United States Patent 11,001,841 (CCCTC-BINDING FACTOR (CTCF) RNA INTERACTOME) - sequence listing, part 40

SEQ ID NO: 95605 - DNA, 1791 bp, Homo sapiens
caagcttcctttgcctacatgtcatctagaatgggagtttttccttgtgacaaaagtttaaattaactaaaaacaagcaaatgcctcagggagagttcctgtgtcatgcagtaagtagtgtgtgttcattataggggttactaagagtcggctttggtaaagagaaagcagcatgataaactggaggtaaggtctcatgagaaaggaatgcagccacccccagacagataagctgtgttctcaaagacagttggggttaaacaatttctgtggtggcaaaacctttcctcatttctcactagatgttggatttagacatcttgatcattatgatcagacccttcgaatggggagggtcctgagcaggtaggcctcagccaatagagaagtgctttttggagcctgcacactgttaccctgtggaccacaaggcttagcagcaggccagcgtgttcttttcagcccacttccatgttcacattccacatggcagtatcttcatattgaacatgggaactgagagctttctataaccaatactgtatgacaacctttgcctgctcttttattctgtgaccatgcatgatacagagttaagggaaaaatgtttcctagttcagaaacactgatgcatttgctcgaggataggtccttcactgagtatttggacttggcatctctgctaaggaaggataattgtggcctaatttctggtgtgggattagctgaacacacatacactcccaggtacttcatggaagaaaaatgtacttatttttcagaataatcatataacattgtttcagagctgctagacacaccttaattccctgtagaagcagtgatcctgtagcagtatagacaggaaaacaggcattgttccatacatttactgctagtaatgaacaagagtgcatgcaagccacatttgttggacaagatgtgggtgcttatgtttgttgttaagatagtcctgtaaaagtttaagaagaggttgtgcaagttagagagcaaaaatgaactgaaataatagaaataggaattacgaagaattgggaagttagcttttgtgtctctcctttcgctgtttgaagttataccaagctgagaggaggtgctttgttcctaactatagcaataaggtaccatatatttttagtgcttttttctctagtcagtgctttgcggtataataccgcacatcctgtgttgtgaaaaataaacagagctgtcgaataagctctgctctgtttcatagacagaccagtaaatgaatgttttgaaaccccctatgttagaaaaattagtattctagaggagctgttgtatttaattcatatcttacaaagtaatgataacaataaaaccccatgaaaaaagaataaacaggaaaaatcaaataacccttacttataatctgcccttttggattgagacattttagagtaaataggttgcttgtatcttaaggaggcgagctgtatatttggcttctctagctaaggacagaataagtaaatgagttgtgagaatgatgcattgctgtctcttggaccatatttggaggcaacatgtgtttttgttcttccaccacctctcgtaagagacaagcttttgggcctcattccagatacaaggtcatcaaaaagtgttatatgcccagtaggtttgtttccttgggaaagaaagatactttatttgaacacaaggctcttttgacagcacaatcgttttatgcttgggatggaggtgggattgatcagcacttagcagtttgtcactgtgcagtgg

SEQ ID NO: 95606 - DNA, 1030 bp, Homo sapiens
gctagccagtgttaaagagccagatttcaaagccctctcttgccctttgcttttcccctgagatgtgtctagttcaaatatgcccacggggtcaccctctagacatttagcgtgggaaaggaaccaccctgtacacaaatagcacaaattatagcacagaaactgcagatggtaatctgcagtgtatcttaaaggcacagctagaagtgatcacgttgctcacacggggaacctaacccactgggaatgtggagggtggggaggacttctttctgtgtgtgtggtagtattggtgctgtcttcctgggaatgcactaagacgaagttaatgttcatgagctcacaaacacctttggtccacatgtgcactttcttataaaaggtgtgttcctggctgtttacttatagtcacagaaaactaaaattcaggtctgtctttcctattcagggactggcacatcttcacattcatcatgtgattcaccgggatatcaagggccagaatgtgttgctgactgagaatgcagaggtgaaacttggtatgtaatggatgtgcggcgtgatctcataattgcacctggcacaagccagctgcactcccagttctgcttccatctagctaaaagttcagtcttacccatgttttctatttctgttcttcttaagaatgtgggaactgagcatattacttagcttggctccagcctccccacttccatgtttgtgcccccctgccccctggttctctatacagcagccagactgatcttcaaatcagaccatgccactttcctgcttaaagaaccttaatggcttcctattttactttggataaaacctacatttctcacccttgcccataaaaagccatgtaggatctgacccgtgctacttttccctcctcattttatgtccctctttacttctctcttcatcagtcactgtcttttttttcttttcttaaactttttgggtcttgcctttgggcctttgcatgactatttcccattgggaacacttgacttcagtt

SEQ ID NO: 95607 - DNA, 2050 bp, Homo sapiens
atttctgcgtggttagataattacagcccatggtgttttcctggagttactcacaagggttcttttatatttcttgtttcctttagctgggtctgaactcattccactttcatctaagtgttgtatcaaaattttaaatagagtttgtattaatttttcttccactaacacatcacaacaaaattctttatgtttatatgggtctggtcaacctttcttttagaaatcataggcacagctgttgtactgtaaaagtaagatcttcatagttactttcttgcctgtggttgtgtttgttggttttctatggaggaatctgcccaattggaaactcccctcagagctaacataggaagcacttgagcagttctcataccaaatgactcagtgagttgtgtgttccctgctctggtctcctggtaccagcctgtgatagtccctgagcgatcacttagtgattggttaccattgccttccaagttgctgtgatgctcgcttaggcttcctgcactggctggcctgtgtgtccctggttcctgcactgcctggcccgtgtgtctctgtctctaaaggagtactcagtgagtgagtccacaccctggacgagccattttctgagcgtgttctgtgcatgaatctatgatccctttaagtcatctcagcatttcgtaggcctttttgcatgggctcctccacctttgcaggttcctgctgggttaatggcagtgtgcgtagtgatagtgttggcagggagtgatgggaggcattctgttagaggtcatggtcttcctgccagctctgcctcccgtccttgaactttcctctagaccaccaccaccatccaattgggtgggatgcagaagtcactgaaaaatcagcagaagttccaagtgctttagggtgtgttgtttgtgaatatgtgatttagcttgattttctttatttgattcagtactgtgttttttttcaagaaaactttcgtgaaattcttatctttatggttattagtgctgtttaagaaggtaagtcaagtgcatctcagtcagttctcctgaacctggggctctctgtgacttgatcttgtttgtggcagttctctgaaagcactgaaggttgtggttcattcaaaaggccctctgctggtcactgttggagaagctggggaggcagccagatccaggcctcacagaagcttccagactggtagaggatctcacagtctcggtggctttactgtggaggggcactcctgaccagtggtgcctgccttgagcaggatcgcatattcatgaagcactgctgtttcagtttactatgaagacatttcctccttgtgttttttcccaagtatatctggtttgtagttgtgtttatctttctttatctgcctttttcttcctcccacagttgactttggtgtgagtgctcagctggacaggactgtggggcggagaaatacgttcataggcactccctactggatggctcctgaggtcatcgcctgtgatgagaacccagatgccacctatgattacagagtaagaggcacctgctccgtaggcctttgcagggccactggcatacccgagggatgggggctttgcttataaattgcacaccccttgtctgcctgccttttcagggaggaagaccttcagtgaggaaaattgcaggtgcaaattttccaggacagtattcagatgctgtcttttttgtccatttgcatcacatgactgtgttctcactaaggaatacactggtttcaaagcagtctggagcactttgttgtgcctagaactttttgttcctatttgctatccattttttaacttgaagaatatattagaatcaaatatttattcttttaaaaatattgccaatataaagtaatagcttcatttgagtgaaattttatattcttgttaaaccactttacagcttttatttggtacacaaatttatttaaattattagagtgacctctagggacttgagtcagtaacacactttaaaaaaatctagatgtaaacccatatttgatatcaaactc

SEQ ID NO: 95608 - DNA, 1051 bp, Homo sapiens
cattcaacaaaaatttattccatacctattgtggcatgcatgcctagtgttgagcattgcctgcaggttgagatgtaggaaccagtttttgacgtgtaccatttcaacctttcagtgggacagaaacaaaaagcatgcagtctgttaaaagcagataaccccagaagaaaggctcctaaattggggacacataggacagagtgttgccaggaagatttaccagaagtggtgattcttgagatgagtctcaaaaaataggataggtgataggtaagagtgtcttgaccaaggctagggccatggtcctcatgagctgggcatggagaaacaggaagaagtaaaagtggctagtatggcaaatgtaggtgacagattaatctcttccctccatccctccaaaagaaccaacaactgtaatttccacctttgtaggttaaacagagggaactgacaaatcaaccagtttggaactccggttgaaatgtcaaattaacaggttcaagagacccagcatttcgtcatggattctgctccttttcttatctcattgtctgtccttgtcttctaggtaccagacatctgtcctgtctgccttcattttatcaaagacctccctttacccccttgctgccaccactcctgttaattaagtgattaatgtgcaatattagatttaaacccagttcatttaaatctgacctccttgttagctccctgtttgtggtgtgttgttagtgataggatgcaccacttaaactgtgctaaattaatgctcctgatcctcaacagtcctgagttcctatttatgtttcatacattattcctatgcatttgcagaatgttcacagtgaattctgaagctcttctttatgttgaggcttgtaagttactgatattttcgatctttactctttgtggtggaaatttgatgatctttttcacttcttacaggtcgaagaagttttttagttttatagaagggtgcctggtgaagaattacatgcagcggccctctacagagcagcttttgaaacatccttttataagggat

SEQ ID NO: 95609 - DNA, 1140 bp, Homo sapiens
aagtgggagggaattatgacagggcttggtggttgaccagacaaagacaaaggaatggtgtaaacactgaagagtggtctgatggttctgtttgctgaagaaaaaaaaagtggttaaaggactagtgaaatcaaagaaggtgatttcaacctttccttttactgagtttgaattgttacgcgaatcctaaatagaaatgtcttgtcaagcaaacatctaggacagcattttaagatatttactaaataagtaaaagaagatatgggactattgaattgtagatatagtcatttctgtggatgtattagttgtctccctggagtcagaggaactcagagaatgaatgtagaaatgggataatatgctggtgctattgactcacttataggacagtgtgatcggtgcacacccctgaaagccctgctttttccaacagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagaggtagcaaaaggaaaatgtccaagttggttggtcttttctctttctgcatttacactggtagttagccactcagaggaatatcctctgtagcttcctggggtaatacttatcccctggcacagctgtttacataacttgtgaaagaaagcttacgctttggactggcaggccttcacattccttgaggccttagaaatgttttccttccttgtgaaaactttaaggatctgccccacagttactcatcaacatactgtgttagatgcagagcaagtgtcccaaagatggcatcagaccagttttgtgaagtctttttgcattatggtttaagttggcttgctcaggattgacctgattgcttttctactctcagcctctgggtcccagtttgtatgtgcatatttttctgaaacttcagactttttcacatgaaagtttttttttttctaaatgccttaaccttgggtatactcaagagtaggggatgcagatg

SEQ ID NO: 95610 - DNA, 1635 bp, Homo sapiens
ggaagttgtagtgtcctctggtggagaagtacattttacaccacctgctcatttaactcattaatattgctaacattggtaatgtggttaccttacagctttcacgtttttaatgcacagaaatatattatttccctatacagtcatgggtcgcttaatgacggggatacattctgagaaatgcatcattaggtgatccgtcattgtgggaacatcatagagtgtacctacacagacctagatggtacagcctactgcgcacctagactatgtggtgtggcctcttgcttctaggctacaaacctgtacagcatgttactgtgccttatactgtaggcagttgtaacacaatggtaagtatttgtatatgtaaacatagaaaaagtatggtaaaaatatgatattataattttatgggaccaccattgtatatgcagttcatcattgaccaaaacatggctatttcacttggggatcagaagagtcttttgattttctttttttgactggcttctgctgcatacctcacaggtccaaatttctcattcattatcatttctgtttttatttaattcacagacattattgttttaccttttttcccccagaaaaatgggccaacaacagtaaagccctgtattgatattatccagtggaatttaacctattaagtagcaacacatgctattaaatattatcctactaatttaacagcacactttggcatggaatctttcattcactttgtgtatttgtagtctggattctgaaaactctttataatttgccgcttgtttagaaaaatcagtgcctgctgaactaaggagcctgcaaatattcagctaggacttttagaagaaaacaggacgtacgttcccctgtagtagggacaacttcgctgcttttataatgctttttgtagctaatttgcaaattccttgtggtatttttgttaagactcttttcagtgttctttgaacgtaataaatcttgaatgagttcagagatctgttcaagttgcatattgactgtacttactatattagaatgcttgagttttgagactctggctgtttctagttgtttcttgaagtggtgttttccactatctttttttgatcccggcctgtactttccttaagcaggtggcatagactactttggtggtttataacttgaagtgccaaggaccagatcaagttagcactcatttgtaacacaggcactggaaatgtctttcaggctgtcactagtgagacgagtatccattatccagcctctgcatgtggtaggtggtgaaggtgagcgatggtagaaggtgaaggtgagcgatggctcacagggaagagctgaaattttaaagtcattttgttttataagctaagtagatgctggtgaatgtctgtgaaaacaacaattttgtgcttgtcatgttttaattagcccattatggattttcagtgtaagttcaaactcagggtcatctctttgagcttcttaattaggaaagattaagaaaatattggaatgggaaaagtcacatgagtagaattccactggtttggatttttggtcagctagctgcttgttactagcctgggtaattaagctttatttacactccaggtctgagga

SEQ ID NO: 95611 - DNA, 1261 bp, Homo sapiens
tactagagcaggagcatcattcattttatgaccccatctccacccatgggaagctgatgagttttgtgtattgaattcgaagagcagagaatgggggaaaaggagattcccccattgaaaacctagataatgagagaggcggaaccaaaagcagactcagaacttcactgagaataatgggggtgtagtagtcaggtgagagagactggactaccaaatcatcgttgctatccagttattccagatgaaagatactactttacatttcttagggcatcatttttaagtgttggctttcagattaaatactagttgagagtggtgggaagacccagaaggaatacttaaactataataaatatgtactttgtgtatccattataaatatgtctaacatccctgatagctttaccctaagctttcttgtttaatggttaattttagtgtcacaaataaagtttgtgttaatattattggctctctgtgtctgggaaatttgatggctgtgcatcccctagagttgctgctacccagtagccactagccacatttggccatttaaattaaaattaacttcagtgcaacaaaattaaaaactcagtttttcattcatgctagctatatttcaggtgctcattagcaacacgtgactagtgactacggagcagtgcagagacagaacatttttattatcccagagagtccagagtctagcttgtgctttactggcagacagccttgagctagaagagtgagttgtcatcacgtgcctggcatgtcatcttgctctgttctgtagggttacatagaacagtctggatttagaaaggctgagtgagtctggtgattcagtagcaccttttacacctgttgatgggatgcagggtagagggtggttaagagtatgtatgggccgtagaggcagagcagctcttccagctgggggcttgctggctgtgtgactttgggcaagtcacttaccttttctgaacctgctttcgcatctgtaaagcagggatgaaataatgacttccttgggttgttaggagaattatattaggtaaagtaagtggaatagaaatatcaaatacttagcatagtgccaggcacatagtagtaagcatttgctcagtagcagtttctgaaatacttatattaataataatggtcctggttattcttgttgacgtcagttcctcttttcctgatgtgtgcttctttttttccttttttaaattctttgtctgtctttgctgtattt

SEQ ID NO: 95612 - DNA, 3890 bp, Homo sapiens
tttctttctcttaatgtatttttcttctgacttaagggtcctgcataaccctgttaatgatatccacgaataaagaattttctgtcccctaattgctgtggtgcagtgagcagtggggaataattgttatcaaaatgaaactaaaccctataaggattcacagagtcacaatacttttgaccagcattcatgaagaagcccttacttatgggtccgaggggcagtgtggaaataattggccagtagatatggggcccatgaacctcacctcattagtgtccacctggcactgactgatcagcacactataacatcatgagaaagatggcgggaagatccctggtaattatacatttttacttacgtagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggttagttcacagataacatagcaggcatacacttgtgaagtttgttactttgcagagctgggggatttttagaaagtatacacacatgtgatgcatacacacatgtacacacatacacatatacttagaacttcagatgtatgaacgtggtgaaacacagttggaatgacaccaataaattcagtctcttgtcttaaaaagggtttataaatcattacactttaggaacctgttgaaaccagttaagtggtctctaaatagtataatacctgaaagatgtctgcatgtatcttctcaggcttggcttaaatgctgtagaccccaaatatatgggtgataattaacttttaaaaaaaaaatgaaattaaaaaccaacagtaagaaatttcttaggagaaatatttgaatatccagtggctaagtgaatactgtaatatatatcagcatgtaattctgtatatacacagcacattaaaaaaactaacattgatgagttcaaccaaaaaagatcaggttttaataatatttgcagcattttattaatgtcaggtatgattttatttagaattatttttttgtttcctgaaccacctgtacaaatacaatttgcccttagcccctttgcctttcttgtctttgaattgatctctttgttatgagcttggaataaagaaaaaaatgatatgtgaggaccaatttaaatagcacttggtatctgtattttaaacttataaaccatggtgttaactttcaaatgtgactgttcagctgccgtcctttatgcttatcatgtgtcttgggctttctaagcttgggtctgcatgctcctcggtgttttcccaggaatttcagtgacgctttttatgttacctaattgacgttgtcaaccatttaactgtgtagcgcgtgtgctttaacattccacttatgtttatacctggggtctgcaaagaggaaaacattcaagcttttaagaattaaatcacctagaaataatgattacagttcgatcatgagaggagggtgtgatggtagcaattcatctttaatgctctagtggcagtcattaaattttgtgaatagcaagtatttggcaccacttttaaaaaaaaaaattctaaaatcggttttattctgtttttccctgttctattgtgaaatagtaattcccatgttaacagtgctgtaggacgcatttcatttcagcataagtgtgtatgtttgtgtagatgcgtgttgtgtattgtttgttcattgactatgtgttaggacctttgtggtttggagaggacatgatttttccagctgtccctgtgttgagggcagaaaacaaatgagtgtactgacttgatctttcgagttaagatttaattctgttttgttcaaaaaagaaaatgagttgaaagtcaggttcctttgctccgtcacagttgggttaaggccacaagccttgctagggtaggtattgctgtagcatgtaccatggagggtcagacatagacacaagagacgtagatcccaggtcagaaccagatatgtttgtcagtagccttctgactaagtccgccccacccctctgcccacacccccccagttggcttttttggctcagttttctttgtaaagtaaggttttctaaggatttttatatgctgtaatttcaatattctcccagagatattggttaactaaaacttctgttcagcccatattgatggctatttttgtttcaaggtgtgcaccatgacacaaggggatggtcagcagtagacactcttaaaagggaatctgaatttcaggataaaatgtctcctcgtagtccttcttagtctattcctcttctagagcttttttccctgtccaaaaaaaggaagcctctttggcttgtaaaatgttttatgcttttcaaggttatttcatatcaatctcatgtctgaaccttacaaaaattcctgagggttgggagaggagattttggatgctcatttctcaaatgaggagactgagaaaaggggagctttagagcatgctagggatcatagagccagtcctcagtggaacagggactgaggcctcctggtatccctgtcctttataatacgcatgcagctttgaagtagggttttacccctctctataacatatttgggatgtgtttacttgttttcattgttataatgactaatcattctcttctcattgaaaagaaaaaccaccccatcctcacttcctgctgtctttctctccccttgtccttgtctgtctctgtctgtcacacacacacaagctcatcatggagcctgggtctgttcatttgaggagagttgcccaagtctggaatgtagtcattccaggtgcctttggaattgttagtgaaagcatgaatcatgtttgttgtattttattattaagcaggttttggttttaggtttcaaaaattggtgatctgtgcttgttacaaataatgactaataagcagatgtttactaatcagaaccctctgatactttttaattaaaatcttgatttctctggggtttaccaaccttaagaggaatggcatactgttttaaaattctgtatttgtttacaacagctgtgttctaacagaagtactcttagatcccttcgtgtatattatgggaatgcatatcatcatttgttagactccttaggtcttactggccaatttgaagttcttggagaaatctttagcaatagattttcttcaggtatttaccactaagtgaattgtcactaaaggtgattggagcaaatggttcttggtgctccattcaggtggttctgatgcttttctttgggataatttgattgctgggtgatttctgtgtgacaggagtatatcaggcgacagctagaagaggagcagcggcacttggaagtccttcagcagcagctgctccaggagcaggccatgttactggtaaagccccgcctctgtttcattctgtagcatcagggctccttcatccgtccccaaagttgagcaagctgtggtggtcaccagaccattttggttttgctgtgggcagccaggctgaaatagtgatgcccattttgtggtcctattgctagcacattgcaacatggtctttatttatttatatctctttaataagttaattgttcttgtttggtagaccaacaaggttttgaacagaacttggcactcagtgaacacactagaatgctgagggcagtaggttgaaagcacatgtcacaggatttttacctagtatctataccactaaaactcacatttaattgaattatctcttactctgtccaatgataattatggttagcaacagctgtgagatttttccacaggtaatgtgc

SEQ ID NO: 95613 - DNA, 1018 bp, Homo sapiens
aggcgagctctccagtgtcccatagatttagtgttatcctctccctctccaaggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtatcctctttcctttgtcacttagacattgccctggaaagtcgtataacgactcttcagaactgtgtcatatgagttctagaacgggccatagagtttagctaattatctggtttcttcattttctaactaggaaattgaatttcagaggagtggagggccttgcccaaggtttcatattcagtcagtgctttttccataaaggaccagagtgcctcagttaacatatcccagaagaacttgaaactgaactaaactaaaagattacatgacacagtcactcttaaaaatgtggatgagggaaagagtggtctgatgaactattctgccaagctagtataaagctaaagtgtgcctgtggctcaactttctgactttgcagatgtcaagatgccctgctagattggtgcattagggttacccagagcctcagagtaggctgcggcagggactgctcgggggtgcaagatgggcgacaggtgtgcctccagaggtgttgaatcccggcccacaggtggcagcagccttctattgtgtctgccctcacaggcagtagattctagaaacaagtgttctgtttgttctggagtgcttttatatttggtggagtgaaatgcattccggatttctgatgatagttttttagtctgttggtttagttgcttgtgacagattaatttttttctacttcatcatcatatacagtcttagaattctgagcaaggaggagagcttagagactg

SEQ ID NO: 95614 - DNA, 1039 bp, Homo sapiens
gagccaccagtgccttcccgatcagagtctttttccaatggcaactccgagtctgtgcatcccgccctgcagagaccagcggagccacaggtagcgacagccagctttgctgtggttgaggagactcatgcaacggctcgctgagccgcaggcctgctgtaatatcacagtttagtttgtcaccacactgaaaaagaggagagattagcaggagtgagtttagactaaaagaaggcatagactcagttgatagggaaatatctttttctttctttttgagatttctatgtactcattaagagtatctagagtgagtgatttcttctaactttttgccttccctaactcaggtgttaagtgcctcctttttctgatacaaagatcttttagtttagtttttagagaactgggattataaatacatagagggagagccaggaattttctttgaagtattttaaaagtaagcgctttactgtgtgagccctggctcttggccagtcctatgaatgggccttagatgatgcccctgaaattgcatgcaaaatgtctttatttgctcaaatgtgtattttttgtgggggtggggggaatgaccttttatcagattctcacagggttcaagatccaaaaaagtttagatctagtgggttaggtgtggatttctctgaaataggccagggaaaaggctgtgacctctccttgggtctgctgcagcgttctagccttggctaggtgaggggaactgttgggccgatgctgtgtggctggagcagaacccacagtgctgtccatagaggagaacaagcaacgaagatcatggctaaagatcttagagatccttaaaatgccgattcctaatctcttgctgaaaactactgacttttagatattttcccgcttgccactctgtaatccagaatattaggaacaagttcttaaactcgagtttacttttcactggtgtttgcatgtgtgggggacaaaagtttatgttcttgtggcaggaaactgtgggatctgcagcatggaggagtta

SEQ ID NO: 95615 - DNA, 4953 bp, Homo sapiens
ttgtctttgctcgttgaacgtgccattttgttactcgctctggtgtaaaatgtgacactgcaggtaatgtgaggatggctaggtaggtttgcacatttggcagtgcgctttatcttacaatttttctgcctctctctgcctttccagtctctgctttgacatggatgtgcatgcaacacatcataacccctttgggctctgagagcctctttgtggggaaaaaaaaaataaaaatcttcacattaactgctatctgtaatgtttgtctggatattaaaaagagttttccttgtaaatgtacatttgttcttttctacatactgtgttcccagaccacttcttcactttgaagtgtaactgtttcactgcgtggctgacctaacactgtaccaccccggtgtgtattccgcctctgccagttcctgctttggatttggtattgaccagaaaagccagttttatgcagaacgcattgaatgttttgtgttttgttttcttgtaaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggtaaggagcagaaagacagatgtgtgctgcttttttcctttttgttatttttttttaaagattatttattttaattatgggtatgcaacttgaccaaatttaaaggggcattgaaatttcaaagggactttttactggtgaggataaagttccatagttaggcaattctgtttagccagtggtcagttagcgttttatttttgttaaccctaaataaggtagcaaaatgatgtaagagtaagtctacaaagaataggcttcttaaacaaattcataatctattttagcagttttttatatgtttatacagaagctatgcagttttgcaatattaatgtcaaaatttttagaaaaagtcctataagaaaaattttattttctttttaaatgtaggggattttgttttgtttttgtgtttacataatagtgaaattaaacaaaggagcccatgtcaatttatttttcctcatttggaatttgcttcctctgaatattttcttgcttcctgctagtctttgcttcctgctgatccatttatagaccattgtttggtttctttgagcttattttcctgattctcacattatctcagcaaatgctttgtatgtccctgctaccaagcttcagtccaaacatcatttaaatgttacaggagcatagaaagcctgtttgtactggcttcttggatgcttgtgactaaattttctctccgattgtatcagtgtaggaccagggaaggagttggggtggggagtggaggtgataggaaggactgcttttaaatattaggactgctttaaaaatatattttggtagggaagtattttttttccttttcatgttttcaataatttaattgctatattttctacttaaaggttcctgtgagaacaacatctcgctcccctgttctgtcccgtcgagattccccactgcagggcagtgggcagcagaatagccaggcaggacagagaaactccaccaggtaaaagacaagtgagcactgagaacaggccttctgtgcagtctaccacagccttacattgtctgtttcataaaaatgctcttaaacacagacgttctggggctaagagattatcagttataaaaggaaaagctgccataaaatccatcaacgtggatggcatcaagttgatgtgtagtaaaaagtgggtttgaatccggatgtgtattatagcaactctgaaatttaaactacttttctctgtaagagtaaatggagggagcagcaaggaagggggagaagttctaagagaattgtgatcggggggagcttttcatctaagggatgttgtaaggcctgtggcataaaacagaaatcacaaacaggttactaaagaagtcactggttgacttcacagtctgcagtaaacaagtgaattcaccaaatactatcctttttaggttctagagctgctctgtccagtacgattagctacagaagcttccttatatttaaattaaagtttaagtttagttaaaatgaaatacagtggaaacttcattccttagtgcactgggtatattcatgagctctatagccacatatagctagtggctatgatattatccagctcaaatatagaacattttcatcataacagaacgcttcattgaccagcactatcatagggaagaaaagatgattatgttgaatgttttatatcttgatcatcactgaacctctaaagttagccttctgcgcatggaaccttggtctgacttgaggtgtcagatggatgatagcccaaaagctgcacagaatcctcagcactgctaatggcagggggactgtggtgttcttccctgaccaagtctgtgtcattaattcttacctagcacatgtgtgctttgggtccatccatggcaggaaatccatcccagctcatgctttctgtaccgtttccaacagcccatacaaaggactattctttgtaagtgtcagtttttgagaacagtaacaggcaggtgagagcagcagcctagaaacagaatatagttttgtgtataattatacaaatacggagtgttttcctaatattaagaactgacttgtagctgtgacagaaatggtgctgcttctacactgaacagtagcattgtatctcacacctgatgattttagatctactaatggtaggatatcatttagcatacaaactaaaaatcgataaaaatccatgaacaatgtcattatatcttttggtgaatttaatgttgagtgctgtttatagactgttttttgtctccctacactttaaagacattggatgggcacaccatgcacatgttggtaatttggtgctgcatctagagatgacacattagctgttctctcttcttcttttctaacagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatgtaagctgcctttcctttcctttttccctgctaatgttttgagctgtgatccatatcttggaagtttgtcttaatctgtagtttgcgtgtagccacacgtcacaaaacaatgttttagcataggttgctagtgacaataatagtcatcctgattttaatcataaaggagctaaattttgagagctttatatatacctagcactgtgagcgctttacaatttagtgggattaactaactttcccaaggtaattggctaatgtgtgagctaggatttgaacccatttctttcggtctgggctccagagcctatactgtcatcaatattggttattttaatgtactcataatagatgagtgaatattccctctactgtattattgacataccatgacaaggtatatattgtgaacacgtgtcaaagtgagtgtgatgatggagggtttaagtaaagagtcaggaaggctgctggagccctccttgggccccctctgctctgtaattcagacctgcaggtggagagcctaccatgagtgggcagacaggagtgggcggggtgggcagggcagcttcataatacacatccatatgttgatatgtgtctgtccatcttgtcccttttgaacccaacagcatcatccaagtctgaaggctctccatctcagcgcctggaaaatgcagtgaaaaaacctgaagataaaaaggaagttttcagacccctcaagcctgctgtaaggattgtgcaggatcagttttacttatttcagacttgaatgagatctttctattaaaaatatgtggttgagaggcctgcagtcttttctgcgagggcccctcacagatttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaaaaatcaccttcttaaactcactggttgcctaccttctgctttttggtacctggggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggtaagcgccatctctgaaaagttccacttcagagcagcactccgaccgcctgtcagctcagcttgtattcgagctgcggtcctgctccttcctcaacttgacttcttgttcttttctagaatttaaaaacctcaaactttactccagttttcttaacataacatttgctgtatttattgttattaaatgtagcttttttgagtaactgtttaaaaagcttcagctataaccac

SEQ ID NO: 95616 - DNA, 2552 bp, Homo sapiens
aaataaaaatgtgtctctcaaaaccttttttatgagtctaaagaagactttgtcatgtagggagatctccttacaacaaagtccaagagtctgtgtatatacatttgttgatctagaattttacctcatattaaaaaacaacagtaatactatcagcttaacataagcagatcttttttttattgtcatgggatttgaactgtatatgacatctttgacttttttttggtgtcttctattttttttttttaatctctctcttgactttatttggtcttttctatcaaaagccataggagctcactttctcatgaaactgggtaactataaaagtcttacaaaactgacattgtggcaatttatggttaaagaacttctcatcttctcctgtccctgctcctgcttgccttactctctcttttctgtcctttgctttaggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcagtccccggtctcttttagagcggatgagagtattctctcagagcctgctttccactgggacctagttgttcctagactattccgtgaccccatgagcacttactatgtagttctcgtggattcagcagcaggtcgccttgtgtttccccttctcttcgttggtgtgtgcatatgtcagtgcttcccccagcaccccagcgtgtactttattttttccttttgatttgaggatatatgatccaggggaaatttcagtttggtataactactttaattagccataattattcattctaagtttttgctcagaaacaaatggcactggaaagaaattctttgttaaagggagaaagctaagcagttgcttttttggaggaggctttatatcggtagcctcatctcatgttttgattttgagaaggcgaaaagcctaaacaggatctccttgactccagagattaaggcctttcacgtctggattttttctccataggtcatctctgaatttgagcaatggtgaaacggaatctgtgaaaaccatgattgtccatgatgatgtagaaagtgagccggccatgaccccatccaaggagggcactctaatcgtccgccaggtacccgtgtcttctctgttgtcagaggctgagcttctcctgtggtcattaacccacttgctcattcactcactcatgctgtttctccatcatcatctgttttcatgttaacaagtcccagagggtcaagtgtcgagtgtcgggggctagggaggcaggtgtgtactgcatgcccagaaggtagcgagtagtctccaccccacatcgctgctcctctgcatgtctgcggcagccctcattcaagcaccgcgctgagtctcacagtctatgtctgagcgggagagaagccacagggagtccttaaacaggctcacagagtgaggaagcaggtctggagtctggcagagcagccaccatggctctgcagagcacgctgggctctgagtgtctgcagtgccacagtgggagcgggtgaggcaggcaggacgagcctcatcacaggcccagagactcggagagcagaagggttcgggaggtttctcttctatgttccaaaatgttagttttctcacttgttgaataattaaatgtgtgccacccagatatgctcagtttggatcactaagctttataactgtctgttcatttcttagcttagacttaattaaagtgatacgcttctcatttaaatagaacagggcacctatttagtattttggactttgccctaagtgtgtttcatgctatggcaatgcattcggatggaaagtaggaagaatgtggaaaagaccaggattcagagaatccacaggtactttctggagctttgcaaagaaagatttaaaaagaaaaaaaaaaggatactggttttggtaacagaagctagcgcaacagataaaccagattaaacactcactgctcgagccgtgcagccaccagattaggtactttgaattctgttggcacaagttaggcatttggtgaggaagtgtgagcagttcaggctaatttctttggtttttccttggtaatttagcagagtttataagtcacacagcaccttaaagcagttatcaatagggccataggcaattttagcagcgcttgagcgagacaagtgtgcctgttttttctacagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgaggtatgtctcgcaccacagctggctgctttcctggggttagaccagcactg

SEQ ID NO: 95617 - DNA, 3028 bp, Homo sapiens
ccaacaccctcaccccttcccttcccaccctgctttctctgtcacctacccttctccccaaccccaagtaacatgtttcagatctgcatataaaccccttaaccctagatcagctcccccaaacttgccagttcactgtttactgttctgtagataagtatagttgcatggctttatctagtttattttttaaaaatctaaataaaatgattgctctgtcctcagaccggtattatgtatttggcatgaaattcttatagtcatttgtggaatctgcctttttcattctttttatccaataaataaaatataggaagattcggttcagcaggcttggccttatctggacaaacttattatcctgtacaggaatctctttcaaacagaactgattttttttttttttcttgtttggggggtgggttgttggctgattactcttacttgttttcaccaaccctgttaaggagtttgttctttgacatttacaatcactcagaggtttagaagccaaattatttttgggaaacctagaaaaaattaggatgttaagcaagaaggacaaaggtttgagcttgtttttaatttaaaattttgtgtgggaaatctgtgtgctcctttgaaggcttggttgtggtgctcggtctgggtgttagctcagtctgggtgattctttgctctttgaacagggttatactccaggtgtagtgacatagcccacttgagcacccgtattgaattaaacaagtgatttgattccacagaagatttggtttaagtgtctttatctaccagttgagggaggttagaaagaatcagaaaaatcctctcctccggaggagcagtggcaagtcaactgcttcctagacaggcttggcatcggctagactggctcctgactcatgggacagggagggaagctgccaggggacagatgttcaggtgggaagcttaggggagggcatgggctctaggacatggtgaccctcaggtgtccatggagggggtccaatggtacaggacaaaagcacttgatcagacatgttccttttttctcctgaggtatatatcccacctacactcacattcttccttatatttatattttaaactttgctccatttcgctctaatgtgcagtattttactataacccttaactcactaaaccggcaaatttatttttctgtttgttttgtttttaattgtcattacatttccacttaacaatttgtttcacttcctttgtgtttttttgtcttaagttacattattaaccaaaacactagtgctcctaaaagatcaaaaagatacgccttcttttgtcatttgcacctttcactaatgagtcctcatttggtatgggtttaatggtgatgcacctaaaacaacagtagccaaagcttctgtagctttctggcaagaggctcaatttaaaataactacaattattaacaattgccaatattccagcatagattatttggactcttgggtaggagaataaattcagaagttggtgaattgagatcaagacatttcagacctcctttaggagtttcattataagtatttacttaatttttttttaaagctaggcacatgaagtctagatttcattggtagcttgcagcactgctttgtaagtgagcaatgtctctggtagagatacggctcctgcagtggttccaggtaaagctgccctgaggggtgctatgccacgtggaagctccccgcagagcattttttgggggaatgatgcaaggcaaatagagcaaagtattgggaaatagtgcaatatagaagtgaattgaaatgtgtatttttaatgttcatttttaaaatgccagttgtattaataacattgaaatttacattgcagactcagtccgctagtagcacactccagaaacacaaatcttcctcctcctttacaccttttatagaccccagattactacagatttctccatctagcggaacaacagtgacatctgtgggtaagtacagtagcaacaagaaagcagctgacaaatgggactttatctttgagttgctcttttgggtggcttaggtgtagctggttgttcacaggcacagacctcgggtacagaaacttcccatcccagttgtatgccttatttgcaatgagatgcagagtccatttcctttttccatatacattgcttacagatttcttctctttgacaaagtgttggttataccacatgaatatttacttgaagtatactggggaagggaggcaggcatagtgtgtgtgtgtacagaaaataatttcaaatatattgtgtttcagtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggtaggtgtctagccactactccaacactttcatttttgttctgagtggtggctggtcttctagagaagtactgcattgaatagtttgtggatagacaggatggaagacttctatgatgtccatctcctgttatatgcagagtggtatattagcagactggtgtggcacatgtatatgattgcactcattttaactgtcaaatattggcatgattaatctccattttatttttattaaacaaatttttgtagtagttttgttacgtggatatattgtatagtggtgaagtctgggtttttagtgtaaccatcagcccattatactcaatagtgtacattgtacccctgaaccctgaggttgactgttctcactataaaattcaatcatatctagcagtggaaatgttggagaagtatatttataaaaacttactgcaacatgcaacccagtgtttttcatttttcatgcttgtaatttccaagtactttacagtgactattcttttgactattagcattcagtactttataaaattatacaa

SEQ ID NO: 95618 - DNA, 1225 bp, Homo sapiens
tatcaaatcacaatattttgatagtcctaagaaatggaaggacaagagaactgactacagttgtttcttgatgatggtggaaagtgatctttaagaaaagcttaaatgtgagtgatggaagccgaatcataagctgttaaggatttgagggctgcatttatatggcccattccagagatttgccaatgaaagatgaggaagcacaaagagatcatggtatcagatgaaggtttgttcaaatgtgtgatgtggctaattagacatagaatctgtaaagataggaaataatcagcatataacattctcgaggaactgaggaagaactagaaactaatggattattaaggaaattgatgggatgagggtttcttgttctttcccttatcctttcttatgtttaaatatgtcagcatcattgctacatggtgatgtattgcaggattggttactttaactgtttaacctttgactattttaaggatttctgcttctgggtgaattaaggaagctacacttttttccaaatagatgatgttatcctttctatacaacctggggatttgccaagcacagcataaaattgaggcctttctgtgtccctgaaacaggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggtgagtgtttgttttgtaaaccagaatatgtgacaccatcttaacaatattgtagctttacacactaaacttcagttagctcattcactgatgtactggctaaataaggtacaaccacattgagacttgacaataatgtgagctgaagacgtattcagaggtgacacacacgcccatttgatctctggctcctccgaaagcagtcttgagaagcgtatgaatgtgctctttctcactggcatctctcactgccctctctgcccagttgcttgttagatttcatttgccttgtccaatatgtaggtctgtgtccactcctttccaccagacttttttttttttttttttgagacggagtcttgctgtgtcgccaggctggagtgcagtggcgcgatcttggctcactgcgagctccgcctcccaggttcaagcaattctcctgcctcagcctcccgagtagctgggactacagg

SEQ ID NO: 95619 - DNA, 1057 bp, Homo sapiens
acttggacttgttcacagatacttctgttggtagaattcaggactcatgaatattttagtataagccttttttcttcctcagtctgtgtgagccccatgcaggactagggaaagttgtaaggaggacctcggtctctgtgtgtttcaggagtctcttggctgattaatcatgttgttactcatttggagtaatactaagcccttgaagacttcagggtggtatacctggcattgtccttgattttaaaatatcttggaatctattataagaagattaggatcattagcgaaagtactcattgatggtcaaaatacattaaagagctggaaaaggaaactgtgaggtgtgatctctctctctgaatttttcccctgcttgtttggatgaatgaatagaaggcatatttataaagtttgcagaagacaactaaaacagtttagagggctatgttgatactgacctgtgcttctcttgcttttttatttgctgcttttcagtaaaatatgaaagaatcaaatttctggtgattgctttgaagagttctgtggaagtctatgcgtgggcaccaaagccatatcacaaatttatggcctttaaggtaacaacatcaagtgaatttaaaagtagtattggccattcaagctgcaaccaagagtcagggaatatgtttaaaaagtctgaatgttaaaattgctaatataaaagctatgtgctaatatagcatataactttatcataaaccatttctaatgtaataagcttagttaagctgctttctaagcccacagtgagaaggagagagagataaatgttgggtagacactttaatcgatgtggcaatgtgttcacagaggaaaagagaacagtacttccacccttcagttaaaaaggtgaccttcacctgagtcatggaagcgtgtaaagatttagatgtgtttttgataacaaaactgtgtctatcgggcagttttaagatatatctgttcataaaatactaattaaaaattaaattacagaaattctgatgacaacattatatactaagtgaaaaaagtt

SEQ ID NO: 95620 - DNA, 2007 bp, Homo sapiens
caatagctccatgctcttagacaagtggaaatccgccttcctggctctgtggagcccttgtgaaaacctcttagctcttgctttgactaacatgggatggatttggggcagttgctgccaggccagaatatccctgggttgggagtggttctcaattggagcccagcatccaatgtttcatgggcctcaggagatatgagtcagtagagtatattactgggaaaaagcagagttggggatatatattgcatgactattctaaaatgttaatctaattgctgtatttatcttcagagatatggtaccagtgcattcactaagagtcttactgagcacttgcacagggctggaaataaccacagacgttcttccctgtactttgttcctgttctctagatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtaggtatggagaacttggggaaaggcagcatttgtgaaaatggagccgtgtctgagactccatttatttatcatgctgattttgtatgtccttcagaccttttgactaccattgaacagagtagttggcagtagatggtggaaagttagattgtaggccgtggaaatagtcataggtctattttagaacaaaatccaagtaattattttctactttaaaaactctattatcataatctctcatttaatccttaaaacatccagaggaatatcggacatgtttttgttgaccactttgtaaagggagacagagaattggtaaagagacagagaattggtaacgaattggtaaagggagacagaaagggaagttatttgcacagaatgctagagccataactacaaacagccttgtgcatacttttctagtttgcattcagtaataaagaccgatatttgacattttcatgggtttctattccaaaactattttggttttattgtaattaggtcactgtctctgatcactcatgatttctcttccctgccgtctctcatgactggattgataaaaatctgtgcactaaactctaaactcagtgggtaatttttctagataggcgtgaaaggcctaaggaaaatgaaatagatcaaccactgatgcaagtaactacttcacaggataggcaaggtggttacaaaggcagagttccttgaaaacaaatccttaaatgctaggcatttaaattttaaattttaaaaagatttagaagtataaaaatatatttttattaagtaagcaacatcttttcagggctgtttcctcatctttaacggtttgcaatttttccctccccaaaagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtaatagttcccttatggattctttttagttgctctatcttttaataatggcttgttttccatggagtttgatgattaatttccttggagttttgataaaaataatcaaggaactttttaaacgttgctttttagtcatgtttgtgaggattggggaatgttttgctttttgctatgaggggatagagatatttttctctgtagaaattaacatatttgggttttgctttgtatatgtatttttaactctattagatgaccagtctaggctataattagagatagggaagataaaagctgccagttcagttggctggaattcttttgtgagtggaaggaaccgccgtgccatttgggtacatcaaaaggttcctctgacctaatgtgtgtcaagaagatgccccttgttagtctgtgagtggtgaaattgcttcctaggtttgcatgacagaa

SEQ ID NO: 95621 - DNA, 1985 bp, Homo sapiens
atccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttg

SEQ ID NO: 95622 - DNA, 1066 bp, Homo sapiens
tctaagaaatttggattagatattccagcacaaagtgacttttaaaaaatactcatttctattttggccaaaagtgtaaaattcaggcaagttactcaccagagttctgtggagggatgcggacagagctgaccaaggccattctgctcttaccctgatgtaacagcccttagaaactaacattaagtaactgttccacaataaatggtattgagtacctcttgattctttgacagctttattgagatacaattcacatactgcataagtcacccatttaagtagacaattgggtggcctgtagtctattcagagttgtgtgtccatcactaacaattttcccacgtttttattaccccaagatgatactccatacccctttgctgttatcctccaatctctgcctccctccactctgccccctcaagctttaggcagtccctaatctactttctgtccctatggattggctgttgtggacatttatagaaatggaaccagtcaccatgtggccttttgtgactggctcctgtcatgtagcatagtgtgttatagctcatccatgttgtagcacgtgtcagcacttcatttctttatattgccatccttggttcttaatctatgttcctggtgttatacttgcaactaactcactgacagctaggtccccagcctcaaaagttgcagagttaacctttcacccctcaggggaaacagccccaaaagcagctccagaaatgggttcctcctaggtgtgttttcagtttaagctcttagaaacccagggatctctttccacagatgatcttgatgccaaacgtaggcttatcataggtcagatgcagcgagtcaagttttggaatgggggaccgttctggaagcacagttgccaacataggccctgcctgctgtggagagcaaacctccaacccggaaaagttgggatctatgggcgttctttgtgtccaaatcctaaatcagggttctgaggttgtcccctctaacttatgtgggctcacccctaggaagggacataagagctggctttgctgagctgggatccttt

SEQ ID NO: 95623 - DNA, 1027 bp, Homo sapiens
ggggccaagatcaagtaggaaccagcaattcagagtaagtagtatgaattttattctaagaacaatgacaagcagccagacagatcaaaagcaggagagtagcatgagttgattttcatttctgaaacagcagactggccgctgtgcacagaatgatccattccagggtggatcagaagtgcaggtacagaagcgcaggtaaggcatgaaggcacaggtaacatgatgtcattgaagatggagagatatggatgggttcaaggcaccttaagaggtaaaacccacagatttagtgttggactgaatatggggagaaatatggcaaggtcaaaaaagttaaccaggctttttgacatgcactattgactggatggtgatgctattcagtgaaggaaaatggctctggaggaaaaccagatttaggagtgagatcatgagtttggtcattgctacgttgagtatgaggtgcctttggatggtggaggtccagagtaggtcatggcctgtatgggcatggagcttagaggaaggactggagacatgaccttcaaagtcattggccttgaaatgatatttgaagtagtgggtgtgaatgagattgcttaggaaaataatggaaaatagaaggcttagaagtgaagaaaaagacagactgagaaatgaggaggcaaaagtagttgaatttggtgattgacaagttgaagaaggtgaaagaaaagctgttgcctagaatggcttctggattttacatgtgtgtgatctagtgggtgatgatacattaacaagctggggataacttttgtttgggacatgctgcatttaaatagtttgtggaatgcacatttattattgccatcataaaagatatgtatttttgcatttttcttagctcctctcttacaacttttccatatcccactccaaatatataggaggaatactggaactaagtaggtgatcgctaaattttggcagacaaatgggagaggaaagaagtagagaaagactgaggggcagggagtccagg

SEQ ID NO: 95624 - DNA, 1093 bp, Homo sapiens
cagggattagttttgtgaaatttcctgctcccatttctcattttagtcacagcaaaaggagcggtggacctgggtttacatcaaggctatgcactcaccagctgggagactttggagagatcgcacagtcttgctggtctcagcttccttactcataatttggggatagaaccatgtcccacacggttgatcatgagaagcaaagccgggaaatgttgaggtgccgttgcctggcaaggctcttcaaaaccagtggactacaacttgatctcttgctattaatgtattggtcagtaaattatgaattagtcatttgaaagtgatgaaaagtcactacgttttgagaacatcagcaagttctatttctactcaaaagcttagtcagacagaaagaaaaaaaagatgaccaaaaaattgggcacatttgtacattttgaatttttcaaaggtgtgagactttcttcctactcaaatgtcttctgatcctgaagttggagagcaacaagtacctatatcctcagacaccttgtttagaaacagggaacagggaacattcgcaaaagagagaatacacttagcacacaaggtttgtttgtttgttttaaaaatcagaaacagtaggaaaaaagagaaacagattgagagaagagagataactagtggcagggtctgggacaagtggcaataagcctgcatgtctgctgtagtttagaatagaccaggaaacactgtatttaccagagaggttattctctgtggtgaaccgagcatcaactcacccagcccttcatcagaaaccaaaggattaatatgatcacatttttaagtgggaaaattgaattccttctccaaaagttcagaaacataagaaacttatgaaatgtttcttttcccattttctatctatggaaaaaaaatcctctggctttggaaagtcaaatgtgtgctatgaaatttcacacagaaaagtatccacttatttgagcggtggccctgatcagtgacctttatgattccacaaggagtttcagctatgttgggtttttgccaattcaagacacaaattagttatcccttttgtacctgccctgtg

SEQ ID NO: 95625 - DNA, 1123 bp, Homo sapiens
ccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgctattgagttgtcatgatgaattcttttttatttctgaaattatagcatttcttgaatttaagagaacaaaaacttgaaaggcctatgtctccattttattaactattactaaatacatatttgatgctcataataataatacacatttattcattatttcctatgtacaaggactcatctgcttattttacatttaactttctcatttattttctcaatacttcaaagtaaaagacaaagaaagttgaataacttgcg

SEQ ID NO: 95626 - DNA, 1079 bp, Homo sapiens
gaggtagtgtatggattcagtgcattcagatgctttaaccggtctcatgccattttaacaggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaag

SEQ ID NO: 95627 - DNA, 1005 bp, Homo sapiens
tagctgcaaaacactggcctttccctagtgcaccagcttcttccttcttgctttactgagcctttcttctcaggtattattttataagcttataaactacaggtcctaggacattagccactttcgccaactccagaaggaaacatatttttaagcaagtgctggttcaccaataaatacaaattatgactgcattttttcttatgacttatccacagaaaatatggggttttttgtctgttttgtttgaggaacttctgtagcatatcctccttgagtgtaaagttaaaacggatcccaggtcagactaatccaggcatttgcaagtggcagcggatttgtatggcatgctatggaatccaattatgatttcttacgtgtttaaaattttagatattggttttattttttaaattagtttaaatttttaggtttactagtttgaaaaatactaatttgagtccatcagcatttattttgttttaggatttgtttggtgtcagcatggttgtgcctttattgagccttcatgtcaagtcccttggagcaagtccaacagttgctggaatagtaggtgagtggtcgatattgctcatttttagagcactgaattttaaatcctctgaaccaagtacctgaaaacaattcaattttgtatccaaatattatccaaaggtaagtgggaaatgagataaaacaaatttccagaatattttaaaatattaccctatagcaaatgcaattcctttttttctagacgacgtatgttcaaagagattttgagatttgagcactataaccaagtcccatgccactagtggcaacaggtacttatggagcctctgcaaggagctggctgtgtgtataaaagggtaggtacatgtggactcctgcctacaggaacccttaacctaatgtgagagaccagggaaacataatctacagaaatcacatctcgtgggaaagggtttcggtgaacattagccaattagttgcaagcttctc

SEQ ID NO: 95628 - DNA, 1005 bp, Homo sapiens
cttgtttatctgctcagttggatgagtgtattcttaacatcatgaaagaccacattcttaagcatggaacagtagcatctcgcccaccagtacagatagaagaactgatagagaaacctggaggcatcatagtacaatggtgtaaggtggatgatgactttacggcacaagatgacaggctccagtttcgtaaatgtacttcaaatcgttttgaggatgtatatgtaggttccgaaactgaattcagagtattgcacatagactccaacgttgaagatcatttcagaatctgcacccgaagagatggctgacaggagcagagtccttggagtgtcccccaattagttcattccatatcggagcctcatgagtggacagctggttttgagaggagcagtgtgagcaatggaagaaatacgtcatgccggaacgattctaaatcttcaggtgttctcaactccagagctccaacttatctttctgggcagacattaatatttagagttgaaactgtggaactaccagacagaagagactgtataggagtgtgccataaaaacggaatgtcggccgggcacggtggctcacgcctgtaatctcagcactttgggaggccgaggcgggtggatcacgaggtcaggagatccagaccatcctcgcaaagacggtgaaaccccatctctactaaaaatacaaaaaattagccaggcgtggtggcgggcgcctgcagtcccagctactcgggaggctgaggcaggagaatggcgcgaacccgggaggcggagcttgcagtgagcggagatcgcgccactgcagtccggcctgggagacagagcgagactccatctcaacagcaataacaacaaagccgggataaagctgtatgcattggtacaaatggtgcatttttgtaaatggaaaagaaatgcctcatcagttacatgcaattacttctgagtccactgtcacatttgacattgaagctgtgactctaggaaccaccaa

SEQ ID NO: 95629 - DNA, 1048 bp, Homo sapiens
attaagacaggcgcaaaacgatccttcctcttctgtgcgccttagggaacgcccgaaggcatgcaaggctggggctcaggggagggtccccgagcgggcagtcagggctgccctcaggccctgggcaaggaggtttccggaggcccctcagttctcgagtgtgtgtgtatgtttttggtggtggtaattgggaagcagggggtcaagacccaggagtgcagagagtgggagagaggatctcctccgcccatcctgggctcctgtcgggcctaacctccacccagcgtcaactttttgctgctcccgttagatggcgcccaagactttctaaccacttgtgaaagtgctcctggcccggaacaaaaagaaccgtggggtgtgagtatgagtgtgtgtgagtgcgagtgcgcgcgcggggctggccacagggcacaggagttgcctggcactacgcgtggccccgtcgcgggtcgggtcgggccggcccagggctggggcgcgctcacgggaggagctgcgcgcggccggcggagaactttcttcttttcccttcgctctccctcttgagcgagcgcctaggccctggccactctcccggagagaagccgggcgacccggccgcgggctcaagcagccagcgccggctgcaagtgaccgcggtgcgcgggcggaaaggggtcccggacgtgcgggtcggagagctgggacgcacacgacagcccctttctctgcccttacttaccggcccagcgctcacagccgctgccctgtttttaagagaatggcgcaggtgcaagtttggttgttgcggttttagccgctccaaggaaattgttcagtgtaaggttacctaagcgtactgcgtgggcgtgtttccagaaacaaagggcaaactttctcgctcccaaagccagtgaagttaaacagactcccttatgaaaaggcccttggggaccctagggcgtcagatgcgacagctaattttaaaataactgtttaacaggtgattagggagcgcgctttctctccaccaccaagttcacctctt

SEQ ID NO: 95630 - DNA, 1063 bp, Homo sapiens
tgtgtagaaatgtctttgaaaaagatcctaaggactttttatgaaaaatagcaaattagggccatttttttaaagccctttctaaatggacaacaatgaaaatgtttataaatatgtttaaacctcaattatgttaaaagtaggaaagccaccaccttatgtcacaaactctggagactataggcagacacaattttaaatcaagtgaaaaaccaagtcttcaataatcgagactcttttgcttgagaagatgctaaaatgttgtaggagcaaaaggaacagtgtggaagagacagctgaagaaaatacaaagggatatttacctaacaaaatggaagaattattttaccacagctacttaacactgtcaaggacatttaaaaatcagttgagtgaggaggagctctatgagatgggataagacaagaagatatgattaaaggaaactgttgaggtaagaattttgaggatagaccaatgatataaaaagctaaaaattcatagtggctgcagtaagcagaattgacactgtagaaagagggaaaaaaacatggagtaaagatttcaaaatcatacagaatgcagaaaagggataagaaataagactaagagaagctgatctaaactatggagaacagaagaacagataattgctgtggctgaaaaagagctgaataagtcagtaagaattcattggatatttatttttgaagttgatagtacatttaaacattttattcagagacacatgtattgtcactggtaaaatgagagcaagctgtatatggtccaaattgccagctcaaaagccaaaaaaaaaagaaaacccaattcttttttttttttcatatagcaaaagaaagaaaataggaaggaagcattaaaaaatgtaaagattaaataagatgaatgacaagaccgaatagctgttaaaccccatgtaacttgggtattctcatctactaaaatctcagattgggttaaaaaaacaaaacctaaaaaaaatagtctaaaacttaaatgaaaaagatgggcagtgatattccagggaaatgtaaatagg

SEQ ID NO: 95631 - DNA, 1985 bp, Homo sapiens
ctttttattactgaatagttttcgattgtatggatataccacattttaagaattcagtcatcagttgatgggcatttggatttccatttttagttctgatgaataatactgctaagaatgtgcatgctataaagttcttgtgtagacatatgtttttatttctcttatgtgtataccttagaaaccattgctaatccaaggtcatgaaaattcacccttatattttcttcttctagttttgtagttttagctcttacatttaggtctttgatccattttaacgtaatttttgtgtgtgatgtgaggcagggatgtagctttgttcttttacatatggacattcagttgttccggcatcatttgttggaaagactattttttcccattgaattattttatcacttatattgaatatcagtgtaactatgagggcttatttctggaccttattttattccattgatctatacatttatccttatgccagtaccactttgtcttgattactgtagctttatagtaagttttgaaattgggaagtgtaagtagtcttctttccttcttgcttttaaagactattttggttgttctttgctcctcgaattttcatatgaaattttaggatcagcttgtcagttcctgcaaggagccacctaagattttgatagggattgtgctgaatctctagatagattttgagagtattcccatcttaatgttagttaagtcttctgatctctgaacatggggtgtccctctatagatacagatcctttttaatttctctcagtgatgttttgtagttttcagagtctaaatttggcacttttttgttaaatttatttctaagtattaatgtcttaacttctattgtaaatagaattgttttattttataatatttttgggtttcttattgcaagtgaatacagttgatttttgtatatttttgattttgaatctacatccttgctgaacttactaattctcatagttcttagtggattccttgggattttctaaatacaggatatagcaagatagcccatatatagaagggtatagcaggatatcccatatatttacgaatcccaaagaatccactaaaaactacaagaattagtaggatatttcacctgaaaatggaaatagttttacttcatttttcctatttggatacctctatttctttttcttacctaattgccttggctagaatgtctaacaatgttgagtagaaatggcaagagtggatgtcccaattttgttcctgatcttgggggaaagcattcagtcattcaccattaaatatgatgttagctgtgcgtttttcatgggtgctctatcagattcagtaagtttttttccatacctagtttgttgaacttttttgttgttgtggttagtgtttttgtcacgaaatggtattggatattgtcagatgcttttccattttgatgatgatttggtttttgtcttttgttctgttggtatgctgtatcacacaaattgatttttgtatgttaaaccaaccttgtgttcatgaaataaatcccacttctttggtgtgtatactctttttttatatgtttctggatttggtttgctagcattttcttgaggatttttatgtctaattgatattggtctgtagttttcttacaatgtttgtctggttttgatattggtaatactggcctcatcgaatgagttaggaagtgttctctcctcttctgtttttggaagagtttgtcaagaatttgtattaattcctctttaagaatttggttgaattcaccagtgaagccatctgggcctgggcttttctttgtgagttgttgttgttgggtttttttaaatgcttactttttaaaatggtcctacctccttgtggtctgtgtgtcccagagtaactgttcttagcaggaggatttcattacccaattgagtttactactaagatgtttttgagcaactcttaactac

SEQ ID NO: 95632 - DNA, 1020 bp, Homo sapiens
tatatatcaactgaaagaaacactatggctgatgagtcagcatttccatgctgcaacaatgggttattcctgaaaacaaaaataatttatccaaaatcaagaaaatattttaagcttcctttgcaattgctgttacatatttagaagttataatggttttaaaatgtttggcttttaatatattaattaagactaggtgcagtagcttttctctaattatttagtttgatcaggaagttagatattccacaaaagtgaattttccagataagggaaacctatttttaagtgttatttgtaatgaaaactactaccacatactaaaaaccttctatgttatgtgtgaagtgccatcttggagccggatgtacattgccacattttatctttgtaaaaaccttatgggataggtatcttttttttttttttttttaacaatactaaggctgtacactgttctttctactctttcagattaattttttaggtaacattttctaaaataaatttcagtctccccaaccttatttagtaggatatagtgagtataatttaaccttacagtgctttagtattttcctttttagtatgtttgttagcccctgactgtggcttgtagagcacaactgtccctgtggtgaatggctcagctatgctgtattactgattcttgtcatctcccttgctgtcaggatgtcttatgtctacgtgtctgcctctagccaccctcacctgtcttccaaccttctggcataactaaactcgttaagtgtgtgaattaaaactaaaagccattggactctgaatgaggccctacgtgcccctcctagtaagtaaaattcatgaatttatgtcagctattgcagttctttataggtctttttcattgatttccagttttacaactttacttcagagggttaagtttgaatagaaatctggccttgctgaatacagcatatataatttatgtgtgaaaattacacctagctaatgtaatatactagtgcttccttaata

SEQ ID NO: 95633 - DNA, 1555 bp, Homo sapiens
atttttttttccagaattagctcaaattggtgctcgacctttttattaagtttacaagaaaaatattatcttattggtgaaaaagtaaagtattataactaaaaaggaattagtaattggcaggtatagaatctcttcatttcaaagtagtttgatttttgcccagtttcttaaattatattgaaacaaaataaactacctattgttcttacccactgaaccatgatggtgctactgataacctttagaagatctaacaggaggaaaaacgggtagcctctaacaaaattagtagtgtatatggtgttatgctgaaagtactttaaatgcaggctaaatatttagcaaatagaccttaatgctgttatcctcaactcctgtttcatcagtctttcacaggttactgccaaatgttgatcagtgtgtaaaaatttttttttggctgttaacagtatacataactgttaggaggaatctgtcagttggaaccttgagctgagtgagtcttgttgtttagtgtaaagaaaatttggtgtgtatggaaactgaagaactaagcccatgagtgtgtaacagaggcagcagaaacagttttccttattgaccccaagactaaagaacagctaggtgaggagtgcagcaagtgccaatggaactttatagaccttgtaacatctccttgtgctagagcagacgtggggtaacaatgattgctaacctgtttagtgaagtttcttaatcctgtcatgtgtaccatcaaaaattcttttactcaaaatcatactgtaaacaccaaaaagttgaggaccactgatatttgcattttccttttccattgaagcatgtagttgttataaagtttagttgggagacctttctgttatattgaatattatgaatacagacttgcacttgcgtttactaatgtctttatttgggaattaaaagttaagttctacattactatagaatttcaggaaaaaagccagcaaattgatatatagcactcctgaagtctaccaattactttttaattggtattatagacctcattctgaaaccagaatgttttattctcctaagtgtgaatatgctgtatgaagtttctctaattgatttgctgtgcccattccatttgatgtatcatttttcacaatatttcataatttgtgctcacttctaatgaacagagtcgttaggacaggcatgtctaagtacaactgacagctaacattaggtgccagatgcagtttatagagctatgtagaactgtagagaacagtttaaataaattagcacctgtacattagtctcacttgctggtaatttataagcgaatcagtagagatgacatttaggtaagtcattgatcaagttaacagctgcaaacccactgcccagctgggatgcctaattaatagagattgcattcctgacccagtgcttctgggttgagtctgcaattctttcatactttgatttaagtctaagaacatactcaaatactttgccttcattttagggaactgttgaatatcagtattctagttaaaac

SEQ ID NO: 95634 - DNA, 1050 bp, Homo sapiens
cggcaaccttaaagagtaaggtgatgatttttgtatgtagttgagctgtatggacgtggatggtgaggatgtttgaatactaatgtgtttactagaggcaccaccaaaatctggttcttagactgggaaaaaggtatcttgaaacactaatgctaaaccaaatacaaacccaaatacctggctagcaggattgttttgaagcttatggaaaaaccattaactgagtcccaattgatacatatgttttcattttttgttttttttgttttttttttgtggaagggttgggtatttcttagtttaaataataatttttcatgaaggttggtttaggagtgaaaaggtgtttatttcagataattatgaaatttctgttaattctgtcatggttggtaaacttgtcccagtgggccaaaccacaatttggatgtgaaatgccaattttcctttaattgtaagatgcttgggggcccaaaccacttgctggcactttttttctagtgcctagtaagtgccacacacgttctggggccaatgaacactgacagtgaacagataggttaacattaacagagagtcttttcctcaccaccttcccccagtgattttctggttgacctaattttacctttcataatatttaaattttgcattatttttcatgctaatatagatgtttctgaatcacataacaggaaaactgctaaaaaaaaaaaaaaaaaaaaaagaccctgaagtattctaacattttatttgccttcatggttctcattttcttttcttatatttctgagccttccccaaccacatctttgccctaatctaaaattttttgtgaagtagccctattaccccaaccatttttgttacttattctttgtaattatcttatttgaaataccctccttagtgttaattttatattaagcttaatgctttatgttggattgggaaattacaattgtgtgtttttgtttttatttttttgagacagagtcttgctctgttgcccaggctggagtgtagtggtgcaatctcagctcactgcag

SEQ ID NO: 95635 - DNA, 1093 bp, Homo sapiens
tatatgtaaaacattttttattgatccactgaaaactgcacattataaacttaacccccaaatacatcagtatgtacttaacccctaaatgcttgcattcttcatactgttatctcccacaatatcattatcacatctgatacaattataataattctatatgccatatatataatcttcgtgaaaatttcctcagttttccccagaatgtctttgtagctgactaattgttttgtagaatccaggccacttgtcttgtacagttgtgtcacattctggctttctgcttgctttctcgtgatcagacttagaatgtataaaggatactgcttaggtgatattgtatacttctcgttacatccacgaagtctgagaggtacatagtcagtttgtcctgctgttgatgatgatgtgactgatcccttggttacagtgatgaccactagacctctttattgtaaaagtagccttttccctttgtaaccagtctatagggtaatattctgagttcatgcgaattttccattctttagtaacctttcagccagtggctttagcatttgttggtgatccttgcctgaaattgatggttaatttggaagttgtaaaatggtgattttctacttctgtcactccttttacttttataacatattgttctgtaaagtagctttctttttcttcttgccccttctcctgagtgtgtgtgtgtgtgtatgtgtacatgtgtgcgtgtgcatgcacatgaatgtgcatgtcacatattgagtgtgttgtgaagcattatcattattcttttattttcagagacagggtcttgctccatcaaccaggctatagtgtagtgatgctgtcatagctcactgcagacttgaactcttgggctcaagcaatcctctcactttagcttcctgagtagctgggactacagtcatgtgccaccacacttcttaaaaattttttttgtagagatgggatctcagtatctctaaaaagagatagtgagaatgtctcagactcattttgtgctttgtctgccttacacctagaatcagccatttctccaaggtacttggttccttatactgggatg

SEQ ID NO: 95636 - DNA, 1044 bp, Homo sapiens
aacctagaaataaaaagaaactttcttagtttgagaaagcatatcaagacaaacagaaacacatcaaatttaaaaatatatcaatagatcccattaagttcaggaataagacagttatgtgcatactcgcctgtgttatttggcattgttttggaagttttacctagcatggttaaaaaaaaaagtgtggctaaaaaagtatgaattagaaaactgaaagaaattaggaaaatcgattattattcacagatgttatgactgcctacttagaaaatagaaaacattcactaaaaactatattagaatttcagcagactaccattatttgggtacctgaattcaaaacatttaaactatgaattgttctgaaaattttaaaaatgataccctcttataaaagcatgccacagtatagttactgggcgaaatgctgatcctgcagagatcatatgagcatcctgtcagttgatgactctgtggcagccacatctacacacaaagaaatcagtgtggaatggcatgtaatgatgaactaaataacatgatggtcttactggtagcaaatgaattgcaatctttcacttcctttatgtattttggcagacaagaactgttttaaaaacgctgaattccaactatacaaatacatacctacatattcatacagacacatacatacgtatatacatacatgtacctcctttttctcaattcatttaatggaatgctgaaaaatagactatgcagaagataacagagtttggtcaagactttaaaaattattgtgtgtttttggagttaagaaattcaaactctagaacagaaataaggtggctagttgaagaatatacatacagctttcaatacttttaaagtaatagatattatgtccttaaaatcacaaaaactaaaggacaaagatgacaaattacttatgttgaagttaaaaatttctctttgacaaagacactaggaaatttgaaacatgccagaggcctgatacctagaataaattactcacaaattaacaaaagcagcttacta

SEQ ID NO: 95637 - DNA, 2023 bp, Homo sapiens
tcttgtctgcagccatgatgtttgtcattttttatcactttctgacggactaaccatacagtgaaaatcaattgcataagaaaagaaaaatattagaaaatatgccggatttgattcatgaagtctatgacaatgattttggaaaagtgctgaaatcaaccataagccattagcaaataagaatttggtttttcaagctaaatacccaagcaagactttctttttagcatttattatgaaaatgtggtctttgtttcagaagaaagacatcctacatataatacaggtggtatttcaatagaaaagcatgtactattcaaaaaactgtagagagataatgactctttactgaacaaaatagttcttggatttctgcctcacaaacataaattccagatagattaaatatttgaacatgaaaataaaataaaaattccagaagaaatacaagaaaatagttttagagagcccaaagccttaaagcatgtttcctcagtgggggcaaagactggttcacgggggtggggaaacctaactgttacaatggtttgtggccctccagtgggccacagtatacttcagcagatgtgtagtgtatctgtggtattaacatttcatgcgggggcggaaattagggagaaaatgcctataaaggattccttcatgggatgaatcatgaaaaaacaagtcatgctgccgtagaggaaaagcgacagatttgactatttacatattttaaacttctcgattatgaaaggtaacataagtaaaagtaaaaggcaagtgacagcctgggggaaaatagtttacaacttctgtaatggaccaggaagtataatctgcttcagagaaacaacagagatagtatgcgcaaaggacacagagttagcatacaacagagatagtatgcgcaaaggacacagagttagcattcgtcttgtttcttagactaacaccacttctcagtttgcttggtggtggttagttagatatgaatgcccatctgtatttcagaaggaattacacccaacacctttttgaggcttttctgttgttgatgttttaaactctcggaggttgatgaccactgggttgaaacaaatgatgtagcatagaaaaatacattctttagttttcatttgtttacctgttttagattctctgaatgcactgcatttttttactttatcagttttcccttttaaaaatatgggagggagttatgtttatggccaaacctaaatttttttattctaacaagatgatttgggctattttataagcttttatttgaaacaatacagaaattctcatagtgaaatatttagtaatttttaaattaaatgtaaacattgttttatgttaatggtatgaaatatttaatatcctaaatatttgcatataaatatgctaaactaaatattaaaattctaaatgttggtgatttttttgtattttttattactcaattataaatgtgtctcataactgtggttaaatgcagctatttggtctgtctctgtgtatatttttatttgctttcatctggcttttttaaatcagcaatccagtggggagaagatggccgtccatttcactatctcttctatactggcaaacagtcatactattcattaatgcatgtaagtatattgcatttatgataaataatatgagctgtaagctacaaaactaattatactggatactgttcgcagcttcagaatttacctagtattttataattgacaaaaataagacttctagaggtaggacagtgtgttgatgaaatgatttatagtaattcatttttgctaaaggtgaactttatagagtttatatcagaatggtttgtctttaaaatgcttttacttagaaattgaaatcatgttccaagatagatgttcaactcaattatagtgtgtacatgtgcttccagggtaaagaaggaggaggccaagtgtatgatgctgtcgggggctgtgaggcatttgccttgaaaaagaatcaaatggttatttct

SEQ ID NO: 95638 - DNA, 1098 bp, Homo sapiens
ggcttcccccatctacagtcagattgcagtggcttgaatcagtgcacacatttactctgctttttagaattatctgctgtttatttgtgctccacaaacccaaaggacaaaattcccacttgtcaggtacatttatttcttgggggaaaaaaaaaaacaaccttcttttcgctttttgttgaccttgggcaaatgagcttcttgccctggcagaaatgaaatgaatgataaatgtagagtgtgtctttgctgagtaatggagctgcggctccggctcggtagaggttctctcccgcacagcctgaggctgcccggggacccctgctgttcatttaaataggtatgtcaaatctgcctccaaacgccgccggtttgatctgtggtaatatttgtgaaggttccatatggacttgagccccctgcagtgctaagaaataatgtacaacgcttcatggtgcagacgcaaattttctctgaaaagggatgcaatgctgcgttttagctgtcggaggggatgatggagctgacgcgctaggcctgtcaacttgttacacggatgggttgcacgcagcgaagctgtggaaaatctgtgccttttaacttttctacttaatcacggttgtagcattgcctttagactgtatgctacattaattctcttcctgccttctgcctttcatcccaagtttcacggaaaaaagtaaagcatgcaggtcttgtagaggagccttatcaaacagctgtcatctgacatgccatttgcatttgttttggctgaaaccgagcaacccaagggcaagatattttgttacattccatcataatgaggaaattacacatcctataagagacctaacttttctaagtttgtttttatgttttaaaaggtattgttcaagaaactgatcagtttctaagtggatgaaatgttaccatactctctgactaaaatgtcaaatgatatctgattaataaacattctttgtttttgagtaatttaagttttgttacgtatctatagaagagtcctttgggcttttatattttagttcaatgcagtaatttctaagtgtatgccttatgcatacatttcagcat

SEQ ID NO: 95639 - DNA, 1038 bp, Homo sapiens
atttggagaatctccagttcattttaaaggacttcagtaacctactcggttcttaaagcctggaacagcagccccagaagtgtgctgcttcattatgtgaagattccagactcttagcagaagtcctggggacggagtatcacagaattcttacttagttcagatgtgtctagatcctctttgtgaccttgcagagaatatttaaaactcttgcatgtagtgctgtcttttaaaaattaagatagtgacccttctcgcagtgaggtgtcgtgaaataactacaactatgtaaagtgcttattttaaaaaagctacaaactgatgctaaaatatatttgcatgctgttttaagactttccttgacagcaggagttaattcagtaattaattcagcagtcgaaattgctgttatagaggtgtctttaatgtatattttcctcccatatgaataattaccattgtatatctggtatgctccaagtgtaccaattaagaaaattaattttttagaaaaggattcaacatattattgtctctatgttggctttaattagattacctctttgtaatggtataattactataatatatgatgggcctttaatttgaatagtaaaaatatatgctgtctgagttataagaactttcaggtcatcactcctgggtgtggacttccccagagtcctttttcatatgttccatcttgagatgattttctttgtatgttgaatggcatttacatgatgtacaatctatatagtatattgtattgtattcacaaagtaatagcaagagtctataacagaagtatgtcacttggaacttgagatacatagcgtaaacctcttagttaatgataagtggattacatttttatttgtttgatttgattttgtatatgccagtggccaaaaaattgaggagagaatttaagaaattgattttctgtgatttctttaacaaacacagattttaagtcagttactttactattaccatactagtatctaagataattactattagttactatttatg

SEQ ID NO: 95640 - DNA, 1088 bp, Homo sapiens
tgatagaatatttaattactatacctggatatgatgtcctcagaatttttatgtatatagctgcacatttatttagcatttgcatgctttaattttttacattttatttttatattttggtatttcaaggtttctgcttccatttggcagacagcgataagatcagatccatcaaactgatcagccagtgttaaattttggcctatctattcaagatttcttccataaaggaagaacaccttgtttaagttaagttaaatgcactcctgtccctttagttgaccttgctaccacattagtctattgacaggttaacgttgtatctataacatcttctttgaagtaagttatacaggcacaattttaatctttaagaaatctggtgggcttttaataccaagtgagttccatagtggcatatttaactcttaaaacatttgctagagtagataccttttctagagtagattgaggaaatggaatgtatgtcaaaaatagcttagttgggtaaaattactgctatataatataaaaactgattttcaaatcataaaattgctactatatgtgggatcttttgtgatataactctaattgcatggctaattaaaaagagaatatatgtgatattttaacagagacgtgattggcagcagatggctgattaaggaggaactagaagaaatgttagtggaaaaactgtcagatctagatgtgagtaattaatctttttaatttaaggggacctatgcaataagaatacagacaattgctgtatttaggatcctaatagtaatgttcctcagaggcaggtgttcctacgatgacttttctttctttctttaaaaacaaaacaaaacaaaacaaaaaaacaaaacacattcatcattgatttctgccttgggaggaccttatttgtggtcagggaggtgacttgtcgagtctccaagtcctcctcttgtaagtgccctcatatcctgtgccagttgttttagggaagcacggcagatgttgtttcatctccttacgtaaggccagtagctaattttacaagctgatgataagtgtaaggagtcattataggttaa

SEQ ID NO: 95641 - DNA, 1066 bp, Homo sapiens
tatcttgggatctgcaaaccacctctgtcggaatcccttgaaatgctggttacaaactacagtgtcctaagcctcaccctagatctagctcagaatctctagggagttaccgaggaatctttttaaccaactttccaggcgaatcttataccctataaagtttgtgaccccctgctttaggtcttaattgcattcttattttgttaaatgttctaatatatcaacattttcacaggacagttgatgtcttaaacattttgatgttccaaatttattactttctggaagattggggtgtagataaatttcacaaatttttccaagatggagattttctttgatggcggtggctaacattgttagtactttgccaccatatatagattttaagtcatgtacttgaattgttctttttctcatttaatgtattatagaaattaatgatttggaaaagttgcagtttgcttaaacaaagtgtcagacaattggttagtggtagatccagagttaatttctaatatcctaactgccaagtactgctctacttgaatctaactgaaaaatctctttgcttcttcactgaacaagtaatttcattatttcctctgtttctggctgctttgatttttttttaataattcaggtattttttctgctttgtaatatcccacggactttaatacaggtgtacagctatgaaaacaaaagaaacaagttatatatgatactttgtactttggggtactggatatcagaagaaatcctaatgtttatggctggtatcaagatgagggatgtggaggtggtcagtgacttcttgacctagttcagaagcaaggctgagttccacccatagtgcccctttgtaggtgcagaagtcattgagagtctgtgagatgcaatcaagagagtagctgagcacagaacgcccaggccagtgactggagaggagcatggagctctgcccacccaatatcctaggtagctgagtatttcacccttactagaagagtgccttctctttcattacatcataggaagctgtagtcaaagtagttcttttaat

SEQ ID NO: 95642 - DNA, 1030 bp, Homo sapiens
ggctcatgcctgtaatcccagcactttgggaggccgaggcgggcagatcacctgaggtcgggagtttgagaccagtctgaccaacatggagaaacgccgtctctactaaaaatacaaaactagccaggcatggtggtgcatgcctgtaatcccagctactcaggaggctgaggcaggagaattgcttgaacccaggaggcggaggttgtggtgagccaagattgcaccactgtactccagcctgggcaacaagagcgaaactccatctcaaaaaaaaaaaaaaaagaaaaaaaaaatgtacagactgaaaatctaattccactattgcatttacctcgaccatctggctccatgactcagttatatatccagtaattacattatgaaatctatttttctagattttaattgaagtctctttttatttatataagcatttgttaaagaatcataaaattttaaaaattaagccaggaaagtgtttaagctcccaaacaaatggctgtccagaagcctcccttgtaacttcacttacgtggctaacccacttcactgtgtgttaggtgatgacagaattccgatcaagatccctgattctgggttggttagtcttcctattagtcaatggtcacctcactgctgatttgtaagttcctgaagtgactgccctaaatccttacaactactttaaaatagttgtaggtgcccattcccaccaagactaggcttaggcttcccaaccatgtaggaagtttcttgacaataggaatcatatcttaaatatctctgatatcttcacaatgcccagaacaagactggagacatagatgtccttagtaaaaagctgctgaattcaaaccaaagaataagatctaaagatgtaatttcattatgagatcaagccagaattgagacttgctgttaaatcatcaggagttatgtctgaatacaaatcaacagacaggttattggttaaagaacagtcctcctatagttcccaatgttgaagttatcaaaccctggggtatgg

SEQ ID NO: 95643 - DNA, 1050 bp, Homo sapiens
aatgacatgtgataattgtttggaaaggcctattgattttatatctgatcattcaatccagagacattaaattcagttgattaatggagttccccaactgtaagacttctttacgagattattttcaagctttgaaaagatcttctgagataaaggggatcagcaaacagtaagagtgtgttgctatacccaagcaaaagaaataaatcttaatctctcagcaaatcattcaaaatgtcagaaatgttagtgtttctatatcttggtaaaatggattgattgagaagtatgaaaagtataacagtggcatgcagaatattgtttttatgaatattcagaatttcagttgtttacataattatgtatctttatagtaaacgtaaccacatttacttgtgctgtgctttagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaaggtatgagtctaggtgggacgggcatggtggcccaatactggctatacatgttcatctgcttcttgtcctagtgcctgaagttcgtaagaaaatatatagttacatatgtaatatttcacttcgctgtcttctttcttgctacagaaccataacagtatttctcagatttgatttctacaaggtgagcttgaattagaaaaaggggagaactccccacactgattatttgagccctgctaaaatgttcagttccaaggtcagggaaaagttaattttggccttaatgcataaccttttatccagcttaacaaagtgcttagcttagttatatttaagagacaaattgcttgtttttgttttatcatagaaatgtgtgggttttttgtttttgttttttaaacagtctctctctgtcagccaggctggagtgcagtggtattatcatagctagctgcagccttaaacttctgg

SEQ ID NO: 95644 - DNA, 1070 bp, Homo sapiens
taatttttgtatattttgtagagactgcattttgctatgttgcccaggctgttctcgaactcctggcctcaaacaatcctgccttggcctcccaaagcactgacattacgtagcatgagctaccacacctggcctgtcatagaaatttgtaataattatttggttagtgataaagttctttgggtattttgtttttgtaagttattggaggtttccattttttcccattgtggtgtttgaattttcttttaccctactctgtgtaaccctgttacctgggcatgaatacaagagtccctgtgtaatgtgaaaaaggatgggcagttgattcttaccttagactactgctttagaagttggaataaattggggaagtttgagctgaagaccatcttcgcactgttgatgagaagaggaaagcaccatgtgtgctattggcggctgcatggtcgtgggcaagtcacttagcacctaagtctataagctcctcctctgggcaagtaggttggtctctgtgcaccagaccttctagtacaagccgctgaggttcaataaaaacactacctatggcttaggctacttaattgcttaaggctcttaaaaatccatttgcttataagcaatttgtcatcatatgggattcatatctagtcattgaagtaatttgctagaatcttaacaatttgatgagtttgagctactgtgcatatctgaaagtaataaagcattcttacttacagttgaagctagaacttaggtcttttctgtattttgtcaaatactgctgttttattccatgcatgtcctttaagtacaagcaagtgtaaatgttatgggtatatcataaacaaggttttcctttgctctatgtacattaaatggtccttaataaaatacccaagccttgtatacagtaggaggagtgctaacgttggaagagtgaaaaagacaaggaaaaagtatggtccatttacatatttataaaagcaatgtaagagctttcccatcagtggtattcttggaatctatggtctttactaacttactatagctccagccactgctggggc

SEQ ID NO: 95645 - DNA, 1028 bp, Homo sapiens
aagatgattccacttccttttctgtgctcacagcaaatgttgctaataaattgtgattttcttttcctcgttgaactggacccgtcctctgactcctcagtgccgtgccggaggccacagttaccagctagttatggttgaaacttaagagaaaattgatcatacataacctggggatgtgggctctgtgtctcttcctttagaccacctgcaccctgtcgttgtatcagctaggttcagctcttctttcattcagcaaacgtggcctgagcatctgagcaatggatggaagggtaacccagtgcctgcttctctggcatgcccattctagcttggaaactggatgtgtgcctttcctgcagcacaggtgctgctctgctgtgggagcgttgcatgggctcacatcagccagtggaggaatcttccctggattcgtcctggatcttaaacaatgagcagaaatttctcaaatcaagaattgtactttaggtcagggattctcagctgtggcactgtagacgttttgagccagataattctttgggcagggggttactgtcttgtgcattacagggtgtttaatggcagcagccctggcctctacctactagatgccatagcacacccccgccccagtcatgataaaattgtctccaggcattgccacatgttccccagggaacaaaattgcttttcaccaagaaccactgctttaggccaggaaacaaccacagcaaaggctgagagtcatgaaatgtacaaactggcaacataagtgggtctagtagaagtgttggggtgtgggagggatgcttgaggctgaaggtgtagggtagcttgagatcagtttgggaagggccttgaatgccatactaagagatttgaaatttatcctgtgggttatacaaatcactggaggtcaggagaggctgagtgaagtggaaggaagggcagccagaggtggaagccagtagaggaggacagctgatcagagcttggatgaaggaggatgctctgaacatcgcagg

SEQ ID NO: 95646 - DNA, 1103 bp, Homo sapiens
agggtgaggttttgccatgttgcccaggctagtcttgaactcctgagctcaagcaccatctgcccgcctctgtctcccaacatgttgggattacaggtgtgagccaccacgtccggcctattttattttttattttgctaagtttgtggtaatattattacaacttcatttttaattggaagtaaatatcagatatacattctgggtaaggtagttctcttcacagaaataaattcctgtagggctcttcacacatacagcatattatattgtttttccttccttgaaatataagactgtacaggaaaattgctggtgggcaggggtcggtctgcatccagacatagctacaggaaaatgacaccatgcttatttggaagcctacctaactctttcttcttacttctaggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggtactcattcacatagaagtcttagtgaaatttacttaactcttttatgatatttcttcggtaaatatcatttaggaactgggccttgcgctaagcataaaagatacacagatgactccaatacagtctctgtgcttcaggggctgcacagttagtggggagacagacatttaaacaaatagctatggcagtataaaagcttgatcacgatggaataaggcccattgtgagagcagaggagaaagtatttcctagagatatcagggagggcttcctgaaggaggtgctgttttagccaaacctttaaggatgcataggagtcagccaagcagatgttgtgtgtaagaaccttctggtagagagaaaggtgtatgcgaatctgttcaagagggtactatgggcttcaggccactcaagcagctcactgtgactgtagtgcatggtgtgtttgaaggggcagcgtgagctgaggctgcagcagaccagggtagtcagggtg

SEQ ID NO: 95647 - DNA, 1036 bp, Homo sapiens
ggtgtgccccaccaggtctggctaagtttttatattttttttgtagagacagggttaaggataagtcatttttaagtgctagcatgttacttcttcagctttcatttacctccatgtaattctgcattattaccatttaattaccaaagcaagtccttaatttaaaggcctataataggaagcttatctttagcaaggcttgaataacagtttactagataatgaaacaatattgcatttgtttttaaatattatagagttatgactttttagtaaaccatatgtttttttgttttttgttttttttttttttttacagctctctctccctctccccttctctatctaccccaggatttagactaaatatgaggcgtttgattctttctataatattctttactgcaaatgtgtttagtttatcccttatgctaactgaagacaggggctggaattatgaatattatacttttaagaagctaaataaaaggagtttgattgtaggtgcccagagtttgtttctctattccttccgcaaagggagacacaatttatattttaaatggcagaactgcttactcctgccatttaaaaaagacaaccctgattgattaatcaatgaaggaagaagtattttgtattacttcactttcactaacttagatgtctggaagctgacatttcaatatctgggttttactcattagctcttaaatggagaaaaaaatgttgtctaggtgggttttggtggttatgtttggttgggacaaatacatgatgttgtttaagagctgtttgtgccagagactatttgtagaagcctgcaagagttctgcactcggcctcacctgggattctggggatgttcccacagccccgaggtagatggacatgattccttctctgtggtgcctttagaacctccctctacacttcccccagctcttttccatagtttctgtgaagatgagctcccgtaggtgagtgtgaagatgtcttaggggtggggcaggtgtgtgagtgtgtgttctggctt

SEQ ID NO: 95648 - DNA, 1035 bp, Homo sapiens
ttgtccaccagacgttgctacttttcatatggactagcgacagatgagaaggaggcagtgtgttttcctttagggattattacgttgttaaattcgatcccaccactgtagttaatggtaactattttctgactcatagtgttaatcctttggaaaggtatctagagagtagtgtttactgaaatcccttttgacaactgcttggtttgtggagtgccttggacacttacaggctctttggaactcagcagcaattccgaactgattgtagcttatacaataagagactgatattatggaacaataagaataggttaatagctataatttttcttactaaataaaggaggaaaggttggctgaggttaaaattttaagggctgtgcttcttaagctgagtctggagtttatcttttgggcagggaactaccttctggtatgttataaggaggataatgacctagtgtttcaggtgtgtggcccacattcctgcctcctttctgcattgccttcagatctgacctggctttggtccaaatgttagaatgaccacttgatctctattcatttttgatggactatcataaagaaaaaaaaaaaacttcttgctgtaaaatgagaaaataacaaatcttacttgaggtagtgtgtcctttttaaaatgcagatacagaattaatttttagcttattcataggacagtgccttctattatagggctgagtttttgcggttcctcccccagggtgatgaagttctggtgcacatatagctgcataggtttctgaagagtctgtttcatttataagctgtgaagtaattagaaaatgtgagggttttttgcagacacgtaggacaccaggccaagcttaaagttggctctcaggtggacattatttggtagagcagataacaaagtgtcattctttgattcaagaataattactggtaaagagcccattttaataaatgccagtttgtcatagcattctttttggcagaatatatttatctctgtaccagattaggagtttc

SEQ ID NO: 95649 - DNA, 1084 bp, Homo sapiens
agtgtgtatgttgtgtgtgaggagtgcgtgtgtgtttagggcaagggaagacctgagagacctcgtccttgatttgggttttccggggagaagggccaggaaggacttgcacctccatccctggtatggaatggttttggcgctgtgattgaggtttctgggagctctttggatttgagagctcaaattcgggtcacactcaggcctgaattgtcctgatctggagagtaggcaggggtgtgttggggagtagggaaaagtgctgtgctgggcttcctggcccctgtttttagcaccaggtcaagggctggaagctgtcatccctgtggaattgttttctttccattgccttctggaggtgcaggtgcaagttagtccgcctgcctccctgtgttaagtgttgatatccttaaacacggaagctgtccggttgtctgcacctgccgtggcttctacccaaggactgttgagtgaccctcaggaagcctcctacctggctgctaaaaatgggggctcacagatcacacagcaggccttactgcacgtggactgcacgcgcagctgtggtcaaaacatgtctgagcagagtttaatcactgatgaagtgctcatgggcaagcaccttgtctatcaggaaggaaggcagctgcgggtgtgattgtggtggcaagttaaggcactgagaaggtgtgcagggaagatcctactgcgttgtgtgtgttggcttggttggagtcaggatgaacgaatgtagagggactgtgtggtggctgctactctctcatggtggacatgcttctctctgttggtcagccggaagctggcagacaactgagagctcgcagttccatggtcagtcagaaggaacatttggtcagctgcttccttttctttttccttccatttctgccagccgagcagcctcaacagtcattgcagctgcttctgtgatgtgtagcaaaacgctgcctggagtactagaaagtctactggctggaatctgctggaacctgtccataactagcctgccccaggtcatctatgaaatgggagtgatgctctgtggtggtaatgaatgtggagt

SEQ ID NO: 95650 - DNA, 1060 bp, Homo sapiens
actgtaatccaggcaatagatggcagcagctttgactacaatagtaaatttggtgggttggagcatgcatgtattttgaagatagagccaataggatttcctgaattttgaggaaaaagtcaagtcaggtaaaactctaaggtctttgaataatacacaaatgaagggcctgttaactagcttaagttatgctatttaaaattatttaatttcaaaaacagttttataaaaccacaagcaagtgattttttcttttttaaagaaaattacatttgattaatcagtgttgttgattggttaataagtacaaagtgtcctaagatccttaagtgaactcttctgtgtctattatatctcaagtggatactattgatcaattaatttttttttagggccttctatttgtaaggcaccgtcataggcaatccactagaagcagtgagagaagacagagtaggagggtaggggtaaaggggagtatgttcctctgagttttaatctctgttttacaaagaaaaatttaatgattgagattattctccaattatgaagaatagtcgaagaatacatgtctgctcattgtcttttggaaaatacacacacagtctgacctttgatcaagaatgcattttagattgaccattttagcttgatggttactttacttactagtacagactatgtagtggtgttaactttcataaatatgggttacactgcatatggcttttaatttacttttgctgttattcagccagtattttcctcttgatcagcacattcaggcatattgttctagtaagcaaaactttatgtgccagtcatactttcctttgaagcaatctttgtacaactgtcttgattagtcccccaaaatcattttggaaaggatctttgactctattttttaaatacacaattgaatcagagcattaaaactggaaggatccaagagatcatcttgtattgttgaactacttattattttatctgtggaggaactgagatcctgagaagtgctgtaacatgcccaaggtcacacagagctaggaccaggtcc

SEQ ID NO: 95651 - DNA, 1050 bp, Homo sapiens
gaatttcttgtacataaatattttaaactttgaaataaaacactaggaaattctttcatttagaatgaacatagaaaatttcatttttaatagtctcagattagtcttatcagaaaatctttttgtttactgcttattttaacttgaatcccagtgaactggtttgccgttccagatggtatttttcaagagtgcatctctttgatttcaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatggtaagtatgggggtggtttccatgctggtaagtggtctgaatgaaacttgagcagtctgcctcatgacgggaggtgggtcgactgtgctacattctgttcttgaacccttttgatggtctgtctgatttgtataatacaacttattactccagtacttgaatcctggaatttaaaaatccatggtgattaatgtttttaaaagttcactcaagttatttctgcttaaaatacgtagagagaggatctgttaggcagttttcctagatttttctcatttagttcctttaactgtcttggaactaaaacagataaatattcctttattagcaaggtttagaacattaagtaatttgtccagggtcacacatttattaagtagcatttggggcctgaccttaagtctgtctgtttgtgcataccttaaaaccacaccagacaccagaatctttttaagatttacca

SEQ ID NO: 95652 - DNA, 1197 bp, Homo sapiens
tatattcatgagttctagtttctactgttctgctatgtgtttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttttccctctttgttccttcttttccctttctccttatacattttctttctctact

SEQ ID NO: 95653 - DNA, 1035 bp, Homo sapiens
ttgagagattttatgttagagtgatctgaaaaaaagttaatttctaaactgctatcttaatattattatatttggagactgatgctgtaaattaaataacttggaaaagactcaggtaactttctactttgtcttttgttttgttttagagatgaggtcttgctctgtcgcccagagtgtagtgcagtggcatgatcatagctcactgcagccttgaactccttggctcaagtggtcctcctgcttcagcctcctgtagctgggactacaggcatgcaccagcacacccagcttctactttgtacttaacacatagattcttcattttttttgtctggacagaagagacaaaaatcttatttccacttagattgtttttactaaagtgcattttactaactaaagtgcattgctttttcagttgtttagtagcttgatcatcttattgtggaataaaaaatagagattagaattgcctgtgtatttgttgagtacctactatgctagctctttcttgggaatgaacaaggcagattaagtacttgctttcatagagaaaacagacagtgaaccatgaaataatgggtaattgtaatggtagaaagtaaaacagggtcaagaaatggtgaaggatgaagaaagtaggatgagaagctattttaaatacagtggttaggaaaggcctctgaagatactatattttgaagagagcatgcctaaggcatagctatggagagctttcaggagaagcattctacatgtgtccagttttagatggctgcatactcctcccatcaaggctggagtcagcttcccaccacttgtatgtggacctggccttgtaacttgctttgatcaagtgaatgcttctactcttacacttggacttctgcttgcagccatgtgaaaaagcccaggcatacccactggaaatacatggctcacccaacagccagcactaactgccagatgtgaccactagtcacctatcccccccggtctagctgccggctgactaaagttgtatgatgagct

SEQ ID NO: 95654 - DNA, 1005 bp, Homo sapiens
ccagagcctctctgccatgccggtgaccacagtgatctgagttgggcagggctccctcagccaaggatgtcctgcagtctgtttctctgtcaccggatgtggtgtgagacgaattgataggtgttcatgttttctgtttctctttcttgcaggcaatacataagggaaatccctttgttttttagaagcatctctcacacacagacatgtgcatacatgcacatctgtctaacctgttgctctaaaatgcagcaagagaaaagcagcctagtcttaattgatttcagcagttaggtggtcctggggcatgaatgtgggtgcgccagggtgcctcggcccaacttctttccttgtttgccctgcagattcgcaaggggcccctatgctgtgggtccaagccctcctgtcctgcctctgactgtcttgtgtggtctggccccacaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtcaggaggcactcctttctcatgcgtgagccagtctagcttcaagccttgtgcacgttcctctgaccccctgttcacattgacttggttccagacactcgtgttgactttccagtttgaccttgaactgcagaggagtatttagagtacttacgaagcagggacatacaggttctatcatgggcagtaacgggatctttttgctgtgcacgtggggcagtgttatgcagtcaaattgttagagtaagaaaatggtgggtatcccccttaaaaatacatctcctgcatcagcccccactctcccaccaccatagatagtttctcttttcttcccttctacctgctgaatttgtactcattcagttatttcaccaagtgtgcatggt

SEQ ID NO: 95655 - DNA, 1987 bp, Homo sapiens
cgggggccggcccaggggcggggacgccagccaagggcgcgggcgaggatcagggcagggggcccggctgcggggcccggggactggagacccccgggtgcgcaggctgcgcctggcctgcaggcgggcggccggcacggagctcggggctagcgtgggaccgtgcggtggccagggtcgccagggcgcgtgtgccggggaagaatagccgcggatcgcagggccccggcgcagggacgggggaggccgcgatcggccgggagaacttaaccgtgtttattacaactatttatgttcgcgcacaaagctgctgtcacattgcataaaggaggtcctcgcttcggcgaagggagcttttgtgcccggcttcaggctctgcgccctgccccagatttacaggactctaacagccacctgaatgaaccaaagtttctcacaatcgctcggctctctcggtttttttcagggcgatttaatcaccgagtgcttttggaaaaatttgatatgtgagttttaaggcatggagggtaactgccttatgagcacagttagcttggcattgtgtggaggggtttaatttgcaaaacgctttaatttgtagacaatggggatctctgtgaaggtctgcggtggatgctaggggtcattggctggtggaccccaggcacctgacttaaactagtattgtaacagcttcagggacaaagccgagcgtgcgtggagtcggccttggccacttcacacaattcaggttggcagattcctctttatttggctttgtttattttgccaacaggtttaaggctgcttctgccaagtttgcatctgcataatgggatgagcaggccccagtgtgggcaggagggggcctaaaatatcgcaagggccagctccgtccctcgacccagaaagaaacaaccctgagaggccggtgggcgtggcttgctgggacctacaggtaggggagtcccttcctggcccaggcgcagtccccgcttctcggaagggattttgtgtaggaatgaaagtgattcagggtgtttttcatgcctctgttttagatgtagttatcaagtctcaaaagtgactgaaaatgaaattaacctgggccgctttaacttaccaaaacggaactgtgcgtgtgaacactccctcaattcactttgcaagcttcatagataagcaggtgaattagtaacaggattcaagccttgcgagttttacgtaaagagaatggcagtcatcggacacgtggagaagaaattgacttcacctggagattgggctagacatggaggttttttgacgtttggaacaggggtttcctgagaagcaagtgttaacctgcttgtgaagaagtgaacacgagggaaaatcctacctcagtatattctgccctggaggttggttagatgtagttttgattggagaaggtggcggaatcttagtggtcttctggcggctacttgaggctgaaatggagaactttaggcataggaagctgtggaggtgcctggcccacttcctgtcccggaggcctcgcctggattctgagcttctttcctgcttcataaacattcaggggggttggtcatgaaacactggatgaaattgggtcacaaattgccatcaggaagagttggctgctgcataaccccctctgtccacttgtggagaaactgaccctgttaaccgtcgggcttgctgaaggtgccttgcaggtggctgtgctcagttttcatgctttgtgttttgcttaggacacgctgcatacttaaatcttcttcatccttgctctgtttgaccctgccatattcccaggctttgtcatttacattttcggttatttagcttttccaacaaacagcagatcttatgtacacagtactatatttgagaaatgcactaccatccatattaaatacaccggaaatcttccttgcatgtgcacagactggataaccttttaaaataccctaagactccc

SEQ ID NO: 95656 - DNA, 1392 bp, Homo sapiens
ttttaaccttatttatgaccttttttaaccttaattgcctcctgaagcgtcctgtctccaaatatagtcacttaggggttagggctttaccatatgaatttagggtggacaattcagccactcccagtgtgtctgtctaggttccacaacagggctgatgcttttaggaagacctggtgctcccatcatccagatctgggatctctgtttatttggggacacctaccagggatggttagagtagtcacaagtaaggagggaacgtcagctctttatatattggttgtagcaccccataacagggaacaagccttggtgctggccttccaaaggctggaaaggttttaagtagagtgattgaagagagagaaaaatcttgacttgatttcatttatggaaacttctcttcaacttaggtaggtagacacttatttgggggttggtttgtctttaattgagaccatgataaaatatcagtgatatgcaaaggaaagttttttctgaaccctggatgaagagagcaaagcaagaggtggggccaatggcagccagggtggagaggccgtctcctctgagcctgccatctctgtgatcgtgcagtctttgccacatgagcaaacatcccttagcagaatgtgcatgacggtggtgaggtgcaccctgagcgtggctggaatgtttctgacctaggccattttgccttgttcagacataaggcaggggcaatgcctgcatgactgacctccctctagctccagatctgtatgttcattgatgctttgtttgctcattcattcacattcatatgaattatccaagttcttagtggtcatttccaccatcccaaaccatttgcagcttctcctgcaacctgcccgccttctcagttatattccccatcaccgactcactcggttatccttgaattctccctcagctcccaactagttatcaacccctattgattctacctccaaaagatctaacatctcagccctgctgtcctttttctgtttcccctggacatcaaaaccactttttaaccattcctgccaatccatcccagggtgactgcaccctgacagtcaggtctggccatgacctgcacacggtggctctccatcgtacttgggtcagtgactcaagtccccagcatggcagtcatgggcttgcacgactgggctgcctctctgtttctcccagcatctaaatatccccttccccatatacacacatgctgagctacaagtcatctgtggccacccactgatggtttgctaattgtgataacaaaactaagtttataatcagtttgtttttaaagactctctccactgggactggttcagggttctcctgtgcagtaatggcagggctaccccactacagctt

SEQ ID NO: 95657 - DNA, 1040 bp, Homo sapiens
atagtttatttgccctgacatcctttttctgtcccaggatcccatccagggcacgtttcctttagtctccgtagcgcctctgatctgggacagtttcttagactcgccttgtttttaatggcttgacagctttgaggagcaaaactgcttttcaggtgttttgtagactgtccctcagttgagagttgtcagatgttttttcatgattagtgtagagttaccggtttggggaggaaggccaccgaggtaatgtgccattttgtatcaagggtccatgtgatcagcgtggcttatgatggttgatgttgatcttgatcacctggcccaggtagtgtttgtcaggggactccactgtcaagtgactccactgtcaagtgactcttttcccttctttccatactgctgcagtctttggaaggaggtcatttaaggaagagggagttcagctgtacctcctgtaggggttgtatttacattagttatttagaattctatctgacagatttatctattctcccaaaagggaccaagattttcagtggggatagaaggcactgtggcacagacagccccttggcactgttgcggaggaggtgataggataggatggtgccccagcatggggtttccagaatgtggtcctgggctgtggagaaatgcaaattccggggaactgcctgacttcccgcgtgggataggttggtctggaattcttcctgttgcacgagttccccaggtgattctgatgcatattcaaagttgagagcctctgctgtggattagcacttgaaccccaggtgtgccggccaggagtcaggccctcacctccatccttgccgttcacacctcttccctgctggtggcacctagctctaaggctccccgtgtaaccacttctcccacagttttgaccacctcttggatctctccatctgaggctccctttgtatcaaccaagggtctttgctttctggataacttcatccttcttttggtgggcccagagttccagtgaagggagaaaccagttacagctgaga

SEQ ID NO: 95658 - DNA, 1027 bp, Homo sapiens
tctgtgtttatctcatagataccattccatattcccaggtatatgcttgtaatgttattcatgtcacacatacatgtcatgtcattgaaccaaatgcaatttgctgttaatgtaatactgctcgtgacgtggcctacttggatgtctgatatgagcttagaagcctaacaggaagttcacctgcaaaattggaccctccctattcccttgtttccacaataacctagttagtattttgtgaaaggtgttctttataagtgttacattctggtgcactgatgatacagtaattgatttaggaatatctgttactctttgtggttacagtagaggttggcaaagtggcccatggaccaaatccagttcacctgtttgggtgtgaatacagttttattagaacccagctgggctcattcatttccacagcatctgtggctgccccatgttgcaacagcagaattgaggaattgtgactatgtggcccacaaagcctgaaatatcaggccttttccagaagaagaaccgcagcccctagtgtgcagcaaggaacagaaatcaggagagctgcattggagtccctgctttgtccctttattggcgcgaggtttgaggtttccgtgcccgcacctgggaaaggaggaggaggatacccattgtctcaggggattgctagcatgaaattgtgggacatactgggtggttcccagcacttaatatgcacttaataaatactaattccttccctctctattactcacatccccggctctcatccttaagtagttgctgtctttctacatgtgaaaaatttgagacaaaaaaatggacatcagtacttgtgttttcagaaatgaagacatctcaagcagcactgtccagcagaaatagaacataagctgccagtgtgtgctagatgtgtaacttcacctctcccagtaaccacatgaaaaaggctacaaattttaagtcttctgtagtccaacataaccaaaatatttcaacatatactcaaataattgctaatgcc

SEQ ID NO: 95659 - DNA, 1453 bp, Homo sapiens
gcctgtccactctgtggtgcggtagggagaggaggtgtcaagttgtctggggcctggatgacgaaatctgtgttccacaagtacactcaatttttaactcacgtttattttgtaacttttgtgaagcattcattggacactgagtactgggtatcatctataaagccacttttctttttgagttatgtgttgaaagaaatgtggcttaatgagccgtgtagatgtacagctgaaaaaacgctttctaaaatcattaccagtccaggcaccggtggcttatgcctgtaatcccagtgcaggaggatcagttgaggccaggagcctgaggccagcctgggctgtatagcaaggccctgtctctacaatgataataataatataataataataataattaccagatggattcatgtagaaattgagtcacaccatggtgtctgaataccttgtcatctgatgttagctaaactttagtttttaaaaaatagtaataagtggtatttgttgaggggtggtttttacgtgttagtcatgttgtaagtaatttgcactgtgtgtggcatgtgggtgcctaatcaatgagaatttgcctgtttctttgtggatttttaatttttcatgatgggaaatttcaaaatttaagaatcctgaatcctggtgtgcctgtcactggacatcagtagttaactcacctcattcccttccctgatctctgggctccctattagattattcagattccaggtagatagataattatttttaaccgaaatttagtttttaaaatttaacttcagattgatcttgtttgaacttaatcatttttcctctgacttgcttatttttttcagttgtcattgtagcacattgatgtgttctttcttatctccttttgggttttaaacattatttatgaatttatgccttaacttaaattgtctacagcttctgctgtagacaaaggagctgtttgtttcatgcaacctttcaagtgaagaataatcagctaattacaactgtttgaaaattagcttcctttttgtttgtttgtttttccttcctaccctgggagcctggctggcatcactgggagcaccacacctcccggtgtggtgagcttgggagctaccttgattcacttggattcttttaatgtgtatttgtgtttttgtgcactaatcaggctcattattttctcatctgtaaatgagaaacttggaatagctggtcatcaaaaagttcctttttgattttgtggttaccaaaaccaaaacaaagcaccaccaccaacaaaaaaaacagtgcgagggataattgttgaccgtcagttgcttagggagttaatgacttccacctgggaaataatttgaaaaaatgtcccccttgtattttggtttggcccaatttggtgtggcctggagcatgtcccttactgcaggccacctctgggggt

SEQ ID NO: 95660 - DNA, 1047 bp, Homo sapiens
gctgtttgtagcctcgctagagcttgggtgggcccccatcgccctcctcctttggggagcctctaagagtcactagaggagacttccctgagcttccttcctcggagtgaggcattaaattgtgcccgtgttctggggtagcaccgtgaaggcccgcgtggaacatggtttttatttagagtaaaaacagctcgatgcagcgttgcctgtctgagccagacttagctcttcatcttcacctgcttgtgggaagcttcgtacaccaccaaggcacaggttaatgtgcagtatttgccaccgtgggtgcagttactaggaaggcagccgttcgcggagaataatggtgtgttttttccaccttgttcctctgagcatcatgaaataccttagcacgaagaaaccctgtaaatattctgggtaatagccctacataaatgtattcagattatgtttttttttcgctaataggtgaaaaatgatgacctccactctttccaagaggggtggcctgttcctgagcgacttcagtgtgcttccccacagagagggttttgcagctggaaacaagggcatttcttcccagaaagtgggagttgtttcgcttctccctttatagtactgccttgtagcaatctgaaatgtggatatatttggaatttgcacgagaaaatgaaacaccctttctctgcagaagacagagtgccattgcctttgcaggtcactgagtaagcagcaggacctgcttcagctggacggcaggtcccttctgtggcacctggttggcctcaacaccatgcgtggcattggcagtgatgaaattcattttcattcaggaaagcgtcactgggagcttttcttttttgagagaggctctccctctgtcacccaggctggcgtgcagtggcgtcatctctgttcactgcagcctctacctcttgggctcaagtaatccgcccgcctcagcctcccaaaatgctgggactacaggcatgagacaccacgcccggctgttatttctaataggaagttgccatcccttttctcacc

SEQ ID NO: 95661 - DNA, 1177 bp, Homo sapiens
ccagccttggaggtggccctggccgctgctgggatcttgtgtctgctcctctctaagcatgagatgctgagtcggttcctttagctcagactcatccacacctttaggaaaaggaggtaatgccggcctcgcgcggttatgagagtgaaattaaactccacatagctggctcagggtgaggcctgataagcactgtgtccctgtggtggctgtggcctggcctgactctcctgggtccccgggcagggcttcctgtctccatcgctgtctcttatttctctgcctccttcaggtccagcttctactctctcctcccttctgcctcccccacgcattgcttcctcctgggtttgttcccctctgcctctcttgggccagtgccttctaccagccctgctcccaccctagccttaggctgactcccttacctctgctgctcaggcaccctcctttctaaagcatggtgataacagcaccgtccagactcgaagcaggggacctgcgaaacttcagctggcgtggtgccgcacaggtgctccctggccttggtggctctcaatggggtgagcatgtgccctgctttcctctcttctgccctttgctgcgactcctctgctgtcttgctctgcccgctgcaggcgtggtggcactgggcagctgctgttactcccactgccctcacctttgaccctcagccctgagcactcagctggatttctcttttctgggttggttgtcctcacactgaaggaagctcagctcagcgccgtggaaggggcaggacccagtctcagctctgacatggtcatatctgtaggcttgggctgagtcttccacctgcaagtgcaatggactgaaattttatgtcccccagaaattcaggtggtgaagttctaacccccagtgtgactatatttggagatgagccctctgaggaaatagggttgagagtagggcccccataatgggattcctgcccttctgaaaagagacagcagagagctctctctgccacctgaggacatagcgagaaggcagccatcggcaagccagaaagtggcccccatcagactctgctggcacttggatcctggacttgcagcctccagagctgcgagaaatgaatacctgctgttgaagcccccagcctgtggtcttttgttagggctgcctgagc

SEQ ID NO: 95662 - DNA, 1016 bp, Homo sapiens
aatcctttgattttatatttcctttatgctgaaaatctttgtccctaggatcgtttacgtaatgacttatttgcttgcttgtgtgttttatttatatacaatatatataaatgtttaaaataaccccaccaatataattgcaaaccatataagtactgaaaacaacagaaaatgtttttgtccttagggtttatctcacaggggaaatacagtccaattattgtatttcaaagtctttcaggataattcctctctgtacttaagccaccaactcaatttatagtttagtttgtttcattctgcttttaatttttggactttaaaaaagttaatagtttattattttatttatttatttatttatttatttatttttgagacggagtcttgctctgtcacccaggctggagtgcagtggtgcagtcttggctcactgcaacctccatctcctgggttcaagcgattctcctgcctcagcctcccgaatagtttattatctaaactgttcgcatggttccgcagccaaagatggttatgtccagagaatgattattttgtatgactactctctctatcttcttttttccctactcttttccatcaccattttttaaagatgtttttttctttcccctttttatttcttgctttttaaaaaaagttttattttttagagcagttttagtttcacagcaaaactgagcagaaggtacagagttttctcatatatccagttcccccacatgaactagcaacatccccgacagggtgctgcatttgtttctgtgggtgaaactgcactgacaaaaaccaatcacccaaagtccagggtttatatttgggttcactctttgcgttgtgcattccatgggtttggacaaatgtataataataattattgctttttaatgtgagcaaacacatatgtgtatacagtgatatatttttaattttttttttcctcaaataagcaatagcatactctatacacttttcccaagcaagaggtcaaaggt

SEQ ID NO: 95663 - DNA, 1033 bp, Homo sapiens
caagcagcaggctgccaggctgtgcgggctagcagaagggaggttcttaaattctctgcacccatgtgagggaggctgctctcttgacagcgtcttagggtcaggatggctggaatggagcgtggagcctggtctggttggagtccctgtgtggccttttggagatgagtatggtaacagtgaggcaggaagtggctggatttgcagcgactgtgtggagcctccctgtttaggcttagtgagctgatgcaaagtctttcgtaaccatgatcagttaaaacaaaacacctgatgttgtggcctcctgtcagcttttgtcctcctgtagaaacaagatgcttctagaaaaccagtttgtaaatttggcacagaaaaaaaaccctttcagcaatttggtgtggactctgcttgttaatttatggcttcgcaactttttttaagctaccggcactaacagcagatctttaagtgtttaatcgtcccaagtcaggtttgactgtgggctgactagctatagtgatctaatttggttcatttcctaggagaagaaaattataaccacatttttattaatttatggttttgatccatctattttagactcaatattaaatcatcccctacttccagaagatgtgtttttgaacataagtatctttaggatttaatattctatgaaaggagtaggagctaatgttcgcttgttgtaatgtttgttttcttctgatatgatgattttgttgaaaaaatgtatttgaaagagtaacgtgtaggtaagaaataagttagccaaaaccatacttcaagggaagcctccctcctatcctgggagcccggatagcctcactgtggcctcttgtttgtacatccagaatattcttgaaactgggttagctgagtcatttttttttcttctttcagtgttctccttttttctttttataaaatgaagagatctgtccacaagtctagcttttaacaatgagaaaaagcactgaattgtacactttaaacagtgaaccagtttggggtc

SEQ ID NO: 95664 - DNA, 1061 bp, Homo sapiens
cttcttacaggaactaaatagagtgagaacccactcatcaccacgaggaaggcaccatgcatgagggatccgccctcgcgatgcagacacctcccttaaagccccacctccaacactggggatcagatttcaacatgagaaggagtcagatattcaaacggtagcaacatccttgtttgcccccatgtgtcacatacatgggccatggatgatgactgatcatctggaattccccttttttgtcgcttgccacccagttgtctgtttcatctgctgctttctcgggggtgaggtggtgtcagtgatgtctgttgtgtgtatagcaccaagcacagtgctagcaggggttcagtaaatacttgttggatgaattaacttgaagtctttctagaagagagcaatattgggatggtgaggtttagcaaaccttgttgtcatttttcaaattgatggttttccttagagaagagattatagttcccctagctttgaaggtcagtcttgggaaagcaaggttaggcttattttctactgtatcacaaattagtttttatctaagatagttgttaatataaacatttattctgcttgtctccatcaaatttttaaattctaaggcagatattttagatagcacacatgtgttttagaagttacctagaaaagtttagctgctgttttttataggcacgttttcttgcagcagatatcataaataggcactgctatgtagtctcctatttgactttgaactctaattaggctgagctccttaagaagggccacttctgtgctgtgccttatgtatgtacagcatttgcacacagcagttgtgcaatacattttcattgaatacgtgtgactgatttcattctaccaacaaggtgactgctattgtctccaaggaaacctagtttctgaggttaattagcagccttcaatttctacagctaggaaagtgcggaactggcattagcatccagtttcaaagcaagtcctcatgcccctgcatcatgtgcagagacattgccagcttcacacccaggttagtcgtctttcac

SEQ ID NO: 95665 - DNA, 1888 bp, Homo sapiens
ttgaaatatcaagcacagatgctagaaacctttatttcctcattctgttttcttaaatgatagggatggtttctttaacagaattctacatttggaataaatattagcatttattgttccaaactcatttatagaggtgtctatagtaattaaacccaaagtaacccatgtcccctctcctacacagggtccctgctggcaggtaggtacaggttcttgtccctagagcggggtgcagaggggctttctataatccactctcccacttcaataggaaaatctaaagcatagataccatgcttaggaatgtgggcataaaccatataaatctgcagaactaaaatgattttagtagcctaataatattttaacattatgagacctgggtagtgtggaatctgtttttaaaaatcactgtgcttcttgtttcaaccttgcatgtttcaaaatcaggcagggaatcgtgagtaacaaggtggcaaggaaaaaggtcagatattgattaatgtagctgaattcatttgtaagaactgaggaaactcatgacatttatattttgaattttttttttttttttgagatgaatcttactctgtcacccaggttggagtgcagtgactgatctttactcactgcatcctccgcctcttgagctcaagtgattctcctgcctcagcctcctgagtagctgaaattacaggcatgtaccagcatgcccggctaattttttgtatttttagtagaggtgaggtttcaaatgttggccaggctggtctcgaactcctgacctcagatgatccacccacctcagcctcccaaagtgccaggattacagatgtgagccaccacgcccagccgaggtttttttgaagtagatgtttaagttacaaaatttacaagtaccttacagctgtgaaaaaaaaataggaaggcctgataaaccgctaaaaatggtgactgttatccgtctactttgggagcagggagtatgcactacctgaaaagacctcacttgtgtttcctaagaagccaagttccaccaaagacatctatgtccattttcatacgtgggtattttcccattgttggtatttcctcttcaccccttcaccatgctgtcttctggcttggcagaaggcagtgttgattccagtgcagttatatggaatttcatttgtttacagttaacatcatgtaagaaaattggcttattaaatttatgttgattttccaaaatgctggcaccagggaatcacttgacagtcacagccttcctcccagtgtgattagtgtctaagacaccaacgagaaagccaaggaaggttacaaaattgtgtacttttgtagctggagtggtaaattatgtgtaaaatagcatttcccagattctagttgaagcgacagtgccaccacttcttttttttctgtaaaatttcccagacactaatgagctatgttgacttagagtctagtctgcagaacgctagtgtgtcttggcatttcagagagtaaatgagttgctcaatgatgaactcctgaaaactggatgataaactcacattttaaggcatttttcttctataattttgaggggtaacctgatcctggcagtaaagataaattaatggtagatactcactgaaaaaaaaaaaataataggagggtgtagcagaaaactgtagatgatctttatgatcagtataaaatttttctttttattgagaattgctatgtgctaataaattctattgaggatgcagtacaaatactgttcagttaagaaattgatgtatacgttacacccaataggatgactgctgtcaaaaagtagacaataacaggcgttgacaaggatgtagagaacttggtacccttgtgtactgttggt

SEQ ID NO: 95666 - DNA, 1019 bp, Homo sapiens
atatgtttataagacacagcatatcctgagaaaatgagtgtcaacctaacagttatcaggaggcagtgttacttaatgaaatggactcatttaattataatgttatttagaatttttttcaagtttgtttttgttagagggtcagatttccccatgtacagcaaacagtaacataagatttgttttataaggttgctgtttctaaaccaaatactaaagcttgttgaaagaaggtcattttaaagttgagcatttcaagacccaggagaaaactggttgcagagttgtaataaaagctgtcagtgcctaatttttcaagttggtgcaaaggatgaagtgtccgggtagttctctaatgagcatctccaaatgttttgctggcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggtgagtgtttcaccctcgagagaggaagccttgtgcatttcaagggacactgttcgtctttctagttagtttgctgtttcaaaaaaaaaaaagtctgttttaaaagttaatatcttcctagttgtcttttttaataatctaagaattaagagatgaagatggagaaagaggatgtttttcatttcctggagattctggagtttggggtcctgtgtatggagacactttgtgtgcttgggacccctgcacaggtatctccttgtatcaaaacgttagaggagcctgacttggaattctcacctctaagtctacccagctctgccagtgtcgtgacatgaagttctttctctcttatacaatcctgtccatttggcctacgtgcctagagcaggg

SEQ ID NO: 95667 - DNA, 1081 bp, Homo sapiens
gtatttttagtagagatggggtttcactgtgttagccaggatgatctcgatctcttgaccttgtgatccgcccaccttggcctcccaaagtgctgggattacaggcgtgagccaccgtgcccggctccccatgtgcctcttgttttcccaggtgttgtcaggttatgggcagtgccctcctggagttacacaaagttaacagtatccagtcttgcctttacatgcacacggaactgacttacagtatttactgcctcagattacctgagaaaataattgcgaggacttttttgaagaatgactcatctgagctgacatttaaaacgttgttaccttcttatgagtataatgttgtctgtatccaagactgcaggttatcacttaagggtttgctagtgaaatgagttaatattatcacctgtgtcacatttacttggggttttaaaaaaatttctaacaagaggatttgttttcttttggggaatggagaatgaggaatacgtaggaaaactgaaagtaaaattatacaccaaatgtggtgggtgttgcaaaatgttcatcttttcttttctgccatgttgaaaagtctaaactccctctgcaaaatcatcgaaagccttcatgtattaggtagtatttttgtgtatggattaggttcttaccatgatttggagagataagtgagacatggaacttcgtatgaatcataccagctcactggccatcgtagattctcagcctgatggagaaatttcatttttgattagcaatatgctccttctccactgagctgcctccctttcatcttttcttcccccacataagcatgccacttgaaagaaacactgttttatgcttataactcttaattaactgtggttaccaaaaaaagagggtagcatgaatagagaaaaacttgaaggttgtcctgagctttatttttccaatttctacctttcaccaaagtaccatctttttagtgatgccaaacattgttacgttgttgacttgttgtgtgtcttctttttttttttttttttttgtatttacaagattctagtaaagcatgaagtgcttagag

SEQ ID NO: 95668 - DNA, 1043 bp, Homo sapiens
tgtcccagagtcagaattataccaagttctttgttttagaaatgagaaacctcgggagtaactagcaagccttgaaggggttcaagggtgaggtgatagtcatgtattgatataaatttactgattttgatgaatgcccttatttgtggaaatacacataaagtattcgggtaatggaacatcgtcttggcagcttagtctcaaatggcttggggaaaataatgttttttgcgccgtttttgtaattttcctgtgcactaaaagaagcagacatatcagcagtggtttagagactaccctaggccgtaaaggtagctgggagtctggagacttgggctcccctgctgtgcctgggcagtgccctaagtttggcataagcctttaagaggccagaaagaatcatcgagtatctgctgcagttggacttagaacatgagaataataccagatgtcaacgtgcccagctgatgcttcacagaatggttctaacagtacatgattcagaactttctctaattattcatcatatctatatccccagcatgcaagtgaaaaccatctctgcttcttgctgggtcaccccaggctgttttgagctcctgggctcacagcctctgtgattgctgggaaatcggaaattctcatttcggcattataggattgtgggtctgtcatcgtgattataaatattctcacaggtctcaacaagggcagagctgttcatctctgaaatgaaatgtgggtaacaaatgcagcagcctggttctcgtggaagccgagtctaagcttcagttgtccctttctctatcccttggaaatcccgtctgagccactgcattctctgctgtgagtgacctttgagaacagtaaccaaaggctttgaaacagggatgcagacacgatgcagcaaccccaacagtgtaatagggtgtgttccgatcagaagggggagcctggtcagatgttatttcatctggtcgggatgtgaaggaaggataaggcttagtccctgactttctgaagcttgtatttgtaatataatc

SEQ ID NO: 95669 - DNA, 1270 bp, Homo sapiens
acccagctaatttttttgtatttttagtagagacggggtttcaccattttggccaggctggtcttgaactcctgacctcaagtgatctgcccaccttggcctcccaaagtgctgggattacaggcatcagccactgtgcccggcctggtttttgttttctaaagctaaactactagaggtaaaaagtttcctgggtcaacttcctaaggtcaattaggaccttagagagcggggaggaaactacatgacacctgacaacaacaggaacctgaagggacagttttggagatgggctgagatttcgtgcaagggaaattggtgcccaaaagggacatggaagactggggaagctgtcaagaatacatttactgctttttctccatggtggtcaggaatttagaatttcttcttccttaaacgtacgcagttcttaatggtgagattattttctgccagcaggacacttagaagagaaaggtcagttgacgaatatttttgctttgctcgacacgtttctgccagcctcagctggagagctctatgctcctgccctgcccagatccctctctgcagctacgggatcagctgaaggtgcctgctgctgcttgcacgctgtcacccgctaccttccccccgccaccaggcctgccctgtgcccttgctgttcacagtgtggccctaacacctccttcacatcactgaatggctctgagtccttctgctcacagccgtggtgtagcctgtcttccttgccacgggtacttcctgtcctcacctgagcgcctccgtgtcctgcgggaccgaaagagacatgctcagggaggtcctccctgacctcctcctctttattgcgattgtcaccgttggtcatctgcaacttgggtttgtgtaagtgattctctatttcactagtctgtgaggtttaggaggctgggtaggttcttcacactttccctcaggctgagcattaaacaacaaatgagcaaagaacccttcttgagaactctgaagaaatgaagaaagaggtacagccagaggtggcatttgtaggtattctagtgtaaattcatggcagagccaagggacagcatttcaggaaggaatggagagcatcgtgatctgttagttgactgaaagtttttgcaccttaaatgccatttgttgctagggaggagtcagaaatgattcggagaaatctctgaaaaagtaactgagtcccctttctccttcatccggggacacctctgttgagcagtgagtacattctgat

SEQ ID NO: 95670 - DNA, 1547 bp, Homo sapiens
aaaatatgatcttggcttaaaattttttgagtttgaggagacttctcagaaggaagtcctgcagtgtggagacattggtcccagtcattattctttctgcctaagatttggggaaaagaggaaagactttagagggtagatgaaaaaggtgttctccggggttgctggccttagggaggacctatggcttttctgtggaacatgcacaggtggtcattgctgtctgaattcagggaccaagtccctttggataaggagggatgcatgcattgtctgggtttcatctcagaactctgcaccccactgtctcagttgtcttatattgttagagaatgagctaactttttctaaagaactaaagcacgaattgtttgtatttccttttaacagttttttaatgggggcctttcagggttttttgcattctctcctaacttagaaagtcaaggaacaacatatatgattctaggaatatagggcggaaagagctttactgggacttgcatcggctctgcacacatagcagcaccgtctttgtctgaggttccacgtggcctgatgctgtgcagggcagcttgtcctgatggatcttgccgtgacacgggccattttcagctgttagtgtgcatgccttgttccatggggattctgcaagagccctgaggtgtgtgtgtggcttcttttctcctgacagcagaaccatgccaggtttgctgtatttcctgttcataaccaaggcgttctcagctgtcatctgtgactaccagggacctgtcctggtggacaagtggacaagtcctttgcttgtttttttcccaccatccactgcctccccccgtccccatgtgttttcctgctcattttggcatttctcaggttagagctggctttcgcagccaccactaggccaccaagagcccttaggttcatgatctgacataattccttcgcagcatgccaggatggaaaggtttctgaggggttcagcctccctgcaggactcagtcaggcatctttatttaatttcctttttttcttgcagtctttgggcctgggcctttaattgaggttatcacatgaggcctggcttctggataagcacagctgttttttttggaatggatcttcaataaaatatcctgagtgattgcagtgtaaatgagctagacccttgcttgacgatattgaggggtgcgtatttcagggaagacaaacattgccacatgctacactatccactatcagtaagtgctgggtatttcagaagtatctgttggatatgttagatgaatcagtgaaccaacaaacgaacgaacctcttggaccctctttcctgtcctgaacttcagtacctactgcttgtccttccatttcttcctcctccctcgctctcctctctcatctacaattgtcatttatccttagcagctaaaggtgatgcattgttgttgcttattctccatatttcgttatcataccttcacctgtgagccatacctgcttaaatccagaaaactcagaaatcctactcaccctgtgtgtgtcca

SEQ ID NO: 95671 - DNA, 1421 bp, Homo sapiens
ataatgatgatagaggccccgagagaggttggttttccgccaacctattaattgtccttagattccacttggaaaatgacttctgaaaagaagggtcaaatgaatgggttgtactaattgttcattctccagaaccattgattcaaaaactatgagaatggaaaaatcattccttataaggagtactcatagaaggacataacaggaagaagtggtctgatgtttgaaaatttgaagaatttgcccagtagtcagcacagagaaattactatataccaagtaagtacagtgtttggagatggaaagtgtaggaaatgcggacagtgggaggtagcacaaaggtggcaattaaagaggagaaatcaaaggggagatgtttcaaaacccggggactgagtctagttaggttttagtccaatcatagaaaattgtaatgagtgtcctgtccatctatgatggcttaaaaagatgtccataaattctttggtactctttgcttcagaaggtggagcctgaccctcttcccttcagcatgggctgcactgagcaactcacttctaatgaccaagatgtggcagaagcgatggagggcagcttccgagatgggcattgtggctgcctctttgctctctcttgggtcacttgatctagggtgagccagctgtcatgttgagagtacattcaggcagccctacagagccccctaggggttcatgtgagcagactgccttggaagtagagcctgcatccccagtctagccttcagatgactgcagcctcagccagcatcctgactgcatgtttcaaaaatgtgttaagattctttgacaagcttaaatgtagagtactctaccatactatcagtactctagtacttgttgaggagcaagtgtggcatggtcctttttcatccaatttcttgaaatctgttctagaaagccaaccgtggaaggactgcaacagatgagaataggactgatggagttgctttcatgggaatcattccctggctccctctggaggcagagttgttttgggtcgggagtaactccatctccatcagatgcagggactggtggctcactttgaaaggaggagaccatacagcagtgtcccagctgtcccttcaggggaaattccctatgagagatgtctggagcagagccagagtcctcaggacagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcatcagagtcccctgaagggcttattaaaacacacggtgctggaggttaaaacacagatggctgggctccaccccagaatttc

SEQ ID NO: 95672 - DNA, 1016 bp, Homo sapiens
atgtttaaaatgcgaccggaattttccactgctgttcatatttttaaatgcttagaattagaaaaattagccaggcatggtggcacatcgggaggctgaggcaggagaatctgcttgaacctgggaggcgcaggttgcagtgagccaagatcacaccattgcactctagcctgggcaacaaaagcaaaactgcgtctcaaaaaaaaaaagaattagaaaaattttgatgtcttaatttctaatagggttagacatcagaagtagtaaaatttctagctactgcctgcatgcaaaccactcttaataaattcccagtttatcaaaaaatagtttgggaaatgaaaaacagcaaatttcttgagcagtcagggcaacactgtatattccatagtgaagtgctgtatattccataatgagtttgcacttttcaaataactaaaacgcatttagcactgaaactgggctaagcagaatttattttttctttggttcagaatttcagaatcgtggactacctccaggtctttctgaacatcagatgccgttctagatataaaacagagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccaggtactcgggaggccgagacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcc

SEQ ID NO: 95673 - DNA, 1256 bp, Homo sapiens
cgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaggctctgtgtgtatttatctttgggaaaactcagactcaatcatgggagagtaattactgaagcattcactcattgcggagtggaaatcatttttagagaagagcttaacatttatt

SEQ ID NO: 95674 - DNA, 1423 bp, Homo sapiens
tacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactcaccagtcatggacttccagttttaaaggttgtctttctgcttcggcatggcacttgttggagtgctaaggaaaatattggagaatttattttaaaagaaaattctgaaaacattcaggtttgtgcactatataatttgatatgtagctattgaaagcatttatatgctacttgggctgagtgtatgcatataattttcactgccatgtaaagttttcagatcttagccagggttagaatcagttttgtgcccttccttggcaacacagaccagatggagaaaaaaaaggtgcaaattgtcccctctggagagatctgtgaactaggcttattgagtgaaaactctgagagcttttgttttcaataagaaccctttcaaggtttagtgttagcattttgtttttcctcttaataaatggaagaacaatgcggtaagttaaagctccacattttccaagtagattggctccgcgtgacaacacaaacctgagcaggcgctgaagattggctccgcgtgacaacaacacaaacctgagcaggcgctgagaggataaagatttctatgtatcagaagcatttaaaaatgagagatcctaagatacctaaccagtgtaagctagacttgcctgtgcttgtacaaccaccttgggattcttcttaattggacatatttttggaatcccagtcttgggcagggcagaggacgatgtggttttgtttctttgtcatgctaaattctccagaac

SEQ ID NO: 95675 - DNA, 1039 bp, Homo sapiens
tctccagaggggacaatttgcaccttttttttctccatctggtctgtgttgccaaggaagggcacaaaactgattctaaccctggctaagatctgaaaactttacatggcagtgaaaattatatgcatacactcagcccaagtagcatataaatgctttcaatagctacatatcaaattatatagtgcacaaacctgaatgttttcagaattttcttttaaaataaattctccaatattttccttagcactccaacaagtgccatgccgaagcagaaagacaacctttaaaactggaagtccatgactggtgagtttcaataatttattaaaatagcatatttaaccatggttaaccaagaatatgttaactttgtgccccccaacctgcccccgccccagatacgcagcaaaacacagtagtgatttcaaatatccttgatcatgaccaacaggaatatttcaaagtcaagtttgcaactcaaaagtagaccttggaaaaactctgaattaaaagagaaacataaagctctcacacagaattcttttatctgccctaaaatcaatgccggcgcaccaccacctgacaatactgctaggatttttctttatgcatagtataacgactcatttattaagtacccactttcataaataaaatcggcattttttgtcccgcttaatgttccttttcagcttcacaaagaaaccagtaaataaaactgtcaacgacagtcacaacatatgctctcacagcaagataaaaaaacttgaaaatacgcagagatgcatctacgctattttacataaaaagagagattcaaaaagtgcaaggcaaaatctgcagttttttgaggggagcttttaggcacatccatttcattaaagcaagcttcagaatgaaattccagtttgttcttcatgacacctgttaaagtctttctttaaacgacaacaaaaaaaagccaaaaatacatcccatcaagtgtacaatggtagtcttgtgtcctaaaagtgaggagttcagctgtggcgagtcc

SEQ ID NO: 95676 - DNA, 1073 bp, Homo sapiens
gcgcagggaggtcagactcggccagtagacgtctctgcagacacgcctgtggtctgggtggtggattgctgctgttgtcatgacgcttataactggaaaccgtttctttcttaggggaacccagaagaacacacaatcctagaatttgctcagttaattaaaaaccttgttggtaagtaggataagtcatttcctgagtaaaatcgactgtgcctgccctatctgttaataacaccttgactagaaagtgggtaattaatacaagctaattgaattggatcaaagcagaactttttatcaggaatacttaagtgttttctaatttttaaggaatagaaagataaaggagggcaggattggtttctcctcagttttcgttgcaggtttgcatgaagtgggagggaggaggagatttgctcccagtgtttgaggcacgattgtattagatcatcctacatgggtgacaactattggatttccgaactggtcatgtcaagcatagaatttcagacagcaagagacagcaaccaccagctgcgtgcttcaggcaggtttgaaattctgtttgcaattctggttatcctggctgccacccactgggggcagtgtagcattgggagcaccccatcaaggtggactcttaggccatgagaaggtcaggtcttccagaccagccctggattgcagacatagagtggatgagcccttggcctcatcttcagacttcctggagctctgaggagtcagactcttggagggtgtctgttgtctggggttgatcctgaaatttgagtgaagtcacaaccagactagactggcaggtaggccaaggaggagtatgccacagtgtgtcctgaggtgaccattcagaccccgcttggctgggttaattcctccagtgtgcccttcctggcatcaggctgccattcatcggcattggtctaatcgacccggatggctggaatcctcccgttgctcgtggcagtagaagcagcggtcttcctcagacatagcctgcatcatctgtggctcccacagctgctccgatgcacttcccagcttttccatcctga

SEQ ID NO: 95677 - DNA, 2088 bp, Homo sapiens
cgtaagactccagcagaagcgaattccttcaggcactgtcttttgagggaaaactttacacagctataccaggtgcacactttaggtattgctgccaccatctcactgtcaaggcatggtctcgaagtagagtgcgggatgtggtgctagatgctttgagtcagcatcactgccccctgggatcagtttcaaggtcggactgtgtcccctggagtttcaaggacacctacgcaggacgggtgtggttttatcaggaggcctaactgttggtttccttccaggtatacggatccgggtctcagacaagggcgttccagtacgtcaggtaagactgtcctgccctgccccagccttagcagtgctttggagcaggggtcatgccaacttgacagacagttcagtgtcttgtatatgttaaccatttccacaacgctaacactatatattgattaaaaatttttaattttatgatgggaaaacttgctgttctctgtttaaaagttaaaatttgcattcatctccatgactatcgtgactcatgtgctaatcttttactgccacctagcggtgtgtgggtgaagttgcccagctctgagggtgacttgggtgatttcagcgcaggtggagttaagagatggccttttgcatccagcagacctgtgaatgccagaatctgacccattgcaaacatggctcgcggggtggaggagatagtccttgtggagggcacaaggtagatagtgttcttatgttgaatttcacgctgaaactaaatgcagataaaaatatattttttgaatagattcacgtggtgatttttattgctttcttggcagcccttataaacccactgttctgttgttccattccgttggtgattaattttagaaggcagtgtggattctcagagtagttaggatagaagcagttgtgtatgccaaagtgcatccaccagtatgtggctattgtaaattctgtgaaagtttctggtatcctgaattgttgtaaaacccagttctatattttgaacccacatattttcactcttcattgcaaataccccagtatgcctgtcaatcaggaagtgttattcctgctgtcttagggccatcccaggggcactagggtgagatggtggctgttgtgcaggtcggggcagcccccaagtcccacctcagccaaagcaaccacataaaattgtacctacccaggacccttaggtaggggtcctgggtaggagtcccgtggagaaatggaactggtagtaaaataaaattttaaaaagaaatcaaaataaccactgtagatttttgctgaaagtatttgtgaatttccatttactccaaaagaaagctgtgagtaaacatttacacagccagtagttttttcctccccacccattaatatcttgcctcaaggggcaaaagcccagaagtgtactataaccaactttgtggcccaaataggcatgcatattctaaaaagcgatttaacagggaaatggcagctgcccccgctttgggactgtgttcatttcaaagcacttaacgtaggcactatgtccctggaggaaactatcatggcacacttctgtatggggaccaaattgtgggcctcccttggattgagtaccgtctttccatagtgacgcgttcttatcccatcctcctccactcacccagctgtgcccttttctgagggagtcttgctgtcctcggttatgtgtgcctgcctcgggctgcctcaccagtggcgcccaggcttctccagcccccacaccacatggaatatcaatgagatgttgtgcggtaaaaggaaaccagtcaggacccattcttctttctgctctcattatctcaagggcattgtgtgcaaaattcatttaaaatagcctcagagacttttctttttgctaggactaaaatattttgagcattcagtgatgcctgtgctatgtgctgtcccagctcaggacaaaatgcaccctggcccgctctgatggcctggtcactgtcctgtgcctgctttgatggtcgtggctcatgctcctagctgccatcacatgcatcgtcctctcccacaccactt

SEQ ID NO: 95678 - DNA, 1035 bp, Homo sapiens
gtttgaaaaaagaaaaaaaaatctacaggtagttctgaaattatgaacacaatagggcaggaaaaagaattctgaacttggagtcaagataaatttcactctgctgaatgcaggtcactccagcgctttgaccttccattacctcatctccaaaataaggttgtaaaaaacaaaaagagttacacctacggcactggtgtagaggggagtttccaggctgagggagctggcagtgggtggacctcctgtcctaccaactcaggcccactgcttcctaccttcctcacatgtatcagaagtatcagccaggccagagaatcaggttcaggcagaactgtcaaggaattcccctctgcttccaagaggcccatgcccatccttcctcaatgttcctttactgagatttgttgcagctgtagtttctgtgttgacaggaatccccattcctcagtatccccagccttttctcagtgtaaggccttccccccaagaacagaacctacatagatagaactgatacacctgtggaattggcatataaatgtttattaagaaaacagagatagcctttgaacctgctttttaaataaataaataaggctttcagggggtttgatgcatgtgctttttttttttttttttgagacggagtttcactcttgttgcccaggctggagtgcaatggcacgatctcggctcactgcaacctccgcctcccaggttcaagcaattctcctgcctcagcctccctagtagctgggattacaggcgcccaccaccacacccagctaattttgtaattttagcagagacagggtttctccatgttggtcaggctggtgtcgaactcccgacctccggtgatctgcccatctcggcctcccaaggtgctgggattacaggcttgagccaccgcgccaggccatgcgtgtgcttttcttctccacctgatccttccccttttccttctcagagctggagcggggagctctgggaaagccaggctgagtgtctggtgctgagggggctggtgct

SEQ ID NO: 95679 - DNA, 1036 bp, Homo sapiens
tggaaaagataaaactgtaaagttaaagtcttcctcttgccagttctcagctctcctcaggaaacagctgttgatcctttctttgtattcatctgcagtgtttgtatgtgacccagctaacacaaataggtatttatagttctccctttttatataacctattatgtattgtcctgaatcttattttcttccacttactgtgtcctggtgatctttctatatcatatatagagaccttttttggcagctgcttagtgttccattttgtggctatactagctagatctctttaccaagacacgggttttcccttcagcattacttgttagcaagtcgtcttcttatgaatatgttgtaatttccttagtcctgtgttgttggatctttaggttgattgcagtttggggccatcataaaccatgcttcagaaagccacacatctgtgtctctgtcatcattttcatggtacactggctttcccagggtcctgctacagagcacctgtgcttccctgaaatgctgtcccaatttacttttccaccgtctgtataaacagggatcttgagaccagcttttccatggggaacaggaaaaggcagaaatgtgcattgtgtcgtgggaagaccagtaccgggaacttgtagtatctctgttgaagaggtccaggaaaataaaagaagaaagtgaccatagctaacacttaactatattccaaatgctattctaatcgctgtttatggttggcaagtttaattatgtcaatacccgtgcgaagtaggcagctattttcttcattttataggtgaggaaaccaaggcatggagccctttccattacctgccttttacctggatgctcagttgctatggagggccgggggtgggggcaccaggagagggaagatgggagagccaagccatcaaccctgggcacccaccctaaagaggaggggtggaaacagtgtttgccaaggggattgagtccatgtttatgtagacatttaaagcatgcagctctgattagaatatttttgttg

SEQ ID NO: 95680 - DNA, 1026 bp, Homo sapiens
tcctccagttacaccatttaatttgaataaaatacctgtgttcaacttaaaagtatttttcaagcgcagttgacttttcacctttgcaggggtctaggttttgttattactgagttaccgtcaagacccctcacagctgcctcatcgtgctctgtggctgggagtgtataccacactgggttcacatcaccattcagaaattaaccacacagtggacttaggcgtttagggctttagtctacaaacagcatgtattgcttattaatttgttctcataaacaatttaaaagatatttgtttttcctgcagtttttgaatctaacttaaatattaagtttttttttcttggtagttcaccaaatctctgcattttgctaatcgttttttctataaagtaatttttaaagttctcagcagtaatattaaagccacgtgagctatgtccagcatcccatttgttataaaacaagaacctttgactaatgggaaattctcagtcagcaaagacattttgaaatttgtaactatgatttttctgtattcttccaagactggtagtttgaaattttaggctgcttaggagtttacagatagtatgacctctttgttctgcagtaagagtcaagatgctaccttaaaacctttgctgtcttccttccccgccttgctcctgagttttaagtcgtggctgcaccagagatgtctctccgtggagctggtcctcactgtgttctcatgtgctttttctgggaatgctctgcacacgctgtccggatgcagataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgagggtgagtgaaaactgcacattgttattattcagagctccgcaggtggccttgccagagctgcggga

SEQ ID NO: 95681 - DNA, 2306 bp, Homo sapiens
agcacggaactaaagtcatgccctgccatgcccagggccggttctttaaaggtattttgtttctgcccagctgcctcaaccaattatctttttcctgggatttttgatacaaaaaacaatatatggccaatcagtagcttatgttattttaatgtaaattcttgataacttagaaactgccttttcctttaaaagcccacttgtcactgctgctgatgggagcatatattcagggcaacttgaattgatgttcctgggttgcagttctcaaacttggcctgaataaactctacgatcctgtttttacttattttgtagtaagatttaattgttttgaaaacaaagtatgcattttgttgtcttcgtaagttaattttctttgtaaaatttaaaatattggttaaaatttaagattccatccattggaatccctgaaagttgtggacttaaacattgacttccttttttctttctcttacagctgtttggggcaacttcgttaatatgaggtaattgtttttaattacttgggtactgtggttggattttatagacacatttcagttggtacatatataccatggatgtcatgggttaattgaaaaatatttttaaaacaaaagtgggttcttgctattcacatatctgagctgtttcttttctcctatgggtattctcaaggaatgcagctgattttaacaattaccaagtaaggcccacaagtaaaacaatggtcggccacccccgcttccctccttgtgtagataataaagggttgaccctagcttatgtaaattgtatttctgggtggattgagcaagaacactgaggggcttttgcaaagccttctgagaagggagctgtcttcgggaagccatggcaggcccatgacctcagggggccagctagtgggtatcgatgcagagaccacctatttagtccagcgttaggcctgtatgcatcgtgtgtgcttcttcatagggcaggaggcactcttgtaaaaataaaactcgtgttatctctttaccaaataaaaaaaaatagcctttaaaaaaatcagcaaaaagaaataagcacttattgtaaaaaccatttggtactgttaatagttttccatgtaaaggaaaatttgctccacttggttatgttgtgagaatcactattgtgatgattaggttggtattgtaatgtaatgcggctgcacatgtctaccagggtaaaaggttactatgccctcaggaggcttttcatgtggagttgggttttgcaaggtgggtgggatggtgtcgatttgattcctaccaccagggcatgtgtgtgtctcctgacaaaggctgctgtgtatgactaggtggggtgctcagatcccttttaaaggagctctgtggttttacttaaaagactccatttttacattaaatccccaggaaagcccagcaggcacaaacacatactcctacagacgcacttcctgcttcaaatttaaaatcctgtgttggatgtagcatagcagtgagattattttagtttagtggaaataatccattaggtaatactgagcatgttcacagatggatttaaggggagtccttccctttggttgtcttcttttcctctggtgcatcccttctggagggaattgtacacatgactgatacttgagcaggagacagaggtggtctgcatccgttgggttatgttagggtaatttattcagaaacagtcttaaagtcacaaagcctttcagttgatctcagttttatagctttctactcaacaggtctatccaggaaaatggtgaactaaaaattgaaagcaagattgaagaggttagtcttttttctatttttgtatctatttcatctgtatacttgtcaattttacttcctttgctcgtgctgtcattcttattgtggcagcttgatgctgttctgtgattttgcaaccgtgtctcaaaaaattactcccttatttaagaggacatgcagtctgttactgttggtccatttttgatgtattaaaacaaattctacctcaaaggcaaaatggatttagacttttacatgacttttcaggtaagcgttttttagagaaagggaagtgattgcctttgggagatagagatgagtacaaacatcctctcactggcacaggtgctgaaaagaacaatggccaccaatcggatgctaggccacgtgcacagatggagacgttgcacacccacccagctgaaggctagcacctatgctcagttatgcacctcctatttaaatacatgtagatacagccagaccgttgtaacatgg

SEQ ID NO: 95682 - DNA, 1033 bp, Homo sapiens
gaattaaacacagagcagtatcttctaattcgaaccttctggtcagcttaagcaaaactttgaatgcttttcttcttagaagaatgatgcatattcttatctgctttaagcaaacatttcagttgtgccacctcagggtttatccaaggaaagtcgaagatttgcccttttccagagtgctaggatgattggggttcttcagaggtgagtaaggatgcatctttcctatgtacacttgttttcttcagatgggaggtgggaggactgcagccaggtggggagcagccaggggtggggggatagggatcagaattttctgaggacttcagacttggcccttgccttctacccaggcgggccagtctctatgcaaagcagtgcctttgactggaggagggcacagatacacttggtagggcaagctgtgggtgaggagggatttagccctatatttggcttgatttgagggctgtgacctgggcgtatgagcatcaatagattaaaggtggtgacaggtctggcactgttttggttgtggttatgtttcactgcttaaccaaccactttaaaacatagtggcagaaaacagttaccgttgtatttatacccatgggcttggtggatcaggaatttgagacggggatggctcttctttgtttcgtgatgcctgggaccacacccaggttagagcatccacttgcagggggcttcttcactggcaggtctggaccttgaggacagactcaggcttggctgttagagtgcccacaggcaacctgtctggcctcacgtggtcagacttcacgcatggtggttcagggctctgagaccaagtgtctcagcaaatgtggcagaagcactggcggccatctgtgaccatctaaaggcatcatatagtgtatcttttgctcttcactgtggtccaagcagctcaagacccccagacttaaaagaaggacacagagacacttctgtccccccatgcaaggtgtgccagataatttttggataggttttaaaagtgtcactttgg

SEQ ID NO: 95683 - DNA, 1003 bp, Homo sapiens
ttttgcattttggggttggcccgtgtggcctgaaatgtgctttgtggtgtgcatgtctcctgagctgcctaccttttgtagatatgtgactggattctagtcctggtatatgatatgtatggtacttctgtacaggccagtgctgtgatctgaatgtttgtgtcccctggaattcacatgttggaacctaatccttgaagtgatggcattaagaggtggggtatttgggaggtgattaggtcaggaggcagagccctcatgcatgggatagtgtctttgtaacagaggcccaagggagttcattcctcccttccaccatgtgaggatacagcaagaaggcaccgtctgtgaataggaagtgagccctcaccgccagtgtcttgatcttgcacttcccaaccttcataactgtgagaaacaaattcctgtttattagccacccactgtgtagtatatttgtgatagcagcctgaacatggactaagacagctgagaagtcaagaacatgtctgatgtgaagttggagagctttcacaaatagatatgttgaataggtgaggccagttaccagattcttcatgtgtactgaacccacattaatgtctactgcaaatttcttgtcttgctttttgtcttacaaatatgacaagtcctaggaattacctgaagggtaaatgtggggaggattaattcagggtcagcccttttctttttctttttatacttttatttttttctgagatggagttttgctctgttgcccaggctggaatgcagtggtgcgattttgcctcactgtgacttctgcctcccaggttccagcgtttctcctgcctcagcctcctgagtagctgggatcacaagcgtgcgccaccacgcccggctaatttttgtatttttagtagagatgaggttttaccatgttggccaggctggtctcgaactcccgacctcaggtgatccacccacctcggcctcccaaagtgctgggattagaggcatg

SEQ ID NO: 95684 - DNA, 2633 bp, Homo sapiens
tttttagtagagacggggtttcaccatgttagccaggatggtctcgatctcctgacctcgtgatccgcctgcctcggcctcccaaagtgctgggattacaggcgtaagccaccgctcccagcaggaaagttttttaaccaatcattcatctgaccaggaaatcttaccaagtccttactgttgtccctgaatttggcactaggagacaccatggggtgctaaaacttaactggtctgtgctgtgatggtacagaccctataccacatagtgtagcacgttgattctcagacttaagcatgcatcagaatcagtagggttttttttaaaaaacacagactgcttgtctcccacctcaagtttctgattcagttggtctgggatgtggcctgagaatctgcatcactaataggttgttctgtatgctgttgctgtgacctgacaccactttgagacccactggccaagatggtgaggtgggcatgaattggaaatgaaggttaaattacaaactggtgtgaggaaaaggaatgcatgagaactatgccaggaactcctgagtgagagcaatcaggtacgtttgttttgttgaggaatcaaaagtgagctgagaatggacggcttatgtaggagttaacagggaagtcataggagagagcgtgttctaggaggagcagtgtgtgcagaggtcctgcggcagccaagagcaggcagtattctaggaatgcaaagaaggatggtattgttggagtgtgaaaacaaaattacagccatgaggctgcccaggcagacaggggccagagcaggcaagcaggcaggcaggcctggggtgcagcccacgacatggttgattttagctatgaggggtttaacacagggtggaggcagtgttaataaggagcaggtatgctaagtctgagccactctgcagggaaaaatgttacagggcttgtgattgataacaccgaaggacactgaaaatgtagtccctcaaccgtgatgtctgtgttttctaatctctgcttttcctaattagtaatcttgccctccctgttacaagtaaaatctcaccactgtttgaaaaaactgtccatacttcccaattatatacaccctcactgttagccagcctccgttgcagaaatgccctccctgtttcgggaacagaactcaagttctgttagcctttctccttctcctccttacatctttcccaaagtctttgttacctactctggccctgagtctcctccttgataccacataactcttcttcatgtcttagggttgaccacctgctaacttgcattgtacttgagttctttcccattcatatgttggcttttttttctcaatgaaatcccgattctgaggacagggattgtgtcttatgtgtttcagcccttgaaacatttatagcagtgctaatggctcattgaaagaactcagtttctgccctttgtgctgaatcaaaaatcaggccaacctactaggtagctcctgggcagactgcttgaattacctttaacgtatttttttttaacatgcatatagtgtaaaaagttaaatagcttctgcagggccaaacagtatcccctgccaccatttccctctccccagaagcaggcacttcatttcttttttttttttttttgatacagagtttcgcttttgttgcccaggctggagtgcagtggcgtgatttcggctcactgcaaccttggcctcttgggttcaagcgattctcctgcctcagcctcctgagtagctgggattacaggcatgcgccaccacgcccggctaattttgtatttttagtagagacggtttctccatgttggtcaggctggtctcaaactcctgacctcaggtgatctgcctacctcagcctcccaaagtgctaggattgcaggcgtgagccaccgcacccaacccctaggcatttcacttcttttagttgattattttggtatttatcattgtgccattgaatcacctggcttcctgatttttcagttgtagatattacctagtgactttgttctttgggagatgatttttttcttctctttgcccctgtacatgctctccaccctcctatatagatgtggtataatctcacggagctcatcatgcagtgtttacaagcatgactatgtaaatgctgttcctagtgagtcatgttgtaggttactttttgttttctccagcgaataattggctggtgttctaatttgcttgctttctatgtagtatgacagatccaactccaaactctttgccagttgtctgtcgcgtcttcccccatgatgttcatgagcatcaggatgccccttggtcagcaccccttcctgaagaagggccccggggccttctactgcaacttgtggatacatctgagggtcagctgccagcctcaccacctgcacccacatcagcctggacctacccactgcaggacttctgtttcctgacttcctcttcctgactccctcttgtttcactccctggtttggatgtgatgggaagtgaattctgagactttacccataagtatattttctgccttcatgtctgatagattgatagtgtagaattatagaaaaaaagttcctttagaatttttgaagcattg

SEQ ID NO: 95685 - DNA, 2043 bp, Homo sapiens
ctcactgtgataggtgagtgtatggctgcaggggttttcattgctcacaggcttcctcagtgaacagagcagggcaatacatgggtaaacataaacacgcatacctgcatgcatacattcatctatatttccatattaaaatatgttgaaaaccatgggttctcaccaatattttcaattctaatccattttcacagtttttattctagttgttccctttagtacagttgatccttaatgcagggactaggggcgctatctccacagctgataatccacataaaattttgtagccacttcctgttgctgttgcagtgagctcaagtgtcatatcacctaaagtgctatgtgatgtgtatccagggtctatgctacctgctttatagggattatctcattttggaaatacttccattcaaaacgggtttaactaaaagtattttgatatttgaagctgcagttggctgaaaaacccatttatatggaaaaactaattcactacgacggattcagttaaatgatgacttttatgtactctgtcttcttactctctccataattgtgtgtgtgtgtgtaagtatatatgtatataaaggaaaacttcttttatatataaatattctatatatatgatacaaatatgttctctatattttttaatatgtaattgaccttttaacaacttgggggttaagagtggcaactgccactctgacccaccccctgcacagttgaaaattcacatataacttttgaatccccaaaaacttaactactgctaacctactgttgaccggaagccttgataacataaacaattgactaacacatatttttgttgttgttgctattgttgttgttgttttgagattgtgtctcgctctgttgcccaggctgcagtgcaatggtgcagtctcggctcactgcaacctctgcctcacaggttcaagagattcgcctgcctcagcctcccaagtagctgggactacagatgtctgccaccacgcctggctaattttttttatttttagtagagacggggtttcaccatgttggccaggctggtctcgatctcctgacctcaagtgatcctccagcctcggccttccagagtgctgggattataggcgtgagctaccgcgcctggcccaattaacacatattttgtatattgtgcgtattatatactgtgttcttacaataaagtaaactagagaagagaaaatgatattaagaaaatcataaggaagagaaaatatatttactagtcattaaatggaagtggatcatgataaaggtcttcctcctcattgtcttcatgttgagtaggttgaggaggaggaggaatgtatatatacacaagctagacagctgaggctaattcttcttctgaaccagtctctgtcaattccccattccccattctctttagtcttgcagttggtttatgtcttgtatatacttcaagggccactggagccgagcctccttggggtcaccttcctcaactgccctggttcctagtcttccccttctctgagctcctggagctctctattcctttgcagttcattcagtacacatcagtgcaacctggttttgccattcatcatttcatgtgtatagaggcagccactgatgctagtgccagatcctttgaacgatcagcacttagtgctctgaatccctcccagctcctgggatgcttgctactgttgaagataattactcaagtcactgtatgtcattcattcttccatcctctgagagctgcaattttctcatgtgttatgttatatgttatatgttatatgttatgttataatcataacagagattatatcatctacctcatcggtggtgttttagccattaacgagaataagttgtgaaaaaagttttttaatttcagcatcgctgtatcagtgttatttatttgtgatgcattttaaacaggactcaatgtactcaaatgtggttttcacacagctttttgggaacattcctccagtggatggttaggagggaatctgtccagcttgg

SEQ ID NO: 95686 - DNA, 1056 bp, Homo sapiens
gcctgtgtgtcatgcatctggtacacagaaacccctcccaaaggtccacccaggaagtcaccttgattgtttgctttgggtgctgtagctgtagttggtttttcccatagattgagccatttgaaccaggagaattctttagaccagttttgaagcaaaaaatatgtctcattctttgcctaaatgagccaagacactgtgcaaaaagctgacactgtggcaatttcttacaggcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttcaggagagtaaaaattcatataaagtgcaattgcacaaatacaagccaagctagaaggaagcacctatgaaagcaacaactttgtt

SEQ ID NO: 95687 - DNA, 3225 bp, Homo sapiens
gtctctgagggaggaaggacatagattatttcttgcttactctctgactggtccctattcagattgttgaccaatcaccaatttttgagccccacacatgacacctccctcaacaatatctgttgcctccaattctgagcatttcagttctgcagaatatttgccaggttctcatgtgtttccttgtgcaggtccttaggttatagctttcttcctgcttctaattcagttcatcctcctccgtaattcagttttccaaagatgtgttgaaatttctcttatccttatatcttttctccttttctctttgcgcaatgtgttctaccttttaaaatctcttattctcacttcagtgtgttttgaaaaggtcaggagataattacgcatgtggtcaatccaccattttttaaccccaggcaaataaatcttgttctaaaataggcattaactgaacgtctggatgctcttcttctggaaaaagcagagactgagcaacagtgtctttctctgaaaaaggaaaatataaaaatgaagcaagaggttgaggtaagtcaatattttagtgttcttttcttttttattaacatatagtgtagtcattaattttagaggtaagactttaaaaagcatctaatctgattaatattttataatataaacaaagaaaccgagattgagattttaaaagaaaaataactgaatcacctaactatacagcaacagaggtgacatttacttttgttgcattatcttttttatagctataatgccatctttactaaaagcgaaaaaaagtaagttgattttcacacatgactaaataccattatctctttagttctacggtattcagaggcatttcttgcctatttcttgcctattaggtctgggctaatttgagtaatagatttaatattgtagatatatattgtcatactttagataggcagcacctaaggagagttattggaatatcagtatcatgtttctccaaatacatttctgctcatttacttttctctctacttagcttgtggctaatatttttcctaaggtcagaggctccttttgtcttacttaaataatttatgtgtgcttattttttgtaataggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttag

SEQ ID NO: 95688 - DNA, 1035 bp, Homo sapiens
cattaattccttaataccaaccataaatttgagaatccatgctgtgatttggggtgtatatattttaaacattgaaatattaccaaactttttgtattttagcgtgtcagatttattttattttatttttttgagacggagtctcgctctgttgcccaggctggagtgcagtggcgcaatctcagctcactgcaagctccacctcctgggttcatgccattctcctgcctcagcctcccgagtagctgggattacaggcactcaccaccatgcccagctaattttccgtgtgtatttttagtggagacggggtttcactgtgttagccaggatggtctcaatctcctgaccttgtgatccacccgcctcggcctcccaaagtgctgggattacaggtgtgagacaccacgcccggccgtcagatttattttaaagccccttaaaaatacctttttaatattggttgggtggtgtgggttgtttttatttttaatttcaggaacatgccactactgtaaatgaacttgaagaacttcaggtacaacttcaaaagcaaaagaaacagcttcagaaaaccatgcaagaattagagctggttaaaaaggtaaaataaaacactaggatcaaaattgatgtaatattcacattgttctgttttgttgttctgtttgttctgttctctctgcaatctcactctgtggcccaggctggagtgcagtggcatgatctcggctcactgcaacctccgcctcccgagttcaagcagttcttgtgcctcagccttccaagtagccgagattccacgcatgcgtcaccacacccggctaattttttgtattttgggtagagatggagtttcaccaatttggttaggctcgtctggaactcctgacctcaaatgatccgcccatctcagcctcccaaagtgctaggattacaggtgtgagccaccgcactcagcctgcattgttaaactattctatacatgttgaaaaggaatattttagaatgttacttgtggtactaaaataatgc

SEQ ID NO: 95689 - DNA, 1048 bp, Homo sapiens
aatctaggctcctgagttacaagattttggtttgacagttcattttgtatacatgattgttgtatgacacattaagatttaattaatgtcaaagcttgaaatttgtattatacttaaaactttggctgactttactccttcaaagatgaggctaaaaagaaatgtactataagagccacttgacatattagtattttataaataagagctccgcaagctacagctgctagttgtagttagttataatgaaataaaatgaaactaagaaagttgggttaaactattagaaaatattttgtgaaattaaaaagtagaaaatatccaactcctcatttctttgttacagtgtaaacaatttcagtattacagaaaagcacccatttattgctgtggcatcattttagcaattttacaaatgaaaaaaaaaatttacaaatgaactgatctactattgtgtaaatcttttacttataaaatgtgcaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataagtgagttaaagaaaattcactttactttttaattatttcatcataacaacttgatttggtggggggcattacttgtttatttcaccagtctttcactgtcagtcaggtgtttaacacagtgataaatgttactggggacccagaatgggtgtaaaactgtttgccattaagttgtttgtagtccatgcctatgtcctgaatggtaatgcctaggtcttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtc

SEQ ID NO: 95690 - DNA, 1091 bp, Homo sapiens
tgtcagtctcgtgacatgtcttttttttgagacggagtctcgctgtgtcgcccaggctggagtgcagtggcgcgatctcggctcactgcaagctccacctcccgagttcaggccattttcctgcctcagccttccgagcagctgggactacaggtgcctgccaccaggccggctaattttttgtatttttagtagagacgcagtttcaccgtgttagccaggatagtctcgatctcctgacctcgtgatccacccgcctcggcctcccaaaatgctgggattacaggcatgagccactgcgcctggccgacacatgtcttaattctagtattcaccagatttctttcatgttctccgttgttagacatcaaatttgtctactttttaaatagaaacattagatagagcaaggaacttagaaacactcaagcggcactgaatgtgttagaactgcataaccaatatagcttctttgctttcacatttacaattagttggagttttagttcagccacacccagtatcttccattctgcttccaggaagacatggaaaaatgtcagccatgatgatgcagtattttagtagcaagttgatggtgttttggtttcccatgggaaatattgtcactggagcattagccgctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaaagcttcaaaaagggcagtcaggactaaggcaacttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcctggtaaactttacagtttagaccaggcgtggtgtctcacccctgcaatctcagcactttgggagccaaggcaggtggatcacatgaggccaggagttt

SEQ ID NO: 95691 - DNA, 1038 bp, Homo sapiens
actgcaatctccgcctcccaggttcaagcgattcccctgcctcagcctcccgagtagctgggactgcaggcacgcaccaccatgcccggctaattttttttattttactagaggcatggtttcaccatgttggccaggatggtctcaatctcctgacctcgtgatctgcctgcctcagcctcccaaagtgttgggattacaggcatgagccaccacgcctggccaaatgttatattttcataaatttatactctcttcatgatttcttagtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatcctattaccttttttatatcattctttgcctcatttttctgatagtgttttacattatcttatattcctgaattttcactgtgtctgaacttttgttttgattaagtgccgttcactgtggacgtcttaactgcctgggacttcaggaacagggtaggggcagggggttagtggaggctgccgatgttcccctcagcccattttcagagccccatgccatactggcttagtttctatcgaaagtagaaggcagagggaacatcttggtaccaacccatggctccagttagttgctcctcatggagacgttccatcagttccccagctttcaactccatttccatgataccctgtgcttctgagacaagaaccccagtatttacacaggatgcatcctctcctcgtcagtgatacttggtaagctgctggactgactcatttccacctcttcatctgtttctcgtgagaatttcttgatgtgtctcatctactttttctcctcttgtattagcttcttgcctttctacttcacccctcttccttccaaccccaaatagcttaggacagtggagttatatagcccaacacttggttcatacgcagcaatccactttctaggcaaatgcag

SEQ ID NO: 95692 - DNA, 1230 bp, Homo sapiens
gcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattatgctaagttaaaatacagtttagttatttgctttaaaataaactcttctttttttctttaaagtatactatctcaaaactcattatgttgtcagagccctagagctggctagtgtaacactgactatgagtaggtgggcccacacttgagttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattacttt

SEQ ID NO: 95693 - DNA, 1689 bp, Homo sapiens
gcatttatcctgttattttgttgttgctgtttcttttttttttttttgagatggagtcttactctcgctcaggctggagtgcagtggtgtgatctcagcttactgcaacctctgcctcctgggttcaagcgattgtcctgcctcagcctcccgggtaactgggaccacaggcgcccaccaccacgcctggctaacttgtattttttagtagagatgaggtttcaccatgttggccaggctgattttgaactcctgacctcaagtgatctgaccgcctcggcctcccaaagtgctgagattacaggcgtgaaccactgcacctggctgttgttgctgtttctatgtgagactgataaaggacaaaaagaagatggcaagggatggatggaaaaggctggttcttctctcagggttcccagaccatagctggagataacccagggttgtagctccatctgctggagagaagcaaacccactcttacatagtctataaatgaaagtgatctctccacaatcacagtgagccagcctgtgtttgctaagcacttgctgtgcactgtgtaacactttgtcaggcttagggtaacagaggaaaaacatagacatgttccctgttcccaccatgcttagctctgagaggccttctgctgtcaagaagacttattttagctggtgtgcttttgcattctaggtttccccctagacttttccttgggtgacttttaaagccacgtaacctcattctgagcttcctgttccttattagaggtaaggaataacagtgcccctcctataggcctcagtttagctaaactttattaagtatctagtgtgtctgctaggcagaggcccaaggagcataaagatgagtaggaatctagtccctgccctccacaaggttagaaacaggagctcataaaatgatcctcgcggagtaaatgagaatgtataacgggatccctgaggaggagtgcgggatccaggcaggagagtcgactaggaaggtatggacaggttttctgagttgtttgaggatgtgagcattagcgaagggaagcccttcccagccgaggtcagcgtgagcagcagcatggagatgagggcctgtgtggtatgtgtatgtccctcttaggctgtgtaaagtgagcggcaggaagtgtccagggatgagggtttggggacatagatggagccaggtagggcctggagcagtagctcacgcttgtaatcccagcacttcgggaggccaagatgggcagatcatttgaggtcaggagttcgacaccagcctggcaacatggtgaaaccctgtctctaccaaaaatacaaaaattagccgagcgtggtggcacgtgcctgttgacccagctacttgggaggctgaggcaggaaaatgacttgaacgtaggaagtggaggctgcaacgagctgagatcactccattgcccaccagcctgggcaacagagcatgactccgtctcaaaaaaaaaaaaaaaaaaaaaggcggggccaggcgatatagggttttgtgtgttaccttaagggatgctgactgtcctcagtgcagtagagaatttaagcagggtagtgatagcaggttccttagaccgcttgctggctgtgtctgttggatttgattgaaggggaccaggctggagacagggactccatctaggaggctgcggca

SEQ ID NO: 95694 - DNA, 1050 bp, Homo sapiens
tgtgactgtaagaggtgtttccagattgcagtaggttgatgagtaaataggagttgagataacttttagaaaatggtgtctgaggccgggcgtggtggctcatgcctgtaatcccagcactttgggaggccgaggcaggcgaatcatgaggtcaggagatcgagaccatcctggctaacacggtgaaaccccatcttactaaaaatacaaaaaattagccgggtgttgtggagggtgcctgtagtcccagctactccgggggctgaggcaggagaatggcgtgaacccaggaggcggagcttgcagtgagctgagattgcgccactgcactccagcctggacgacagagcgagactccgtctcaaaacacaaaaaaaaacaaaaaaacaaacaaaaaaagaaaatggtgtctgaaaagagagagctgtgatggtagctggagagtgactcaagatagactcattttaacgtagcagaaactggagcctatttacaaactcttcgggggaaagagcccaaaaagaaggaaagtggctgtctggatgtgagtttatggactgacatcaaacagaccttgttgggactgaaggcctgaagagtaagcatataggtgggaggtagttgaaagagaactttccagataaactgttttcttcatgaataagtaataaagtaatatctgctgagagaagaaagggatgaggtcgattacgagaagaccttcaagcatggtacgtccttatgcgagtggcgcatggcttcaagaggagggttgatgggacccatccatgagtagagaagttaacaacaatgccagtctgcccaggatgttctgctgggactcagaaaaacatccagtttccttcctttagattttaactgcagcatcacgagctgccttcctagagggaattttgtattttggggctgtagctcagaagacttccattctcttttccctctcccaagagagatcgcagctgcttcccggggtttatgtccatgacataggactgtccctgctgggaatgggggagggaactgcttccc

SEQ ID NO: 95695 - DNA, 1080 bp, Homo sapiens
tatagcttgtcaccagctctaagagtggctagtacccagtctcagtgttggataacaagcaaaagtgatgagttgttttcttggggtttgtgtgtgtgtgtgtgtgtgtgtgtgtgtgtgtgtgtgtgtgtgtgtgtgtttggtttgttgtggtggtatgtttttgtttttgttttttcagagacatggtctccctatgttgcctagtctgggcctgaactcctgggctcaagtgatctcctatgtcggcctcccagagcactgagattacaggcaagtgtaagccactgcacctggccgttttcttgtttttaaagattaacctcaggccctagttatgttaccatcctagaaatgcagttatcctaaaaatgattcctctataataaaggaattgggtaaaggagctttcttgctgtattttcagtgaattcaggcaaggacaccctcattcatggaaggggaaggctgaattaattgctctcaagttctttcttaccttcaactaaattagatccctttattctccagtggaaacttggcactgaggagtcccaggaggtgactcagtcggatatgtgaggccttagcaccactggccttgctgcttctgcactgtgtctgtcagggatatctgggacagaaagaataatttccgctgctggggcagccagagcctggcgtgcccgtccctaagctggcctgcaccttgccaccggaagatgtagtgtagagtagctgcttgaccccagagtagcattcagagggcacataaagaagctccgttaattcaaacatgtagttattatagagatccagagggccagaggctatcatttttttaaagttacctctttctatgatgatcagttattcatttttctaaatatttgtctgcatgttatatgtgctttcagtaagtttttgggtgaatttcttaacttcataaagtatataaaacaacttagcaggatatgagttatgacatttaggggtgttgtcctattgcttcagaacagtggggttatcgtgtaacacaccatgtcacatgatttgactaaatacaggaaaaaaaaaaac

SEQ ID NO: 95696 - DNA, 1049 bp, Homo sapiens
tttctggatttgttttccttatgacctacctttctcagttatttaagaagcaaatctaaaggatatttgttgaaactctctatgcagaaagggtcttgggtgagttgtagtaaccttcagccatgctgattaaaattttctccctgctgcagaggttatgattgtggttcttatatcttgtagatgtgtatttaattattgaaatatgtgaaaactttgttttattggtttcaaagtagggtgggtgtggaagggaaactatgccttttgtttgcaaagaaaaatttaaaaacaattgataaacagtatttagtgtcatatggtttatatcctgcagagccttctataaaagaccttagtaatgcttttggcattttattacattaattttttaaaacattatttctgctgcctagggtctttggtggggaaatgtactatttagcaatatgtttagtgaacttttgtcctgtcatggtaagaagaaagcagctataactaagtaaggagttactcttattcattaacatgtaaaacgctgtttaaaaaaaaaaaactggtcatttttttaagttttatttttaattggcacatttatttatggagtacaatgtgatattttggttcatatgtacattgtacaatgaccaaatcagggtaattagcctatcaatcatctcaaatatcactttttcgtggtaacaacacttaaaatcctcttgaggtattttgagatatacaatacagtattattaattataatcactttgctgtacaatagatcaccagaacttactcttcctaattttgtacctgttgacaaactcttagtttcattgattctgttgtttttctagtctctttttcatttacttctgttctgatctttgttatttccttcctcctgctaacattgggcctagtttgttatttttctagttccatgaggtgtaatattaggctgttatttgagatctttcttttttgaagtaggtgtctattgctgtaaacttccctgttagcactaacttttgctgcatcccataagt

SEQ ID NO: 95697 - DNA, 1104 bp, Homo sapiens
aaccagccagaaataacaccagactgccaagtcagatgtgatttcttagtcataaaaggtacttttcattcctgtaatcctgattggcctggtcagtaattaaaagtcaacattcagttttattttacttatttctaggaccattgtagaatccttcagtcattacatatctggtgagaccctagtggtaagtaaaggatatccatgcacttgaggggaaggaagtgttcacacatgaaatagctagaatagtaacaaagctccctttaaattcagacaatagcagtgagctactggtaacagcccaaaggagaaaatgagcagcagccagaattttgagattaattttaataatttattaatgaatgcaccagcagagaagaggtgggaaggatatggtcgacaagtggtaggagtaaaaaattcagctgtggggaaggggtagcttttgcttagaaagttcaccacagacccctgccctctaagttatggtgaattctgtggaagtgattagagtggagaaaaaggaacaaagagggttggaatccagacgttccatgactaaccccaagatgactaaaccagctactgaatgcacccacagaaagggaagtgacatttactgagaacacatttagtgttgctgaacgcttaaaatgctttctttgtgttctcagtccttaccagtctgtgaggggggtttattttgtctacattacagatgaagaatctcacctgcaaatgaagaaagttggctggccgacaggagatcgtttgaaatgaaaggattccagggtttctttctactgagcgtattcaataagcagggcttattatactatctagaatggtgctatcctgtagaaatacaatgtaagcagcatgtgtagttttaagattttctagtagccatttaaaacaggaaaaaagagatagggaagattaattttaataatatgtttaatttaacccagtatatcaaactgtcatcatgtccaagctatatacatatcatgtcatcagcattttaaagttaccaggagaattcagtgggtactttaaagtccatctgaattcagactagccacatttcaagttgctaca

SEQ ID NO: 95698 - DNA, 1052 bp, Homo sapiens
tcttgctctgttgctgaggtgcagtggcatgatcttggctcactgcaacttctgcctcctgggttcaaacgattctcctgcctcagcctcccgagaagctgggattacaggcacgtaccaccacacccagctgatttttgtatttttagtagaagtggagtttccccttgttggccaggctgatctcgaactcctgacctcaggtgatctgcctgcctcagcctccaaaagtgctgagattacagatgtgagccaccgtgcttggtcaaaacatcttaatttgacctttttttttattcacagaccactttgagactcaacacttaacgacattcatagaagaaaatgcacaaaggcacatgcatagaaagtttttgtataacttccaggaattcatgcccccagtgcagccacagcaacacgtgattgtaatgatgattgcatttctgaagactttttaaaagcatttttttggatagaagagttaaaatgttgtgaattcttgataaattgaataagcaacaaatacactagcagtcactagagggtgatgttttctagcatacaacatcaagttctttccggcaggttgccattgtaggttcctgtgtatgtgcttgcttgtacgtatgtctgtgtgaaagagacagaggcacacacacagactgtctctacctgcataactaaaagaatttctttgtgcatgtttcttttttctccttttcacttatctataatacaagcaaaaatgcttttttttttttttttttgcgacagagtcttgcatgttgcccaggctggagtgcagtgatgcagtctcagctcactgcaacctctgcctcctaggttcaagtgattctcctgcctcagcctcccgaatagctgggattacaggcgcccgctgccacacccggctattttttgtattttttagtagagacggggtttcactatgttggcaaggctggtcttgaactcctgacctggtgatccgcccgcctcagcctcccaaagtggtgggattacaggtgtgagccaccacacctggccag

SEQ ID NO: 95699 - DNA, 1050 bp, Homo sapiens
ttcatagtaaactaaaaaaatgtctactttatccaaactttttcatttataaacgaatttgtgtcacctggtatgtcttagatgtgatttgagactttttgttgttgttgacatagctttaataaaattaacataaactgtgactttgtataggctaggaggaaggagagactgaggagtactatgtttggaaggaaagctgaaggtagggcagccggatggttagctttgcagatatgaggccagtgagaagaaaacagctagttcgatattttgcttaggattaagccctgatggttggatactagccatctggggggtggtgggtggggaatccttttgggagaacggacggagtgtgggaatgaggccctggccaggcagatgtgtgccagtctgacactgttcatttcttctgttgtttatgccagttcaggcaacacggaagctgtgtctgtttctcctgtcattgtaaacgtagccctggtctttcaaaaagctgtggttgtgtgggtctttaaggtattccttcagtaattgtggtggccactatttcatttaaggagttagcatcttataaagaaaaatctgttttctcaaggctctatagtaatgatattttgtttaagtttgtccaatatggtatttagttcttcctattaaggaggagtctctaaacttcagtctgtgggccaaatctacctcctgtttctgtttaattattttattgggggggtgatatttatcccctcaagcatttattctttatgttacaaacaatccaattatattattttagttatttttaaatgtccaatctaattattattgactgtagtcaccctgttgtgctatcaaatactaggtcttattcattctttctaactaatgtttttgtacccattaaccattcccttcccattccccatctcaccactacccttcacagcctctggtaatcatctttctactctctgtgtccatgagttaaattgttttgatttttagatcccaaaaataagtgagaacaaatgatgtttgtctttctgt

SEQ ID NO: 95700 - DNA, 1059 bp, Homo sapiens
catttatttgtgtagatgtgtgcttcagtgaattttcttttacagctatacagcatttcattgaagacatcactattttagaaatctgttttcttgatcttgagagaagcagggtagtagagtgatcatagatggggcccctgatgcccattccagtccccattctgtcactcaccagttgggagcccagtttctacttccgagaaatagggataccgctcatttcacagggtgttagggggatcaaatgaaatagtatgtgaagcattaacaccatgattattaccgtcattactgccactagaacgagatgacagtaatgcagactcagggcaggactaattttgtgctatattttaacttgcagttggacggagggcactctgaaagaagtagggacaatagcttggagacagctgaggtggcgtctttctgaagacttctgttttctctaacataggtggggttatctcccaagagtaatagaaaaagagggtgggatcggtgattcgagagtactgagggtttgaagtgttctcatttggggcatgatctggctaaatacatgcaaaataatttcctgtgttggtgtgtgtgctaatcttgtttgatttttttcttagcaacctgtttacctggcaaagcataaaggcttctcctctggagtcttctcttccctcccccatggcaggtgttgctgcctggagctgcttccacaactggttgtctccaggattgcacccctccccacccggaattctaaccttgtgtggcttatcacctgtcacataaacccatcagcctggctctcactcttcaaaagctgactctaaactgcccggctccccgcagtcattgctcctactgtttccagagtgaggcgcccactgttccctggctcacttctccaccttcccatgcctttgcattctcctctccatctagaatattctctcctcccttttcctggtgccattctttcacaatgtaacatatcccttaatgtatttcatatgatcttgggcaatctatttaacatcctcagatatgatacttcag

SEQ ID NO: 95701 - DNA, 1034 bp, Homo sapiens
gtgcaaaggctagaaagtgagaggaagcacagtctgtctgggaaactcctggagtccagtcctctcagctgggatgggggtgtgagatctgctggagtcaaagtacagattcaaggagaacccagcagtttggaaaaaaggacagaaagttgtaattagggccagaccaattgttaaggcaaatgtcttattcccagtttttgtgaactgttgttcctcaagaaccactgggcatgtgggggaaagccccaggagttttatgaggtagtaatttccccatcactgcaagtgtccatgaagagacaaactcccaggtcatagatattgtatagggatgaggccatggggaaaatgacggtggggaattctgcattgaatgagagtctggactgaccttcaaagatttttttagagtgctaaaatgaaaaatatctctatttggaaacccgcagaaaatgcatttatacaggcctccctctgtactgtcaaaatcatgctaagacagttatttgaaatttgaaacccttttaaatagggcctgatctgagaattcaggcataattaataattccatctccatgggaaagtacatttgaaaggaaaaatagatggggactcctccctgtctttgtcatggccctgctgtgtgtcctgggtgtttgcccatctgacccccttccctgtgctgatgtgctgctgtctgaagggtgctggggagggaaagcagtcctctctctctctctctctatcttcagtgaaaagatcctggttaggcggggcacggtggctcacgcctgtaatcccagcccgttgggaggctgaggcgggcagatcacaaggtcaggagatcaagaccatcttggccaacatggtgaaaccccatctctactaaaatacaaaaaattagccaggcgtggttgcgcgtgcctataatcccagctacttgggaggctgaggcaggggaatcgcttgaactcgggaggtggaggttgcagtgagctgagatcgtgccactgcactccagcctggcgaca

SEQ ID NO: 95702 - DNA, 2273 bp, Homo sapiens
gaaggctatctatactttgtgtactattgttctttttcctacaaactaacttccagagtttattttaaattctctatttaaatgtaacaaggacaaattgacaagcttcaacttctctattaaatttgtatttgtcacagacagctatactacagtaactgtaatttgctaaagaaacatttattttaaaattgttgactcaccaatttttgaagagggtagcattaaaggactattattgacactaacattattagaacttatcgcttactatgtcaggtgtctcttagctacatttaatgtattaactttgaattgactggattaaacaatttaaaagtctcagagtttaaattgttaagaagtttgtatgtgaggttagtgaaaatattgagctctatattgctaaccagatagacaattggaagtgacctctgaaaccaacatttattggtagactccagtctacaatggatccaagagtgaagttaccaaaaacagttttaatttcagatttcggggtttggaggaatttccttttttaaaaaaattaagttatataaaaaaaattctaaaccaaccttttctttattttcagacaatagccaaagtactcatgagtaaaataacgtatatgccaaggaagtagttatttacatagttacaatgctctttcaaacaactagatttttttttttttttttttgcttagaatttaattaaaagaggaagaataattcttaagtattgcctgttctagttgtttaaagagaaatattttgtcacccattctggtgatgtagttatctggtcatagaagggacttgtatttctgccacttttgtctcctaatgtagagaaaatgatcattttccttattcagaagtataggttagccaagaaaggtaaaccattgtctgtttatgcctggattttttttttaatcagcttaggtgtatttttttttaccctagttatactaagcctattttcaggattaaatgaggtttctgagctaataggaatcaaagagagtaaggactttgaagttaggtacaccagagtttcagtaccactcagttggacaagttatataatttttttaagtcttggtttattctttttttaaaaaaataaggataaaaataactactattattgaacattatttactctctcacagaactcaaaccaccaattcagtgaggcaggtggcattgttatcttgcgaatagtgccatacagttaattcattgtttaattgttattgagtgcctactatttgcaaagtaaagatacagtgaggaataagacacaggcctcgccacaggaacacccacctaggtttgggcatatttaatatgaccacagattttctctccatgaacaattatttgattttgaatacctgtgctatcaaacatctttcatactgtctcaagtattgcataagacccattccagctctcattccttcttactcaagtgttcatttcttacgtttgtggactcttaacagaaaaactttcagagactaaaattggccatggccactgccagaaaacattttttgctcttaaagtttaaataaaaggctgtgctctgaaacacgagatgcacgtgcttaaagagcactgtaatacacatgaaaatagttccggcgtcaaacttgaaattgttcaaaaccgaagcaggtaaaaggtggcatgacaaacactgggcttcctagacttttgttttaaagtattaaatatgacttgaaactgactttattcacatactttgtacagtggagcattacccactgtgtttgtggttacagttagagtgaagtgacacaagtgacatgcttgttccagtgggtcggaagccccagaccttcacaaggcattgacccttttttccctgaagtttttggtgtcccaaaataacatctaagatatacccatgtacctacacttactcctttagctattctatcttttaaattatgttgcattcaaacatagttgttttttgacaatacctgaatgacaaacacacctgagaaattcctgccctttaaaaattctcaaagttactttttctctgcctcagatagaagggatctataaataactgattagaaacagtacaaaattgaagtttctcctggttgggttcaaaacagcttaatataggggctggtggctggatgcagtggctgacgcctataatcccagtactttgggaggccgaggcaggcggatcacttgaggtcagaagttcaagac

SEQ ID NO: 95703 - DNA, 1043 bp, Homo sapiens
atttttatgtattcttttaacacagaattattttttgtgtttcagagcagttttatttcaaaggataaaactgtctcttgaaatagtcatgtggtgctttgtctgtaataggttagaatattgccatccatagaagagtaaaaatgactgctgcttttaaataggcttaaattattgactttttatacaaccagcataggcgctgtcattagagcgtcagacctcttatattcagtctgaacatagtccaaatagtcaccatatttattagtttatttgaaccactctcaatttcaccatttgatttgctttcctaataggttctaaactctttgaagctcagttattttgttctgttttctcagcctatgaatttggcctcttgccaagttagttttgattacatttttgctttttcatttatgagctgccataaaagagattgttctgtcttatgctttactaatagttggttaaaggtttgacttaaaagacttggttggcccagagtcatacaagtgcatgtttgccattctgaactgaaatccctggcgacagtgctgtttataaaaggattagagcagggagttttgttgccctaaaatcaggaaaattaagttttattttatattatttaagtaattaaatgataagaaatttacacacaggtgtgtgtgtgtgtccatccttgtgcctcaattgcaaaatttcctgaaataatctccctgagctccatcgtggtgtttctcccaccaagcttttcttgtgattctgtcttgcacaccaccgttctttagaagtagtatttcttggaggtttgtgtttgagatggggactggatgctggctgtagcctctttgtggctccaaaggaaagaggagggaggattgtcctcaaagactcttacaagggtagagagggaggaagcaggctgggcaaagctcaaggaagtccatgcaataactgacctgtgtcaggttggggtctccttctagcaggatgtctgtagggggagggaagaaggactgcagggctctctggtg

SEQ ID NO: 95704 - DNA, 1088 bp, Homo sapiens
aagctttgaggttagctggagtccagtagaagagttataactaaacactggcccttgtctgtttccacttgtgcccattcattgaagctgagattggactgagtacatttgtgactatgtaccagtagcaaaggtgatagaagtcaaacatagctcttagttttaggggctcatggcctcctggggaagggacccatcaggcatagctggcagtcatggccagggttgtggaagcccaggtccaggcagggttcaaatgctcctcagagtgtgccagcagcctcagcctcagggagagcttgtcaggggatgttttacaaggtctccaaaagcctcttatgccctccagagtgaaaagcacggcattgttgatgaagtcttgtggcaaatatgcaaggcacgtgtggatatttctttctcttggaggcttacaaggtagccccggtctcctggtgcagtgtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagtagtgaccctggcgggccaggctgacgtgcgtgggaacagtgggagtgaccctggctgggaagcagggaggcctggatattgtttctcctggctctgtgtcctgccattctcgtccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattgtgagtgtctcctctcctggagtgccctcttccaggtccagcgttcttggctgtctgttcaggagccatcctgagctggcccatacaattttattgactggactttgggtgggagttttccagggtggtagggctccgaggggctcgcag

SEQ ID NO: 95705 - DNA, 1454 bp, Homo sapiens
gtaaatgttaatattaatgttgtcatgaaaaataactgttttccaaaatggaagaggcttagaggaaaggatggcattgcgttacatttttgcaaatcttgttaataaaagtttctcagatttgtttctgcattcaacctattacagtctattgttttagatgaaatatatgaagaaaacatggcctcccacagagatgtagttggaaaagaggacttttctgcctcctgaaagggtcatggtgacgctgacattttgaaaacgactgatttaggtgataatgatccaggacattctagaatattctttttgggcttttttagagtcccattaagattgttgaggtttggtgaatcttttgagagggtttagaattaacaacagagccatatatatgagcagcatcttacggtttccaaatagtttaaaatactttttcctcagaacaataatgagaacagcactgagaatgaccaggcagatgtggagcttaccgtgctccttcatccaggaatacctgtggactttggtcagaaagagggaagaagcacaaacccctccagagttttgtaaaactgccacaatcatctggcttacggcaaagctgggcgatgatgagaattttacagattttttccccaacctacagtaactttgaaatgacagaatggaaattcattttaacatgaggcttgggccaggtttactgagcagtgaagctgcttccctttctcccttccttccttttttttgtgacattttaattctgcattcaaacctgttaaataaagttgagctttgacgggtctgaagtgatgaacatggtgtgtctgcacgcagttatttatggcaaggctacaaaacaggatgactgttttgtgaaacattttggggagaaaggcaaagggaaagttgtcttccagaggtgtggaggggagtgaagcaagtaagtggaaccacttttgctaaggaaacagcaaaacttggaaaccaataggggcaaggcagttagttactctgtttatagaatggagactgtctacctgtctgtctcactagttggttgtgaaaattcaggagaacattggtaataacttcatgaagtacattgattaaatatctggaaggtcagaagctgtaccagggaactagacacacaggtgtagagctcatgctgtgggtaggcctgtgaaaataaacttgccaaaaattgaaggaccgcttggcatgggggaccttctccatttctaggacttttaagaaataaataggtcttcacgtgaaatcctcatctaattgtatgcctgtcaaagccatgttgcttttcttttcctttttcttttttgaaatggagttttgttcttgttgtccaggctggagtgcagtggcaagatcttggctcactgcaacctccgcctcccaggttcaagtgattctcctgcctcagcctccca

SEQ ID NO: 95706 - DNA, 2072 bp, Homo sapiens
atggcatttagttgacatgcattttagattctgttctcagaagggaaagaaactggccttgagatgttgacttttggatattttaattaagctacttattaagctataaacccaattccttgagagcagcttgtaactttcatctctgtctcaggtgcctaacacatagtaggcactcactcatagtatattcagcaagaagaatgccaaaaatgttagaaacagaatcaaagtgggacacccttacagagcctcagatgctacggtaaagaggctgaagagtccgagttcagagcatgtaaggaacaagcaagaaattgagctttttagataaaatagggtttttgtgatcagatagaatttgctgctcggttcttagtgttgtttgatcttcgatctaagaagtggctgacggtctgcaacctgctgttctttgcgtgttacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggtgagttgcactggacaaaagcagggaggtgccattccccgccctcccgcttcctgcccttctttcctgaggcctcctccttcatgttcagtttcatgatgaaagactgaagtgccacatgcatgccaggtatttgatagctgtgaggtcagaggtggcatctctatggcccatatgggcagtggcatgattgggacaccctcacagaccctgcatttgtattgctcagttcatcgtcctatttcagaacccagagtcccttatgacagagcctttcagacctaagcagctcagctccacatagaaaattctttctgagtcttcagccacactcaggccccccacacacctcacccactcctgtctctgtgtctttcccccttctcagaggaccactggacctgctctaaaggagagcgtgtggtgtacgtcaccccctccacaacttcccagcctcgagccaggagcgtccatgcatttattttctaagggaaaaaaaaataagtattttagggaactatactgtctacatttagctctcctgggtgtctatgttcttttctaaatatttgtttttcttgatcctcgggtgttagcatatggtctgcacttcctttgtagtgtatttggtattttcaacattaccgaaacccctttcttgttgttttttattgttttgttttgtttgagacaaagtctcattgtatagcccaggctagagtgtagtggcatgattatagctcattgcagccttgaactgctaagctcaagtgatcctccagcctcagcctcctgagtagctggggctacaggcacgtgccaccatgcccgactaattttatttttcatagaaacggagtctccctatgttgcccaggctggtctcaaactcctgggctcaggtgatcctcggcctcccaaagtgctaggattacaggtatgaaccaccatgtctggcctactgaaactcctttctcacagtaaacatgtattttgggggataatctagaaatgctgaccccaggctataaatgaaggtgagagtgaggtgtatgtgtgtgttagatcaaataggtaatttacttttaccaccttacttcttacatatttgtacgtaaatgcacatctatatatgataatatatgtatatagaattattttatagctggagatggctgctctttgatttcttcttttgcctagcagatttttatgtttccctgttatataaaccatgcttgagcaaggaaaggtagttgacaaagatcattggtaagtccattgtatgccactccggcagcattttcccatagaaacaaacatgagagtggggttcccaggccagcccacagaaaagctgtttaccccatcatgggtacatgaaatacagggctagcaagtatgtaataatgtcaacttggaaacagctttaagggtttgggttaaggaatgctattttattcact

SEQ ID NO: 95707 - DNA, 1035 bp, Homo sapiens
aaccacttaccagaacatatatctgaagaaatgagcaccagtatttctgtctcaactacagtttctctttttttttctttcttttctttttcttaagacagggtcttaccgtgttacccaggctggagtgcagtggcacaatcatggctcactgcagccttgacttcctgggctcaagcaatcctcccacctcagcctccctagtagctaggactacaggcacacactaccacagccagataattaaaaaaattttttttgcagaaacagggtcttgccctgttgcccaggctggtctcgaactcctgagctcaagtgattagatgccatttacccagggaaataccctttcaacccagaggccctaacgctaactatagtggttcctaaatctttgtgacatccagcattatctccagtaaaagaagtattttaatttttcccataagaaaatacttttgggagtgaagcggagccaacagttacaagagtgatttaagtccaggaagtattgcagagtgggatggactgaaccaaggactagggacctggtgtgcagctgattaaccctgacttagtacatgctcagggctgggttctttgttggtgcttcacatttctctctccttagtttggatttcacaaatgtgtcccttttttcccatcacaaaatgcattaacagtaaagacccatttttttaattttttatttttatttttattttttttgagacagagtttcactcttgttgcccaggatggagtgcaaatgtgcgatcttggctcaccgcaacctccaccttgcggcctcgagtgcttctcctgcctgaggctcccaagtagctgggattacaggcaggcgccaccatgcccagctaattttgcatttttattagagacggggtttctccatgttggtcaggctggtctcaaactcccgacctcaggtgatccgctcgcctcgttctcccaaagtgctgggattacaggagtgagccactatgcctggccaggaaagacccgtttatgatgagt

SEQ ID NO: 95708 - DNA, 1048 bp, Homo sapiens
acatggagaaaccccgtctctactgaaaatacaaaatagccgggcgtggtggcaggagcctgtaatcccagctacttgggaggctgaggcaggagaatcgcttgaacccgggaggcagaggttgcagtgagtcgagatggtgccattgcactccagcctggacaacaagagcgaaactgtctcaaaaaaaaaaaaaaaaaaaaaaagttcctctattgagaaaggcttcaacggtttttttcctcattgtttttccttaattactctctcagtaaataaagtgccatgcctgttacttaggatgttacttagtaacatcctttgtgtgttgctttcccacaggtgaattcatcattggccgagttatcaaagccatgaataacagctggcatccggagtgcttccgctgtgacctctgccaggaagttctggcagatatcgggtttgtcaagaatgctgggaggtaggtggattttcatccttgtcagatgtgggtggacaatgtgactgtgacaagatcatgtgtattctccatgtgggatgtaaggcagttctgtaggacactgaattgagggcatgggaactcagacactgcagtgtgttgactgagtgctgctgctgggagtggacccttgtgttgctgttcacagggcataactgctccatgcatggctgaactaccaatgggggatgtacctagatggagtttcttaaaaatcagtcatattagggttggaacacatttttcatgtggcttgattctgccccgtgaagcacaggagtgatttttttaagaaatggtttgtttaatttcttttcagagataagggaagcatatttctttttaaccattagaaagaacctaaaattttaaatttaagttttgactctgtttagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcggg

SEQ ID NO: 95709 - DNA, 1574 bp, Homo sapiens
aatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaacatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaa

SEQ ID NO: 95710 - DNA, 1026 bp, Homo sapiens
gtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataacctgttgtatattgtttattttgaatggtatatatgtgaaatacatatgaaaattgaagtattcatgaatatataatagaaacaagtaaatgaataaaatgacctggttactatagataagccaaattttgaaccatctagaacaatggtgtagtcttccctctactcaatgtaaatgctgggttttttaattattattattattaagaaggagatacagtccaggcacagtggctcacacctgtaatcccagcactttgggaggccgaggccagtggatcacttgaggtcaggagtttgagaccagcctggccaacacagtgaaacctcatctctattaaaaatacaaaaattaatagggcgtggtggtgtgcacctgtagtcccagctacttgggaggctgaggcagtagaatc

SEQ ID NO: 95711 - DNA, 1069 bp, Homo sapiens
gtatttttgtcaagacggggtttcaccatgttagccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcagcctttaaaaaaacttttaagtgaatgaaagtggcgtatttgaacatcaacttaggacagatttttactacttttgaaaaaatgttggaaaatatttctgtatgaaaagtaaaacaacttttaattttttttagaagtcaatgaaaggattctattttgcaaagctgtattatgaagctaaagaatatgatcttgctaaaaagtaagtacaaactgtaacatgtattttttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttcaaatactttttctaaaaattgtcttctgttggagtaaaagaggaccatgcctatatcttaatttgtttttggttagatatctgataccttaatcagatggaaaatagcaatgaataaaaaattaaaccgtaattgtaaggcaggagaatagcttgtataaaagatgtttaattgacacaatatgtgatgctctaaggctctatcctagggataagaagcttggtgattctgatttcctgacttggagtggattaaagcaggaaattaagagggagtcaggctttttttttttttttttaggcagtatctgtctctcttgctcaggctggagtgcagcagctggctccatctttgctcactgtaacctctgccttctgggctcaagagatcttcccacctcagcgccccaagtagctggggatacagatgcgcaccaccacacctggcta

SEQ ID NO: 95712 - DNA, 1583 bp, Homo sapiens
tgagatgatactgtcttcatttaaggtcaggaggtgatgacagtgctttgagatggtgatgaaggtaacagaacagtgggaggagaggggatgcgggattgagtcagatttaaggagatacagagcagtttgaacataaggaccttgttgctgaggattgactggggaggtctaggcttctggtggtgactcagatggacaggaatgtgtggcattagtcctggtagtctctgaagagagtatgagctactgcagtaatcacagatgcttttcttcacatacagttcttgaggcttagtttctgggttgtaagcaactctcagaagggatgaataaggtatataggatggtgtttttggtggcatcatcataaaactagacatagtggaatggtgctctttgggagcatgacttgtttaaaattgcacaagtgttactctaataatttttctttttcccctctaaataggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggtagataaaagctattgggtctttacatttctatgtaggcaattagcatacatctttttgtactaaagcagcagtgccccgcaggacttaaaatttcttttatttatgtagaacagttataaaatgaaatttttaccaggatcagttaaatttataatgggaagattggggagataactatgataaatgtatatatttttggtgttttataaggtcgatataaaaatcaatatagtttcacaaatgtggttggagtgagaaaaggaatttgtaggcttaaaatgattaatttcttaacatttgattaagttttgtaacttactgttcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactgcaaaggtacgttgactttgagaagaatgctttagtataaattgcagtttttctttttgcagtaagttcattgctctaaacttcttcactgaatcattatttgtataatgtacctaggagttatagttaatacagtgaacaactaggaggcaatcttatttttcttcttttacggggaagttctaattggttttatatgactttcctttttagagaactcttatagttcaagcttgattaaaattagccttatggttaaatactcagttttgtcatagtcaagcctaaaatgaatgttctaactgctatttcatattttattttttaaaatagtataatcttgagtgaaaattaaagttcatctgtcatcagatggctaggttcacatgtattagtataagc

SEQ ID NO: 95713 - DNA, 2466 bp, Homo sapiens
tttgcatttttgtgaatctttttaatgtctcgcttaatagaacatagctagattctcatttacttcctctttcagtctgtaaaactattacatgtcatgaagcctctagaaaactcagctcagcggggcgcggtggctcagccctgtaatcccagcactttgggaggccgaggcgggtggatcacgaagtcaggagatcgagaccatcccagctaacaatggtgaaaccttgtctctactaaaaatacaaaaaattagccgggtatgttggcacgcacttacagtcccagctgctcgggaggctgaggcagaagaatcgcttgaacctgggagtcagaggttgcagtaagccaagattgtgccactgcactccagccttgtgacagagtgagattctgtctccaaaaacaaaaacaaaaaaactcagctctacatacatgagaaaatgagtatgtaaaatataaatttttttttggtattatcgtaaaagtaattttaacttcatggatcccctgaaggggtttttgagcaccctcagagatctttagacctcacttgctctggttgctttattgtaagccactttaaaatcatgcttcacgtttaagtgtttgctttttgcttttacttttcttccaaagtgaggatttggagaaacaataggatttagaagaactaatttagaatatagattacaaataataggccaggcgtagtggctcatgcctgtaatcccagcacattggtaaactgaggtgggtggattgtgaggtcaggagttgaagaccagcctggccaacgtagtgaaaccctgtctctactagaaatataaaaaaagtttagcggggcatggtggcaggtgcctgtaatcccagctactcagaaggctgagtcaggagaatcacttgaacctgggaggtggaggttgcagtgagcttagatcgtgccattgcactccagcccaggcgatagtgagagactccgtctcaaaaaaaaaaaaggcagactattttaaacgctgtaatgatctatatagtaaaaagagcaattactgtattgatacgcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactgatcttatatttatcctgtgattggagggctggaaataactgggaatatcatttgagaggttaagcatgaagtataggaagtatgcaggataaaaaaaagcattagatgattcataatttataacatggggaataagaattattagttgaatgtggaagatgaagcttgaaataaaatttttattttgttttgaattaaataaaccatgattattcacagtgcagtaagtgtgtattatctgtttgatattttcatattacagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggtaagtcttccacttgtaggagcaattgacatttcactgagtcttgatgtgtttgaaatgaaggtgtgctctggtatgtaatgacaatatgtgaacaaacctgtggaattaaagttgaaatagtcaatttgatacagtggaaaataactaagcatacacaatactggtgaggctggtgaaacagggatgttgaatgcactcttgttgaaagcctgcattgccatgatttgtttgtagacaaatttgaagagtttgatctttttactctgccatttttgggaacatgataaagatgtaatctcgtattatgggtaaagcttgattcagaaagatgtgttacttggacaaaatcttaataagtagatgtagggcaatggctttatagcctatgatagaagaatatgattgcaatttaacatgttaattgaaacacatgtatataacatttatgactgtattgtgtatatgtaacagtatatctattaatctttgaaaacataaaaccttttcttaatttttatttttttattttttttgagaccaagtctctctgtcaccaggctggagtgcagtggcgtgatctcggctcactgcagcctccacctcctgggttcaagtgattctcctgcctcagtctcccgagtagctgggactacaggcccgtgctaccacacccagctaattttttgtatttttaatagagatggcgtttcaccatgttggccaggatggtcgccatctcttgacctcgtgatctgcctgccttggtctcccaaagtgctgg

SEQ ID NO: 95714 - DNA, 1039 bp, Homo sapiens
gcgtgatctcggctcactgcaagctccacctcctgggttcatgccattctcctccctcagcctccccagtagctgggactacaggcgccagccaccagggccggctaattttttttttttttttttttgtatttttagtagagatggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagtttgtccctgttctcctatggccacttaaatccagaccttttcatctgaaatgcaaatatgtttggcatttttcatacacattcctgtcttttttcccccttctgctgtcttatgtagatactgagaatattaaacctgtactcttctcatttgctacataagcaccggttttgttgtccagctgtattttttgggttggagggttaggtatgcagtaatcatgttatttcccctttgggtatacaaatgagacaacgtgagcaaatacaatctgtaattttaaagtgatggaaataacttaaatttttttttcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtaagttatatgtttcagaggaaatggtctccgtcttaattcttataaattgcccataatcttattacccagaaataacgacttaatattttcctgtattccttttgtgtgtgggttgggctggggggagtttgaatgtggtgctgtgggggtggcatgtattttttgttgttgtt

SEQ ID NO: 95715 - DNA, 1614 bp, Homo sapiens
tggtctcgaactcctgactgcgcagaaccttttcaatattgactttcttgtagaaaaacagatttctttactgtaccgatggattaatatagtggtgttccattgctttaatgacttaaaggaaaacccatcgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattcccttcagctttgatatagaaaagcagttatataattaagatatatataatgtgaattgtttatgttggcaaaactaatggcacaaggaaaaatttcaaacccttaagccaattttttaattttatttcaggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtaagcaaagattttaacaaattaaatattctgaattttgtttaattttttttctaacttaacttttccttaaataaaacaggtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagccctgaactgtgtatttagaaagcaattttagtaaattgaactattttttagacctggaaacgtagcaaaattgagacttctagttcagcatgaaataaacactctaagagcccaggaaaaacatggccttcaacctgctctgcttgtacattgggcagaatgccttcagaaaacggtgagttttaaagtataagcatttttaaagaacattaccttaattttttaaaatcatgaactttttattgaaagtttttttgttctgaaaacagcagcttggtcacattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctatatacttaaggtgtgttttgtgtcaccatgaggtgtagatggtcagccttttgaacaaactgacactacagaagaggcaggtttcagctatctaaaaat

SEQ ID NO: 95716 - DNA, 2897 bp, Homo sapiens
cctggctaacacggtgaaaccccgtctctactaaaaatacaaaaaaaaaaaaaaaaaaagaaaaaattagccgggcgtggtggcaggcatctgtagtcccagctacttgggaggctgaggcaagagaatggtgtgaacccaggaggcggagcttgcagtgagccgagatcacgccactgcactccagcctgggctacagagcaagactctgtctcaaaaaaaaaaaaaagttgagtgtagaatgatcactggtgttaaggtggtttagttattacagtatttggaagttgaacaaatgactattgagataccatttggttttgacttgaaattttagccagttctttcaacttgtaaatgaactttagatctaatcatgcgtgttccttaaagttgtgtgcttttaactttcttttttagggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggtaacagagttcctttatgaatttattggagatgggaatttccagtttataaacaaagacatagagctatacactgcttaaattaattgccttgttatttaatggtaatcttgttttctaaattcactagctctcacacataagatatgacagagaagaataatgagatgtttgtctcttaagatcatataaaatctttggaaaatcatttgggttttatattctgagtataaacaatttgactaaaaactattctgtgtgtttaggcatcagaaattgttgaatatgaagaagacgcacacataacttttgctatattggatgcagtaaatggaaatatagaagatgctgtgactgcttttgaatctataaaaagtgttgtttcttattggaatcttgcactggtaagtagatgcagtacttgagctaaaagttttatttatttatttattatttttttaaaagacggggtttctctgttggtcgggctagagtgcagtggcacaatcttggctcactgcaacctctgcttcccaggctcaagcgattcttgtgcctcagctcccgagtagctgggattacaggcatgagccaccatgcgtggccaagctaaaagttttttgttttaaaaacctaatgatttcataaaagcactatttgtatagatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcaatgtttttgcgttggtcttatattttggtaatttcaaaaatactcagtaatatgttgttattaatgcacagaagggatatgtgtgtctaaatgcttatatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcctcatcagccattgtgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatataataaaggcaaaaaataataataatacaaaacaacagaaaaagaaaaaagataattaaaaaacactttcacgtgtattatttaaagtgtaaagtgcctattaaagtggcaaaaatgtaaataagataaaatatatcattttagagtttttacttttggaattttttgcaaatgaaagcccttaattaatgtcttttatttttagttgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaaggtaaacaggaaagaatggaatcatttcattgtgaaattgtttctgttctaagtgttttaaatgctgttttgttatttttatttttttttagtattctcccaaaacaccacctcgatgggcagaagatcagaattctttactgaaaatgatttgccaacaagtagaggccattaaggtaagtcacttaatttctctagctgtactttttattccaagattccttccctggccactctctcactttttttctgaagctggtcagaatgtccccttgccatccaaatagtatggcaaggggacattttggtctttttttttttttttaagacagggtcttgttctgttgtgcaggctggagtacagtggtatgatcacagcttactgtggctt

SEQ ID NO: 95717 - DNA, 1894 bp, Homo sapiens
gggcgtggtgggtcacacctataatcccagcactttgggaggctgaggtggtgggtcacttgaggtcaggagttcaagactagcctggcaaacatggtgaaaccccatctctactattacacaaaaaattagccaggcgtgctggctgacgcctgtaatccgagctactcagggcgctgaagtgggagaattgcttgagcccaggaggtggaggttgcggtgagccaagattgtgccattgcactccagcctggacgacagatcgagacaccatctcaaaaaaaaaaaaaaaaatcagttatttaaatttaaaagagtaagtttccccagcactgtttctgtcatgatataattaaatgtttaaaattatttgatttttttttcttccaatagaaagaaatgcaggagttgaaactaaatagcagtaactcagcatcccctcatcgttggcccacagagaattatggaccagactcagtgcctgatggatatcaggggtcacagacatttcatggggctccactaacaggtgagctggcaagtggataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttaatgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatactgggtttttaagttctgctctatcacttactataatagctgtgtaagataacctgtctgaaacgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaattttatttaattacagtaacttagaatggccggtaccattattaatcccttttttataaataaggaaattaaagaaaggttaggtaacttactcattattatacagctagttattgatagagctgagattcacactccggtggtgtaactccaaagcacttgccagtataatacattgctcccaggcagcgagaaataacaaaattgttccttttacgtacgacagacttctgaaatggtagtagtagtagtgccctttttttttctctttttagcccaggaaagatttagaataaaatctagtttagatgagcacatttgtgtgatggttcatatagttaaggcaaccccactagccttttgtgatagtatcttctcaacacaagcaaaataacagaaaatctttgtgaaatcaagcttattaaatgtcataagtcatagataagtatatgaaatgtctaacgttcaaaccttgttttcttaaaaccttacacatcatataggtccttgtaagaggataaacaaaccggctagcctttcctggggcttttttagtgatgtgtgcagtcagttatttggtgccttgtgggtcatgatttccatttcttctgtgtacaggcataaaagatcttctgttcttatacaagcatgtaaatccaacattctcattgtctcattt

SEQ ID NO: 95718 - DNA, 1401 bp, Homo sapiens
aaaatcaaacttgggcttctggctagccttttctaggtcttgatttttcagtgctttccagaggcaattgtttggaacctcttggcacagtttctgtttctttttccatgtacaggcataaaaggtcttttggttgttttctggtaaaactatcataaaacagttcaagcaaatgactattggtagttttgccattaacatgggtgccttctagtcattttgtttcctggtaaaacacacaaaacagagggagcagacagtttgtacatcagcatgagtgttgatgtgctttttattttaagccagggaacacattttatgttatttatgacatcctgtccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttcttctttattccttttttaatgcttgtgaggtagttgttcttgttgatcacagcaatgctattctcttattcttcatgtcatatttagcagtttttttctagtttgtcatttgataatcttgattggtgtattttgatgtacagaaatttaaaatttatgtagttaaatctttctttaatttctattgcctttgtatttatagctcttgcctagatagtcttaactgtagtatagactttaacagtgttttctttattttctttttgtttttttagttgcaactactggcccttcagtatattatagtcagtcaccagcatataattcccagtatcttctcagaccagcagctaatgttactcccacaaaggtaacaaaggaataatttatacatttataattatttcctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgctcttctgcttattttgaccacaggcaagtttcttaacctctcaatgcatcagttgcctcatatgta

SEQ ID NO: 95719 - DNA, 6658 bp, Homo sapiens
caaaatgttttaactttctgtcttttagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaagggtaagtactttgttgttaaagttaagcacaatttttctttcttttaatgtttagcttgatgcagactctttgtaggatactaatgttgggatataaatgatgctttgtgaacacccccaaaatatttgagcaattttttttctcccttaataagttcacggtgaggtttcaaagagcaagagaacttagtttaagacatttcagtaactggaagatacttttatcatgctagggcagagcaaaagaactcggtacggtatacggactcatgcttgaatcatgcacattaacgtgagtctttttttaaagtgttcattttcatttgttcagtttcttttgtcactcagaaaacatgatattgaggctgggcacggtggctcactcctagaatgccagcactttgggaggttgaggtgggcagatcacttgagctcaagagttcgagaccagcctggccagcatggtgaaaccctgtttctactgaaaatacaaaaatgagccgggcgtcgtggtgcgtgcctataattagcagctacttaggaggctgaggcaggaggatcacttgagcacaggagatggaggtagcagtgagctgaaatcatgccactgcactccagcctgactgagtgactgagactttgtctccaaaaaaaaaaaaacaacgtgatattgagatgttctcattttatatgttgtatgtcagtcttgctcatgtattaaatgagcaaagaatgaaactacagggataaatgaatatgtaagacaatcagattggtggtataaattgagggattctggctttttatgttttaaaagcatattcattttgtttcctaaaatgttaaaaaacgaaatattctttattttctaggatttaattttagcctttttaaatctaatcccatggccttttggactagcaccccttcctcacagcctgagagcaaaggtatagaactagcattctcagtatgagataacagcagtttttagcagctgggtagcccttagcaaagtattaataactgtggctgtatgaaatgaagtacttaccactacaacatgcatgttaaagaatgccagtttaagcaaagtaccttttgactggtggcatgacacccttgttggtttgttttttaaaatgtactgggatgctgatttgtaatgtacttcattgctctgctatttcaggtctgctcaatgaagacctatgttttatctaatgtttatgtttagccactaacgtctgccagtattcaaatgtagtggcaacggcatgtatacaatatggaagagtgtccctgtagggctgttcttttgtgcatggtttagaaaaatgttgtatttgaaaatggaccccgtttttaacagccagcattctacagcttgcatattatatatgttgcaccgatcaattttagaagtgtggctactagagtggaacaagaagtgggatctgttgaaggccttcaagaaca

SEQ ID NO: 95720 - DNA, 1043 bp, Homo sapiens
aatcccttgaaattggggtcttttttgccaaactgaaatccttctcctgaagttgattttgcaagatctgcaaatgtaaaagtgctacttgtttggccaaaaatcacaccacggccattcttctggccactaatatcctgagcctggaagccagtaccattttcaagaggcttttcacttttcttttcttgatttcctggttccgaaatgccaaatttaaatccatcagcagacacagggatggaaaatccttctttggttgacttaaattctgtattagaagaaccctgaaacataaatgaaggtgaattttcttgatccacatgcccaaatttgaatccttgctctgtattgccaaacttagaagctttttctgagaaattacttttaaatcctgttcccacctgacttccagaagagtcatgcaacttcatttctgagcccagtgtgaaagctgaaggagcttctgcaataggtttatgagttggtttagaggcatcacaagccacacattttaaggaagaactctcattttgtacacagcaaacactacaatcccactgtcctttcctgatgaacattccttcaaatccactctttggagccttgcttatctccgaagaggcaggtgttgaaattgcagttgtttgattttgtttacttggacactgacaagcaatacatttggtagcactggcttcatttcttactaagcacacactgcaatcccactgtccttccttcttagtgaacattccctcaaatccgctctttggagccttgcttgtctctgaagaggcaggtgttgaaactgcagaagtagtttgattttgtttacctggattctgacaagcaatacatttggtagcactggcttcatttcttactaagcacacactgcaatcccactgtccctccttcttagtgaacattccctcaaatccgctctttggagccttgcttgtctctgaagaggcaggtgttgaaactgcagaagtagtttgattttgtttacctggattctgacaagcaatacatttggt

SEQ ID NO: 95721 - DNA, 2434 bp, Homo sapiens
tagccatatgaatggtcttagattttatagtgttagctacctatagagtcacagttgttatttaattttacttagtatcatgcttgaacataggcaaactagatgcaactctagtcaccttccattcttggcaattgttaactttccttacagaaactaatcacagttggctttggattagtttcatatgtatagtaatacttgcctatgttttaagatttttttcaattgctgcaaatgcatggatattttggtaaactattgtatgctaagtatagttaggcaacactttaaaatttttaacctttataaattctagaaatttatagtaattcttttcaatgactattaagtaaacacaaatttttttttgttttctttggttttaaatagattctgtgttcacttagggtttttggtagaacactaaatcaggatgctaattctagttcatgattatcatacatctctgcatcaaagtatatgtgttttttatcagtatgctgttttaacctatagataggttccatggtttttattttcagttagagtattaacgtcaatacttaataccttatctttgtcaatttttttgactggtgttacagcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatggtaaaacttttgttatttcaaaaatcctctgttcccgctaatcttagtaaaattgggagtatggtttaattattttaagcctgcctcttagaacttatcactaatatccttgcaggtagatatttaccctaaatgtatgtgtaaatggtcaatggatatagtgatcaaaaggactgcaatcattaagcaagcattttttggatggctaatgtgccaggcacgtgttttgaggggatttaaaataattataattttgctggagtcttaaagatgtggaagagagagagaaggcggacaaggttccagtggaaaactttgtatgcagtaacagtttttaagctggacagttaaataaaagtctcaatagaatcagttggacagtggtatatagtattgggttatgggacaaggagatcggaagatgaactaaaatgagagcagctcaaacaagatgagaggctgagctaaagctctagcagaaagagaggtattaaagatataaaattggctgcaattcagatgtggagagtgagaaatggtgaagttggaggtagtccctaagcaaggaaaaccccccaaaattaactagaaattcttttaatcaattgtattttaagatgaagatttcgaaacagctgtcaagaaacttaatggaaaactatatttggatggctcagaaaaatgtagacccttggaagaaaatacagcaggtatgttaagtgtaaaggacatttataatgcttttaacaagtcttctatttagaaggaataacctagtctgataatttctataattatcgattttacgatgcccatggtgatttaaaaaacttaaaactaacaggtgaaaatattcttttctgggtggtccttgtttttcattagtatgtacaggtcttgttacctgggtctgtggattatgttgatgactaccattgttgtagagaagttgggcttcatctaatttcgtttgcttgtgttgtactgatttttcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaggactttcaatcagagcttcaaaaagttcaggaagctcaagtaagaacatctctaataaattttccttctagttccattgcctttgttgatgcagtaaactttagaatgttcttatttatttatttttgagacagaattttactcttgttgcccaggctggagtgcaatggcatgctcgtggctcaatgcagccttcatctcccaggttcaagtgaatctccttcctcagcctcccgagtagttgggattacaggtgcctgccaccacgcctggctaatttttgtatttttagtagagacgggatttcgccatgttgggccaggctggtctcgaactccggacctcaggtgatgcgcctgacctagaatgttcttaccaaataataataatgggttgtggctactaaatgggtttaagggtctagactaatcagctatggccaggaaagaaggaattttaattttgttctacacaggggctatatgccaaaagctacaaaacactgatgaaataaaaaat

SEQ ID NO: 95722 - DNA, 2087 bp, Homo sapiens
tcttattgatttctagtttaattcctttatggtttatgaaaatattttgaataatttcagttctcttaaatgttgtgaggtctgtcttggtgaatgtcttctgtgcacttgagaagaaagtagagtctctttttttgctgacattgtgccattggcagttccagtttttttgggctgctgtagcacccaggctgggttacaggagtggcagaaaaactccgtgtggatcttaacctccagattatctctctggtcccaagatccttattcttcctgtttttatccacctttctaaggcttcttagaggtgctctgtatgtttcagtgtaggcatttagttataggttttgaggagagatagggtgaagtgtgtttattctatcttctccagaagcccaagttctcaattccctttgaaatagattatataatctgttttgtaaattagcatttaagtggcatagtattttgtgacttcctctttgcagaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggtaaatcttgatatatgtttatcatgtgttacataagggacaccttatatttgagaagatagacttttaaaggctgatcctgaaaactccctttaaaacacattttgatatgtataaaggggcatcttagtagtagtagtaataataaccagaaaaattatactgtgttgccaacaaataaacatgtttttattgatagagttgtggttattagggaatacaaagcattatgattctgacctattttcctgagtttaaaagacaatagtgttgttacatgtaatttcctttgtgatagtgttttcatttaaatattgtttgaattatattatcactcaagcatattcaaagtgttttaattatgaaggaattgtagaaatattacggatttaagaaagttttatggtactacttaaatgtttcttattttctctaatacttttaaagcttgttaaattaattattcagttacagtaacatatttggtattgctttctctctttttcatttcgattttggggatggaagtgggaagtttaagttgtattgctttgtgtaccttacctactttttaaaaatagccttcagtgtcacaaatattacatttataggcatttgagagtcttaatgtgctaaaagaggaagacgacttcatacctaaaacctcatacattttcatatgaggaaaataaggcatggggctttcagagatcatgcagcttcacattagcagaattaagagaagaccgcaaaagtccttatgacgaagtgtaaatgagacatttggtttttatgagcttatttatagtacagaacacaaaaagtttttatacagatgtttcctaaaaccctgcctttgactgaatgcttgctttagagtatagtaggctccatagagcagaaactgtagtttaatatctggcttaatatagatagctctccttctcatttataaaaaataatttttggcatgcatttggtgtagtattgtagtattctttgtgaatagcacctgtaaaattagtaatactgaagtagctcagaattggatgtattttgtaacttgacagaatttaaataactcccctcatcccagagtatacaagtctctactgttctctctaggtcctggggtaaagctttgatattcagcacaaattaaatagtaaattgttctttttttcttttgccaggggaaagcaagatagtttcatttggatttggaagtagcacagggctctcatttgcagacttggcttccagtaattctggagattttgcttttggttctaaaggtaagatcaagaggagagacttttaatgacattgttacagaatcaagcacaactgaaaaactagttttttgttgcagtatataactaagttagaagttt

SEQ ID NO: 95723 - DNA, 4226 bp, Homo sapiens
tcctgggttcaagcgattctcctgccccagcctcccgagtagctgggattacaggcatatgccaccatgcctggttaattttgtatttttagtagagacggggtttctccatgttggtcaggctggtcttgaactcctgacctcaggagatgcgctcacctcggcctcacaaagtgctgggattacaggcgtgagccactgcgcccagcctaatttttgtattattagtagagatggggtttcaccatgttggccaggctggtctcgaacccctgacctcaggtgacctcggcctcccaaagtgctgggattacaggcgtgaggaatttactagaataatataattttaaacatttaaaattgatgtacatattacatcatcaggaattagagggattgataaaataagagggggatgaaaaatgtaaaaaatagatactagtgtttaaatatcctgatttattcatcagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtaaatgttaaggaattaaccttttactaataacttatttttcatttttaagttttaccctggcttgatctgtcagggtataattgtttgcatttaagaatgtttactgtttgaaatggaagctctatttattagatgtctagcctttaagtataaattatctttttacagtttttacataaatattggtttgtaaattctatatgtaattattggtaagaaataattttttcttatgtttctagaatatcatgtttgtttttataacatgattctggggaaaaattaacctcatactcactaaagtcctttcaataaatgttaaccttgtatgttttttggacaagaacattgttctaggaaaattactttgtcattttttaacctcagtcagtagctaatatttctcttcagtagcaaacacttttgaaacctctctgtcctataaagaaaagcatttaatttccaaagggaaaatgaatattatataaaagaaaatgtttaatgataaatcaggtctttactccctcagccaaatcagatatattcctagccctaagatatataaccagttatcacattaacaaattctctttgtcatcacaaagaaaatgccttaaaagaatttggatctttgaaatttgtcatggaatttattataagcagcagcttatagagaatttcatctcctattataggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctggtgagtttttacattcaaatgctacttttcattttttggacttttctaaaatctataacaaacaaaacaacttataacagttattttaatactaaggtcactgcttcccctttccctccctgccagatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaagtaggtattattaagtacataccacaattgaggtcttgaagagtgcaccacactaatgggaaatttgagtgtttttccttgacctcatcctgtagttttgttaaagatttctttaggttttccacacatggaatcacatggcatcactacccattccctgctcctgcctaaaactttcaacctaaaataattgaggctgggcacaatgactcatacctgtaattccagcactttaggaggccaaggcaggcagattgcttgagccccggaatttgagaccagcctgggtaacatggcaaaaatctcgtctggacaaaaaaatacaaaaattagccaggtgtggtggtgtgcgtctgtgatcccagctacaaggaagctgaggtgggagcatccaggaggccaaggctgcagtgagctaggtttgcaccactgcactccatcctgggcgacagagtgagacagcctgtcattaaaaaaaaaaaaaaaaaaaaaaaaaaaaatcaaattttcagtacttgagatctagtagaaactaagggatgggaaaaaccttttcatttttcatcttctttccaacaatatgaatttcttagttttcaaactatactcaggaaagctgggctttaggatttaacatgtagtgatgagttctgtgtgtattttaatattttactcaggattcctattaattgaaaaaaatttttaacttttttattataaatctttttttcagggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatc

SEQ ID NO: 95724 - DNA, 1027 bp, Homo sapiens
tccttcaatagtttgaggtctattgcttttaacaagattagtattattccattttaatacgtcaggagtacataaacacaagtacacctgaaatacaccagtgtttaaacttttatttcacaccatgcaaggtcaattataacacattaaaaagtgacaacagctataagctgcaattttacatttgtaaatcggaaacgtccattttcaaaagctgaacataactatcaaattgtaatagctaagcttcaatccaactgcttatacagatgaaattttctatgaacaacaatgattttatatctgtccacattctgtgatagttattcttcgacaaacagaccctttgggagaaccaaatgattcaatctttttcacagtatccatgccatccttaacaaacccaaatactacatgcttaaagtccaaatgttctgctttcttcagtgttataacaaattgagaattattggtattctggccttgattggccatggatagtaaaccaggaccagtatgtttcacatcaaaattttcatcttcaaatttgtctccataaatggactgtccgcctgttccatcatgtttggtgatatctcctccctgaaaaaaagatttataataaaaaagttaaaaatttttttcaattaataggaatcctgagtaaaatattaaaatacacacagaactcatcactacatgttaaatcctaaagcccagctttcctgagtatagtttgaaaactaagaaattcatattgttggaaagaagatgaaaaatgaaaaggtttttcccatcccttagtttctactagatctcaagtactgaaaatttgatttttttttttttttttttttttttttttaatgacaggctgtctcactctgtcgcccaggatggagtgcagtggtgcaaacctagctcactgcagccttggcctcctggatgctcccacctcagcttccttgtagctgggatcacagacgcacaccaccacacctggctaatttttgtatttttttgtcca

SEQ ID NO: 95725 - DNA, 1050 bp, Homo sapiens
aaaagcaggcatcaaaaattttagctgctttatgaggacaagaaattagttggttttatgaaagatttctttcatttctcaaaggtaatgtaaattatacactttataaagccataaatagcttatctcttgaagagtatcagaaattctttactgttttattattccatgatgtcaaagaaaatatttccatgagtttgtgtgagtggatttttctgagcagaagcagaaaatagactcattgctactttgtaaatgctaatatgttttaataagtatgttgtaaatgcctttgatgttttgttgttatcttggtagattgcatggtttttataaattacttgccacactagtcacttgtgcttgcatacactgattaaagtttttgtgattgaaggagttcttacttgtaattaattcacgttccatagtattagtgatatacagtccttacaagttttagatgagagttttttttttctcctcctagcagcatgatgcagaagttgaacacttaaccgaagttcttaaggaaaagaataaagaaaccaagagactgaggtcctcttttgatgcattgaaagaattgaatgataccttaaaaaaacaggtaagacctgttttaatatatactgaacataagacattctaagaagtatattttatatataacaaattaaagtcagccttagaacacgtttcagctagagaaaatttggattacatttgttagctttattttaaaatacttccaaatgtaaataaagtattctttagctctttggtctcttctctttatttgttctggcaaccaactgacaaacaaaagaaaaaaacctgataacctgagaactgattacatttttaggtactgatctctggctttaatacttattatttatcactacttatttaacattcatttatttttgagtatctattatatcctaggcatcatgctagactcagaccttcacattgctcatgttctcatggttataaactggtatcacattgcagtatacttatttatataagtattgcaggcca

SEQ ID NO: 95726 - DNA, 1045 bp, Homo sapiens
tggagtcttgctcttttgcccagattggtgtgcagtggtgcgatctcggctcactgcagcctccacctcctggttcaggtgattctcctccctcagccttccgagtagctgggattacaggcatgcaccaccatgcccagctaattttatttttagtaaagacaggttttgccatgttggacaggctggtctcgaactcctagggaacttcaggtgatccacccacctcagcctcccaaagtggtgggattacaggcttgagccactgcgccaggcaggttggggaggtttgatttggaattcttttgtttgtttggagaagctctgtccttaacacattttagtgaattactttagtcaaattattcttattacttaacaaatttaaggtttgtctttgaagttttatgaagttgtgaactgaaataaatgatttaatttttgacatataggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaaggtttgttttttaatttgaaatatgtgattcagaatatatgaagattaaaaaaggaaaagccagggccaggcacagtggctcacgtctataatcccatcactttgggagttcgagctgggcagatcacctgaggtcaggagtttaagaccagcctgggcaacgtggtgcaaccccgtctctactaaaaatacaaaaaataggtgggcattttggcacgtgcctgtaatctcagctacttgggaggctgaggcaggagaaacgcttgaatctgggaggtggaggttgcagtgagccaagattgcagcactgcactccagcctgggcaacagagcaagactctgtttcaaaagaaaaaaacaaaaaacaaatttgaggggctgcctctgatgaggcccttcttcctggtctcctgcagagtccagaggtga

SEQ ID NO: 95727 - DNA, 1065 bp, Homo sapiens
atgtacagtcacaaataattttttaagttgataaaattgtcactttccaattttacatattttcaactttaaattagccacagatttcacttacttttaatacatatatttgatttaatatttaaaatagttattggccaggcacagtggctcatgatcctgtaatcccagcattttgggaggtcaaggtaggaggatcacttgagcccaagagttcgagaccagcctcagcaacttagtgagacccatctctaccgaaaaaaaaaaaaaacctgagtgtggtagtgagtgcctgtagtcccagcttcttgggaggctgaggtaggaggattgcttgagcccaggagtttgaggctgcagtgagccatgattgcgctactgcattccaacctgggcaacagagcaagactgtgtctcaaaaaaaaagatatattctgaacatgaataaatatactaagattgtacatatttttaacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaaggtaagctttcaattgtacttatggttaattttgagaaacaatagagaatatcatatattaaagcaattcttttatcaaatatgttgtacattttcagaatgaggttttgaattgttttataatggttacacattataaaaagctacttttatttgctgaatttgagaaattgaagtctttagttggattcttgcctcctcccaagaggcctttgattgtcttaggtcatattcccataacaacctttgcctacatctatttgtatttgtcacatcaaattgaaattgctagttaattattttccactagcgaatgtgttggtaaactagtccatgggcaaaatctggcctaccacctgttttgtaaatgaagttttctcccacaaccatgctca

SEQ ID NO: 95728 - DNA, 1042 bp, Homo sapiens
cttctgcaaaaggcctatgtgctctacacgtggttaatagccagtctatgcaatatgattgatgttaaaggtaacatctcctctgtgtccccaaactaatcagtgccccatcttagactatcaacacctacacagtctggccccaggggtatcagttttccacttggtactatcactgctgtaaacaacttcatgggctgagaagcccttactttcataacccccaccttccatccggggctgctgtgaactggacaaccctaaagcatcctgacaaccagactcctgttgggcaggcggtatctggctggtgtgagccatttacatcagttgtattgaagggatcaatgctatgctgggacccatccttggtgctcattttagtcgacttcatccaggtggaaagatgcaaccacaccccccggagcccaggtttctgcggattcctctcttttgtctcccttctgtgcagtttctggctccatttttatttgttcaggctgtttcagtgacccttcctcactcttcccctctgtgggccgtgcgcattcctggcaaccagtgctctgtcggcttttgcagttgccactggctggctttctggaggcagcctctcgtctctgcctgggtccctcttcctccaacttgctcagtgatgagtggggctcagagcctcactcacaggctgccctccgcaccgcgccaagctcatgggaggggctcgagacctctgcagcacctaggcacatgcctgcctttcccagtgaccaggcccagcccagagctgagcccacagctgcagagatcaccagtccccaggctgaccaattctttacaggtgtaggctgaagctccaacccactgcacttttctctatcgtgaaatcggatgtgaatttagggtgcagatcccaggaagagtgatgacgcctggggataacagtgtgtcttgacagaagagttaggacccaaagccagcatctcccaggagaaagcaaaatagtcattttctagaccccggggaacaagtctcctgacagtat

SEQ ID NO: 95729 - DNA, 1048 bp, Homo sapiens
ttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcctggccgcaaatattcttaagcttggagacttcacgattccacagtgagtaactggaatcgccatcctgtgtgcagtcggcagctcaggataagaatgaaacttcttaataatggctctgcttccctccaaacaatgtgttttccatgatctctctggtctattaccaactatttgtggttggaccaagtatgaatgaaagaatgcacttagagtttgatagatgggctaggactggtttcagttttgtgatctggatatgtttttgcttcttgatgtccttcccttccccctacatcctctccagggctttagtttgtttgttacaatgagattctacatgatttttgtatttataaatttgcttctaaggtgaaccccactggctgtgggggatggaggaggcctactcttctcttgtgtctgttaaatccttaaggaattatttttggtccaggaaaactctgatgcctctctcttttttttttcttttactttttttaaagagttggggccttgctctgttgcccaggctgaagtgcagtaacatgactgatcataactcactgcggcctcggcctcctgggctcaagtgatcctcccacctcagcctccctgagtagctaggactacagcacaggctgcaacccctggctaatttttaaaaattttgttagagatggggtcttgctgtgttgctcaggctggttccaaactcttggcctcaagcagttctcctgcctcagcttcctgagtagctgggac

SEQ ID NO: 95730 - DNA, 1038 bp, Homo sapiens
agcccagccatcatgtgaggaagcccaagaagccctgtggagaagggcaaaggctcccagtaacagttacagctaagctccatgtgattgagctttcttggaagtggagccaccagcaccaaccgacccacctgcagcagagctgttcccaccaagctctgttcaagttgcatatttgtaagcagtcatttgactttactgttttaatacactaagtttggagcaagtttgttatgtaacaatagataaccagaatactgttttttctgtaatcctgtactgttgctgtgggaatatgccagtgtctaatttccttgtcagaggaagtgaggtcaagggaatcttgccctagaaatacatgtgttgagcagatgtctcaagcatgagatacttaagcatctccaggaaaaggcaaattcaggttcattctctcttactggcctgctagagaagatccttaaagagggccagtgtgggcatctggagaaggactgtaggatccaggccatcagacagaggtgtctttggccatgggcaggtggggttcatgttcacagaggcccgacatcaacacggacatatggacccagagtggcagtgctggccccagcacctgtagacccacaccaactttccgtggcagccagtaccttaaacaaaacccacaaatgttgcccaactttttctactgttgccactgggaagtgggtccaaaccctctgtgctgtggtctgcctgggcatcatagttgtgtacctgaggctggtggtctcatatgccgtggcatcaacacctgtttatgggctgtaggaaaactgagaggtcatcacattcagagattcccttgtgccaggtcctgcgcgggtgattttggtgaccatgactgagttttcttggctccagtggtgtgctggcaaacgtttaacagttggcttcctaggaagatgccctgagtgatagtgtttgtccatttccagggtgtaaacactcccacctggccgattccaagctgcttatgtgatgccatgggttgggaga

SEQ ID NO: 95731 - DNA, 1148 bp, Homo sapiens
gatgaggggggaggcaggtctccaaggggaccctgagacccatgcctgcccccaggaggtgtgcggggctgggcggaggaggggagaagggagaactgagagcctgcagcatgtgccagtggaggaccaggtgaatgcagaccccactcactgggcacgtgtttagtgaatgcatgtgaggtgccaggtgtcttgtacagatggggagttttgtggtgggacaggcttagagtcctcctctgctagagcttatggcttcatatgatgatagacattaaacatgcgcaactgctgatggggacacacgttgtcagggacgcatgagatctatcacgttgcagggtaggagtcacatttagaaggtcatagatgtccctttcatatggtgacagggtatgcaggttgtgactgaaatccagatatgctgcttgagaccaggctcagcatacatgctgattgcttataaaggggttgcttgaagtgaaaggaaacaagtaggctgctagatgaagaatatgggctctggtgtggtaggactgggtttggtgcttgctttagggctatgtgactttctgtatggaaaatggaatactaattatgctggcaaggataatacttaccatagttctgggcttataaaagagtgccagtaatattacctcctatgtgtgattattattaacattactgctattttattatctttattgtcatgtcaaggaaaatcatttgtggtagtatgtcaaaggcaacttgtagttctggaaatcttctaggatctggatttcttagaaagttaaaaagtcattattccttggaacaaacattatggagatttgagatttcaagttcattggtcctaaacatgttatcattttttttgtatatcaaaagtgaattcctaggtgtgtgcccaaaagaattaaaaaacaggtggtcaaacaagtatacaaatgttcatagcagccctatttacacagtagcgaaaaggtgggaccagcccaagtgtctatcagtggatgagtggataaacaaaatgtggcctgtgcctgcaatggacttttattcagccatcaaaggaaatgaaattgtcatatatgctgcatcttgtgtgaacctcaaaaacattatgctcaaaaaaagccagc

SEQ ID NO: 95732 - DNA, 1646 bp, Homo sapiens
gttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaatttttaaatatggagaagtaaaccacaggactttggcagattttattggcttatatattttacaggtatttttgtttgtttgtttgtttttttggaaaagaggaaggaattctcatgtatgatctttcaatgcaagctctccaagggcatggatctttatcttgttcattgatatagccatccccagagcctagagcagttgtctggtacatagtaggcatgcaattatttttgaaagaataaatagtataaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtttggtgtttttggttttttcttttctttttcaaagtcccatggccagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacct

SEQ ID NO: 95733 - DNA, 1061 bp, Homo sapiens
atcacacctggctaaggatatgtaatttgaaattaaagtccataggacccactgataaattatttttgcatatgggatttgaaggaaagagagggatcaaggataactcagtcaccactttgacctagaaaatggggtgactggtggtgatcgttattgacctgaggaggatgggaatcagagagtttaggggtgtagttggtaatccagaggttttagaaatgttacatttaagctgcttattaaatattcaggtgaagagtttgagtaggttattagacacatgatgaatctggagctagggagaagttagggctgccatagtaatttgggagtcagcagtgaataatactgggtaaaatcttaagtatttttttaaaaggctctgctaaatgctagagattactattattttgcatggagtttatgttcttgtaggggagttcaaaaattaaacacctaattgcacagtacattgtagctgtgatataagcactaaaggagaggcagacagtgtaaaatgggttgtgtgggtgggggggttccaaatttaagctggaaaattcgggaagactttcttgaggcagtggctattttgagctgtagtaacttggggaaaacagagcaagacatatacaaagggctgaagatggagagagaatggcatctgtaagactccggaagaagatcagttcactgcagtacagcaggacagatgaggcaggcctgggctcacgtgagatgagagaagagaacaggcaggcagcagctgtggaggccctggggaggattttgatctttgtcctaaggggaaggcaacgctattttaggaataatataatatttgcattttaaaaattattatttgctctaatgtgaaggaggtattgaaggggtgttcagagatgcttaggagaggccagttaggagagcatttctttgactaaagtgagatcaatgaaaataaagagctggacatatttgagagatgactagaaggtaaaattggaagaacttagtggttgtttggatataataaagtgagaaagcaggaggctaga

SEQ ID NO: 95734 - DNA, 1064 bp, Homo sapiens
tgttttccatgtgaaaataaaactgtaatttgtgagtaatattgctgctaatacactttcacttgtgtcttccaaaaagacttcaaacaaggtgaattttcaaaaagtccagtatgagaaaatgtttagttttttaagttggaaaaggtgtaaggagaatttatttttaagcatatttttctttcactctgctttcaccaaaataaagtgatagatttgtgagactgggatataccttttgtgcagccatatgtaattgccttagaaagatgacaccttcctaccctgtctttataaacatgagaagactttacagcctccctttgcatgctgtaaaatcttaaaatctttaaggaggtctcttaaaactagtatttatgctccttctctctcatagtgtcaagttacattcatataacttttagtttagtacaatggaaggtgactaagttcttaattttactttcttgaagctaacacatttttaaaacacctggttgtgttttgtaggatcatgggttttgaaatctgacaggcttggttggccatatgtccattggagttactaacctccctgagacttaacatatctacaaagttaggttaatactgcccaccttaagggttgttgtgagggataaatgatgtcacctttgttaagcgcctaacagtgactttcaataattgttcattccatttcttctattttccttttctgatttttcataccacttttatattagtgtacctaaactaaatctgtaaaaaaaaactgactaatgtaaatgaggtgatcttaattcctatatgttaaattgtctttacatctaattttatttcttgtgctcaactagaatattcagaaagccaccattaagaaactaaatatgtcaattttaaaatattaaacatagtaattaataatttttacattagacttttcccctgtattaatcctcaacttcagacagaccagtctactccctgcccctgaacctagctattgcattttgttcagaatcttttccttttctaagccatttcttcccactttgcttgtccat

SEQ ID NO: 95735 - DNA, 1052 bp, Homo sapiens
ggaactgtttgctgttattttcacttggaaacccagatttgtttaatgagaatagttaagagtagaaaagtgaattgcaaaggcagtggtttatcatatcagaactgaatggaatgctcacacaccattcttggaacagcattagcacactgctctgcacatgcactgtgatttgatttgcatcttgaaggctgaataacctgagatagccagaaggaagactgcatttccagggaggagttacctgagtagaggatgtaattggcctttcctttgtttataattaaataaaaataaaaacgtgccaccattactagttagatactgatgtatgcctttcttctttacttaggctttttgtgccttataaatctaagaggcaaagagtcatggactttgacttaaatgtcttttgagttattgatgcctatgcattttctcagttagttaaataataagccaggtaccagtaattacaaattagactgctgccagccccttcgagcagtctggcaagtgtgggaagctttgtcagaaagggacccagcatgtgaatgactatgagaatgaatcagtgtaaattcaataccatttcaagcacagattgccctgatggtttcggaagtacaaatgatactgaatttaggatagtttgacttaggatttctcaactttatgataggtttattgggatatgaaatgcatttcagctaatattttcaacttatgtgatggatttatcaggatataaccccattgtaagttgagaagcatttgtatagcttttgcgcatgttctgcacatttttttatcactaaagttaatctgttcagcatagatattaactgtttattaattagtgaaaatatagacctcaaacttctaagagttgcacagatatcttaaggtagcacaaataatgttgtattaaacatttaaataatttttcagctaccaaccaatagttgactacatagatgctcagtttgaggcctatctccaagaagaactgaagattaagcgttctctctttacctaccatgattctcgca

SEQ ID NO: 95736 - DNA, 1004 bp, Homo sapiens
tttttttgtttttttttttgagacagggtctcactctgtcgcctaggcaggagtgcagtggcgcaatctcggctcactgcaacctccgcctcctgggttcaggtgattctcaagcctcagcctcccaaacagctgggattacaggtgcccgctatgacacccggctaatttttgcaaaagtagagacggggtttcaccatgttggtcaggctggtgttgaactcctgacctcaggtgatctgcccacctcagcctcccaaagtgctgggattacaggcgtgagccacctctcccggcctaactttactgattttaagtgtacattcaaaatgaattttcagaagcatatagcatgttgtaaccactagcatagctctaatataggaaatggccgtagtcatgggtattttgctgtcctgcatatgcatattattctttagccagggacttgggggccctctccagatgtgcagtgcttcctgcctgtgcagctttcttctcttctgttccaacctacagatgttgcttttgcctccttgaactcctgtctgggtttcctcaactcagtgaatggccaggcgctgtgctgtctttgcgctctgcccgggacacttgtccccagtcaggaagctgggacatggtagggctcataaaagagggcatttatttcctttttcagtggtcacagttttatactgcctgtttcccagtgttttaaaacctttttttcatttattttgttcaggtttctagttatttaaggtgagaagataaatccagtcccagttcctctatcatgactgaagacaggctttatttttctttctttcattgttaatgctggactgtactgggtaggacctgcagtattttgtaggatagtcagtgatggtagtgggcaccatcccctcatcatcctaatcccaaagagaaagctttattttttaccatgtaccatgcttgctttgttgtggtttttttgtttatttggttggttttgggtt

SEQ ID NO: 95737 - DNA, 1061 bp, Homo sapiens
agtgtataagtttttattggcaaaaatctcttttacgtgtcattatggaatacacatgaaggagaaaccctcctgaacagagcttagtgataaatcctacctatatctaaaaatcaagagtgagtgcctggttcctttgatttgcaaggagtgtttctagaacaccacccttgctcattcctacaaagattaattccgtgtctcaacctcatgttaacataggaaagttgtttccacatgaagcacccgccaccgtccccccattttagtggggctattatgccttattacctccaactttgttttcattctgcgaatgtagtagtcaaggattgaaatggttcctggagctcagtcccatctgggccgcagtttgctgaagcttcctagtgtccacccctaattgaggctccaagagttgagactctttgagacaaggtaggtttcttgagggacatattacccccaaactgttggaatgtgcctggttaagcatctggattgtgactggcctagttctgcctgtttggacccattcttgtgccatgttcctggtggacctggtccttccaatgttgattctttctttctcattgcttatgtacagcaccctgacacagtcatgcccctctcctgtctctcctctaggtatccctgcctctgggcatgtgttacttccgagtcctgtccatatccttatgggatttttagccactctgtgctgctcctaattttctagttttctgcttactacctttttacactgtgactgtactccccagttctgtagtgggcagttacctttgacgttacctctgtcactttttctacctttgctctacttaaatgtggtagttttttcccccccaaaatactgtggagatagtacttttcctacgttagccaaaactggaaatggaaagttgggagccaggagtcagtgccagtcataacttggaaatgacacactgttgactccttgaatctatattcccccacctccatttttcactgccatttagtcatggcatctacatgtcttggcccacttttactaccct

SEQ ID NO: 95738 - DNA, 1271 bp, Homo sapiens
tatgttgggataagtaaatatattattaaaaacaattccatgtttttgtttttattttttaaaaaacaggttaccagaaaatttaaagttacgccagtcactcccattctattgctgagagaaaatacagagcggtgaagagcttacagtcgggtgagcaagatacgcccccaatgttagctaatgatgtaaggcatcaacaagaaatgtgggggttcaggaaagtggaaggtggggtcgtccaaagcctgggaaagtcttcagttgaaggcgagacagatgggactattagtgagtttcgagagatccaacgcctcgccgccttcgcttcatttttgtctcacgccccacccttgaacgcgcggcgccttttgaccccgccgccgcgccgtagaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttggtgagcagtacacatagtgacattgcaaagggagactttggggtcgggcggatatcttaggatcaactctggctaggtcgcagaagacaggacttgttcccacagacaccagaaggtggaagttttgtcttccctgataacttgctcttcggtatcttggtttggttcactgggtgtttaatgagaatgtcttaccaacgtgctatgtcgtcgttcatcctgacaacattaaacatcagtatagaaaatactggaaagaacaaaagaaaaaaagaaccagggaggtgatcttgccacccccaattcttttcagtaacatccttgttagcacatcttcgccttggcgattgtaaactccaaactgaattcttaggttgttggcagcctggtaaagtggaaagagcagtggcctggaagtcaggaaccttgcatccagtcttagctcttcagaagagctgtgcatgatcaattttcaggacctcagttttcttgtcgtaaaccagatcttatggttcatggtttaataccacagtacggcttg

SEQ ID NO: 95739 - DNA, 1033 bp, Homo sapiens
gctctctcctgggcagtccaacctgtctacttggtcctggtgcatatgcagttaggcttgacagaagcatttgtccagattatccaattctagcagtattgtatgtatggctagccagaagcagatagtttgggtttttatttaaagggagagagagaaaattttttgacttgcagtattgctaaaagattacttatcttattttttggaacaagatgtataagacagttaattgggtctttaatctctctcatgtataatagatatagtgtttccatacttgctgcattgtattgtgtttaggtgagagttgttatactaaactgtccaagcctgtggaagtcagatgcaggggtggggttatcctgcatattgaaggctacattttagccattatttatgctttgtctttttcaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaacttagttgttataaatatttcaacaaaatatacaaccccataaggtccctatatagcaggctgattgggctgcttctgggatgcaagcatttgtgagaataattcagacatgagcattctctagaaatcactttttaaacactgacctgtttaagccaaaaaagggccaagacagctattttccaaatttgaagtttggtgtctgtgtaaacacacacacacacacacacacacacacacacacacttccctaacatttccaagggacttcaagtttttatgaataaa

SEQ ID NO: 95740 - DNA, 1433 bp, Homo sapiens
aggccagcccaatttcctaaatcagggataacagggagacctgcatgcccactccaggcagagttgagcacatgttggatatacctgggatgctctcaggcaggatggtgggtttgactgtaatagatggtacagccagattcctaactggccagatcaagaaatggatcattattattctaatggaagactgctgaattttcaaccaactagaatattaggtgaccagggaggagaatgctaattgggataaatgaaatattttgaacctgggtttaacaaaaccaactgccaagttccctggtgagagctatgtctttccaggagcccatggtaaaaggggcaaagatttggtgggggtggggaggggtcttgtttctggtatgttgtcactgctagtgaggccttaggagatggtcatcttctatcctgtggatgtggatggggctggagtgttcttttcaattatgaacatatcacacaacaagaggccatgggggcgagttagagaactacgaccagagtcccaggggagtgagctgggaggacttccaagctgtctatgtggaagagggcttagagtgttgtgtttgtcctctgtgtgacagaatgaaggacttgagagggacatggtagctcaggagggcagagcttttcaagagactggaagcctgtggcaaagcctagatattcagtaagacatgttagtggggcgattgaacaaatgccttccaaaatgttttaaaagtaaaatcctgtgagtatttaacttgctgcctaagttagacaggcatcttgatatagtcatgtgtaaattactatttaagtcatatatacctctatcttcttcatagatcgattactttggggttgctgcaacagtatattgcatgctctttggcacttacatgaaagtgaaaaatgaaggaggagagtgtaagcctgaaggtctttttagaaggtgagtattagcattggtgctgtagtgaaaagagaataactaaagtagaatgttgggttccatctggcaaaaaaaaaaaaaggatctctgccaccgcatggaaatcctatgccttgggcaatatggtgacaggacagtcctgggcactgggcacagggagcaagctgcatagctttaccacttctctctccccactggggcagctgatgtcctcactgaaagctcctggccaaatggttgacatcctgtacacacgcaaatgtttccacccctaatcacctaatgtcactggacctcaggttctcactggttttttcttttttcttttttttcttttttttttttttggtctatggaaatactgatcctatttttgtcagatatttgtaagaagcgaaggaaatagtgtatgtgaaagtgcttcataaattataaagtaatatgaatagctctctctcacaggacagtccta

SEQ ID NO: 95741 - DNA, 1411 bp, Homo sapiens
acttctttgtaaattgaaaactatttaaaataaaaggcgtacataaattaaaattttcaattatcttctaaggttctaagctggtctatgtccatcaccttcttggagaaggagcctttgcccaggtgtacgaagctacccagggagatctgaatgatgctaaaaataaacagaaatttgttttaaaggtaaatgacctgagttgtcttttgtatgatatagaaatgaattttagaacttgagtttgccaagaaattttttttctttaagatagtggtgtttttatttatatctacagttggcaattaaaaaacaaaaactacaaaagatttagaatttttttcccactaaaattgtcttggagcaagccccacattgcagcaacagttcatagcttgtcatcactatcaacaccacatcttttattgggatagaggttgctttattgctatcatttttcagaatacgagattggatatgaatttcacatacctgatttgcaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattagtaagtattcatttttatgatgagcacatgaatttaaaatggatttttggcttgtaccttgcacgtacttttgtggttggggcttttgtggagtggtgggcaggggcaaagctctcaatttgaaattttattaatcttgtgcaactaactcaggattccactttccattgttcctagaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacgggcaagtgttatgcttttaacagggttcttctcttcctatttccatagcagcctttcatcatttgtgctcatgcagcctggctttgtttgtgtttaatatagatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccaggtataaaactaaagtgagggacttggaaatatttttctgtgttgcgcttatcagattttcaaaatgaatttggggatctaggtagtttgaggtggtcttttgaggagcagttgaaggagagatgagcctaaggccaac

SEQ ID NO: 95742 - DNA, 1120 bp, Homo sapiens
accatgttggattagtatttgataactgccactaatataattttttgtaacattccaggttggagagaaagctttttcttacttttagaaattatttctcttttgtggacccaaagtatatctcatatatgcaaattgcacataggtagtataagttttgtggatataagtggaaaagaaattaaataatatgtgtctatctgcgcacattagaagtaactaatgtccacatctgcccttaagacatgtatccctaattgtgttaaagatagaatctagccgttccagttgagtggagcaaatgcacctagagttgattccctttgtcacaactaaatattgatccaaatttgtagatctaaaatggcaaataataaactgtgcagagctaccaattttgacttttaaaaatagttcttttttattttgaattaatactcttataaggctttgaaagcttacttagtaaatatctctactcactttgtctataatttatttggtaaagttcttgagtactcaattcatgttccctttttttttttttttctcattcctttaagacttcattgttgggaacccatgggatgataagctgattttcaaacttttatctgggctttctaaaccagtgagttcctatccaaatacttttgaatggcaatgtaaacttccagccatcaagcccaagactgaatttcaattgggtaagaattatttggataatataactttaaattcttgtttctctatgagaagttgatggtaacgtgtgtgtgtgtgtgtgtgtgtgattctcctatttgccccccaacctccaatagggagttgtatctgtaatactaaactgatcattttgttaagccatgattgtaggattgtgcttgctgttgggactataactcctataactcatagagggcaatttgccaatatctattaaaattaaaaatgcatttacttttaaagccagctatccacttttaaggatttcctatagatattattatatacttctatagtaaaatactatagtaacattggcaacagaacaagaaagctcactctgtactgatagggaatgagctccaaaacataccatactgttaaaagggcagag

SEQ ID NO: 95743 - DNA, 1051 bp, Homo sapiens
agtgaacgtgagggcctaggacattactgtgcactgctgtagacttcagaaacactatagttaggttacactaaacttataagaaaaatttttcttcagtaataaattagccttagcttactgtgagctttttactttataaacttaaaaagttttatctttttgacttttgtaacaacacttagcttaaaaaacaaacacattgtacaactatacaaaaatattttttctttatatcattctataagcattaaaaaaattttttttttcactttttaaacttttttgttaaaaacgaccacacaaacatacacattagctgaggcctacacacccagggtcaggatcatcagacatcactaggagactggaggttttcggctccattatgatcctatggggccaccattgcatatgctgtcctctgaattgttgttatgcagcacatgactatatatatggaagtgtactggagtgttgtattgtgattgacattttctgtttgtttcaatgttataaaagcagccatttttggaataaagttaaatattcagtcttgatgatagtagtgtcgcatagatgcagcttggagaaataaacccactcctgacatttcctactaaagaatatcccatgtattacctcacctatttatctaatataaccatatcttgattttattatttctgttcatattgtactagctgtatattttcatagatttgtttgtctaaaaatgctttaatcaacttttagtctgtgaggctattgtgaaatgtcatttctagaatgagaagggaatttcatgtgactgaatccaacagatttctaatcatgtggtgttttggtttctttattcctttcacacgtccagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgc

SEQ ID NO: 95744 - DNA, 1766 bp, Homo sapiens
aggagaggtcagttgaaactttgacaattgccaagcaccatcacaagcttgcttttaattaaaaaaaaaaaaaaaaaagattaaagccttttccatccaggaaaagtagtttaatgagtctaaagaatccttcaaaaagtcaatattggctattcttaagagtatttggcactttggctcgataaacaaaaactaatgttctagtgctaaaaagtagtaacacctgttcagtgaaggagtatctgataaaatgtaatccaatatacttggctgtgtgcagtattataatcacttggtagaaatttattctgtatttctgttcttcctagtttacctatctatagatagattttttttttaattatggagagtaataaatattgccaggttgctttctgatttaaacacaaaatcgtttcaataaattaaatgctaatttagtcaatcaactaattgactacaacatgttaaagtgaaaaacccaaaatctctgccctccagaagcattgtagccttttactctccatgttcttgtcttcaggttctcctgaagctgggtgtagccctgccatccgtaccagtaacttcccatggtctggtcatcctgcccacaatggacttgccactctctcgaccccttttttcttgaaggattataggaattagatgtagagttgaaatgctcacatatattagtagtagattttatttgtttgtttgtttttaagagatacggtcttgctatgttgcccaggctgagtgcagtgcagcctcaaactcctgggctcaagtgatcctcctacctcagcctcttgagtagctagggctacaggctcctaccaccacatctggttaattttaaaaagttattttagggatagggtctcactatgttgctcagccttgcctcaaactactggcctcaagtgatcctcccacctcagcctcccaaagcactgggatataggcatgagccactgtgcctggccagtagtggatttttttaaagtgattttttcctcccatttttttaatcttattatacattttacaatggaacactattttgaaatcataatgcaagtcagtgtcaaaagaaatcctagactttgtaaccatatcaaatggtgtgtgttgtgcacacatgtgcatctaacatatcttgtctctaatttttgaatctttcagaaaatgtggtagcaaaacagtgtacccaggcgactttggattcttgtgaggaaaacatggtggtgccttcaagggatggaaaattcaggtattgtgagggtttatttggttctgccattctcttcattttcattctaacattgtttaccattttcattctagctttgccttttaggctgtaatagaatacctaattttagccttaaaggccaataaagattttatggactagtagctttaagtcagaaggtactctccgtgaatatacatacaacagtgaacctaagcacttgatacatcaggccggtgcttgatgagaaaacatcagagaaacccaaattgaaggacattctccagaatacctggccagtactcctcaaaactgtcaaggtcttgggaaactaagaaagactaagaaactgtcacagatgaaagaagagtaaagagacatagcaactaaatgcaacctggtacccaggactagatcctgaagcagaagttccttagtgaaaagagtggtgaaattgaatgatgtctacagtttagttaatagtaatggaacaaatgttggtttatta

SEQ ID NO: 95745 - DNA, 1008 bp, Homo sapiens
tatttccttagcatattttactatttataatttagcaaatctttccttagattaccacagcctaaaaataaacccacaggagccaggacctttggagaacgctctgtcagcagacttccttcaaaaccaaaggtaaacaaacctgttttatctatgaaatgggtcctacaacccatccgctttattctaccaaatgattatgccagtcagaggatattgtgtatgtgaaactatgctaaaaactatgaaacataggaagaatatgtttcttttaggacattatttaataattattcaagaagaaacagggtatgtgcatattttccaagtgtcctaccaaaattatttattaatattcattactgtggtggtttcacatttatccacaaattctttgaatttttttcctccagtttaattcatctccttttgagtgtggctagatttggtgacttgcttcagacaaaaagcaaagggaaagggaaaattagattacagtagggaaacatgggagattctgcctaatcaagtgattgggttaaccaggaataagtcatgttgacagcagatatcccctaatatgatgtaatgagaagaacatttcacctctgatatccttcccaaaaatctgtaaccccagtctaatcatgagaaaacatcaaataagcccaaactgtgtagggacattctacggagtttctgactagtgttcaaaagtgtcagtacaaaaaagactcggaaaggccaatagacaatgacagactcaaggaggctaagaacacttgagaactaaaggtgacatgggatcctggattggatccctgaacagaggaggcacattagtgggaaaaaaaaggtgaaatccaaactacagttaatagtactatttcatttttacaaatgtgccacagttctataagaagttgacattagaggaagcttggtgaggagggtatgtggaaattctgtgctatctttgtaactcttctgtaaatcacaactttttca

SEQ ID NO: 95746 - DNA, 2898 bp, Homo sapiens
gtttatttactaacactgtagaccctaagtagttccatctgtattttaacaggcttgtaattattgactgattcttttttctttctactattatttcttgagagtcagttaaaaattctaatagatcaagcatttttttgttttgttttttttttgttttgagatggagtctcgctcttgttgcccaggctggagtgcaatggtgcgatcttggctcactgcaacctctgcctcctgggttcaagtgattctcctgcctcagcctcccaagtagctgggattacaggtgcctgccagcacaccccgctaatgtttttttgtatttttagtagagaaggggtttcaccatattggccaggctggtctcgaacttctgacctcaggtgatcctcccgcctcggcctcccaaagtgctgggattacaggcgtgagccaccaccgcacccagcctagatcaagcattttattctctagtgtgtctcaagagttttctcttccagatgtgtgaataagagtactcatgaattcaagccacagagtggagcagagatcaaagaaggtaatgtttaattataataaatgtgtttctgtccagattcctctgtatcactcagaggtgtattttgtggctgtggtttatgaaggcttcaggccttaatgaacctgagtgttagatttcctattcttagagtataggttatttatccctgaaccatttcaaataaatgtagaaatccacttgttagtctcatcttctttaacattctttggaaatgtaatttgtgaatacatttctagtaaatttctcaggaaattaatccaaaacagagtcatctttagtatgttaggtaggaaaggttatcaaaagtttaattaggagtgttacactgttattcggtactactttgttagaggcatttgcataggagataagtcttataaataataagatgcacaggttgggctttcacttctccgctgtgtgactgggacattttttttctggacagtttggtgaggaggagggctgtttgaaatagctggaggttcattaactgaaccaagacttactgagcctgctctgtaggtgccaggcactgttatacatagttagggatgaagtcatgaacaaaaaatctccacccacacagagggggaaagaaatgtactattggagttatggggttgaaatttcagtcaaggtgatatttgggtaaagggctaaagttagggagctaccatgccattagcttgggcaacttttcagacagagggaatattaagtgctaagccctcaagcaggaaaatctctgatatattctaagcacagcaaagggaccaatgtggggaggtaagcagggagaggaggaaggtgaggcctgaccaaacaggacccaggctgtgcagggccttgtattctatgcctgactgcagtggaatgagatgggaagccaatcttaagatttacattgtgactatgaacttgggatacagtggcactaagggtataatttatgacaaagttgctaatctggtataatccagaccaaccactcaatctctctcagccttcatttccttttctgtaaaaggataattttcacctcatttacttcataggactattataaagataaaaatgaaatatatgaaagcactataatactggaaattcttagtgataatttttaacaatgacaaactgttttaattgtaacttacttaaattgtgtgtcttttaagttattctgatttccctactgataccacattttgtctccatttctttgctagggtgtgaaacacataaggttgccaacacaagttcttttcacacaactccaaacacatcactgggaatggttcaggcaacgccatccaaagtgcagccatcacccaccgtgcacacaaaagaagcattaggtaaagtattttatctgagtgtgtagcacctgatgacaagttaatgaaagctcttttgcaacctgtttacaattattctttttgttctttaaggtttcatcatgaatatgtttcaggctcctacacttcctgatatttctgatgacaaagatgaatggcaatctctagatcaaaatgaagatgcatttgaagcccagtttcaaagtaataactatttaaaagctactaagtgcatagcattataggtggttatcacagaaaatatcaagaattatttaagaggtgaccctgcccttgattagcttgtcacataaaggcagggaatgcatgaaataaaaataagacagttcttgacaaggtactcaatgtgtgtgatagatttgcttgattaaagggaaaaaaaaaaaaagaatagtgctaaagaaggacaaaacccccatggataagaagggctgagtactcaaggtgtgacttgagccttcactggtagaggaatggctggggcagagtattagaggaggctggcagctagcccacatttgtctagagtcaggggattcatgctagaagccagagatcatgataaagataagtagaagccaattagactcaggaggacttgaaatgtaaagctaagagcttaattctttcttgaaggaaatggaaaacgaaaccctgagagcgtttattgagtgagtcaggtgacaatagtactgatttaggagaatgattaacaccttgctgatatgtggcagggactcgtgacctgggacttgagtacaaaaccctgttaccatagttaagtcacttcatctcactatagtgacttactgcctagtatttgaaaagctgatattagttcttttctgtcagctgttagtcctttttcttatttgtagttgaagtttaatataaaggatgttttttcctagtacaataattagatgctattttttattctgttgcagaaaatgt

SEQ ID NO: 95747 - DNA, 1614 bp, Homo sapiens
agctgggactacagacacatgcttccatgtccagctaatttcttgtatttttttgtagagacagggttttgccatgttgcctagcctggtctcaaactcttgagctcaagcaaaccaccagcctcggtctcccaaagttctgggattgattacaggcttgagccacccatgcctggctggtgtttttcttaacaatttataagcatacttttatatggtgagaaattaactcatctaactttgtaacactaaagcatacaattacagtcttacactgatgtgagtagcaaagcaaagattttaaatttagagcttgttatgcttcctgttgtgagacaggcttttgtggcagttattattgcaatttatatttgtgtttcctattcttcaaagtgaaaacggctatgaaaagtattttatttatttatttttttccctttttcaagccctatctcatataccaatctaagggtattttaatgggaggaaaaccgtaatgagcttttgataacactgatttgtcgaccttttcccaaaattaagtaaagagaaataagataatacttaaatgctgatacaactatagagacttgttatttcagtggttagaaattataagctgctgatggtgtctgtggttcagaagctacaaagcatccattttgtagagtggtctttttgttgttgactgtacatttcagaatgcttgaagaaggagtatggggaaacttcaaggaaaaaggaatccattgaagacagatgccatgctttgagaagatgtaatgcctgattagtagtattctggacttcatggttttgtttttgttgtttgtttgtttaatatgaaaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctgggtaagctgaaggtagtcctagagatcacagtgatgtgagtggcacctgtcaccttctttacatgacctgcattatcaggaacagtatgtaaaagatgaatgatgtctgccttttatttttagataggtatgttgttgaaaaagcaagtggcaaaacattgctcccaatcctttaggcttacttattccatgcttcttttagaatatttattttatactttcgtgaattaaaaattttcagtacctgaaagtcaacagtcactttgtaactgaagaatatacagctgttaggctaaaattccctttgctcactggctttgattgaatacctacagggatcataactgtctagacaattacttgacatgtgttctcatattccttctgtcttcccatagagagcagtttgggattaatacacatgattctgtctctcaaaatgtacctctgcactggaagtttttaccccaattttgagggatttttccagatttcagaaattatag

SEQ ID NO: 95748 - DNA, 2592 bp, Homo sapiens
gagatgggtcttgattgcagtcacatttcccagacctagctcagagtgtgacatggaggtgtctggcaaatatttgtttagtgaaggaatttgagaactcttgagggcagagtagtacctgaggaaaattttaattaaaaaaaaaattagcagcagttgggaatgtcaatcccataatgttcagacactatactctagctactagactatgaattgaagggaaatcagctatggttcttctctactgctgagtaggactttattaaaaacaaaacaacaaccaaaaaaacctctttctttgattagattaagttacaatagttattgtaaggttgttgatacaaacaatcttttgatattaatcataatttaaaattacataaatctacttgggattaaggtccctcttcccctcaagcattttcatattgttttgtgaagtaatttgggtgaagctttcttctcagataagtgaatgctcatgtttgttttctgttttttagggttcagagctttctggagtgatatcttcagcttgtgataaagagtcaaatatgcaagtataatcagtgcattaatctattattagtttcctttaagtgctcttaggtacattgttgtaaataatgtattttcccccattgtagggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatggggtacttgcaatcttgtatttttagttattcttatgtcacataaaaaaatcctcatctctgagtaattacttttttaaagaataattgactatgttgaaagactgcaagaaagtcttcatctcatcctatcagaagcccagaaatcattattaacccattttgcgtttgccccgagaaaactgcgctggcagcaagctgcactttttttttctgaattggaaattgcttaaccactagtgtagcagccaagttagtccaaggactaaattgatgtcttggcagcaaactcatagttgaaagagtactaaattagatatccataccagtgtcatcttagctttagtgaaataaatatttaaaaatttttcagtattatctgtatatagtaattctaaacctctaggtcagttatttgaacctttattccactcaggacttttatactatctaagttatttgggctatagccattctgggcctttcttttctgttcattacttttcatactcggttgacaacagagaagacaagtcagttaacacagaggactcattttgtgctgggcatagatgtgtttttctttcacatgctgtgaccagaagttttaagccagactctttgacttgcctgtggcatgactctgttaaccagttgttggaaatgggactgaccacagcatgcttgaagccctgatcatttagtgcagttcacttctacttagaaagtctctagaaatttttatcttataaaaacaaataaaaatttattttaaaatgatttgcacaatcatgattgtttacaagaacagtcatgtatatgatggctacaaaaatctttactattatactgtgctattattattatttttgatcagcatgtagtttttttttttttttagtaatttacatgtcctaaacatgtagtagccaagctgtgggcaggtaaaaattaaaaggtaatacaagtttcacttctaaaaccaaatatgagaaagactaataaaaaaatcggccccctaaaatataaccctttcctcattttgcatgtattcctatgatgacctggatttaaattttgcatgcaaaccatttctatctttcctaaagtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggtatgttgtgctcctcatgacacatcctgtgcccagcagcaggaatggcagtttgatttgttcctttctatgtgctgttttagagttaattctgatgttaatttagctagtaactttctgaaagtctaaaataatttgacatagacgttcacaatgtagagtgagagtggaaagttacaaaacagaatggtagtatgttttacatgtttgtgtatgtgtacatgtctatatattcatgtatttatatatagacctttttctggtttttgtacagtgactattgtgtaatgaaaattggagtatagtactctcaataatttatcatttagatatattttttgtttgccattatttcatcttggaaaagcagagaagtgatgagtgtgttagagccacatatattttcttaaaattagtagtgaatgaaggagattggaaataaactcatttaaactgtataatggttgcttaatctttcatattatatgtttgtctatgacat

SEQ ID NO: 95749 - DNA, 1061 bp, Homo sapiens
gcaacttttaaagaaatacagccatttctttttcttagaactaagtatcacatttcagcaataagcattgcctatcctatctggttgtttaaaattattagttaggttttacatttcttttgggtacttcctggcatgttgagttgatcagaaaattgtataatacttattttaaaaacgttttagttgaaatttctgagacagtgtgaatgagttgatttacttcttatgattcctactggaaggatcaggggaatttattatgtgataattttacttacggttttacccttaatttctccgtattttatcctcttttccctcatagctagaacctcagaacctctgcataatgttcaggttttaaatcaaatgataacatcaaaatcaaatccaggaaataacatggcctgcatttctaagaatcaggtaataatgacatttgtagcttgtgtggaaactgggaatggtattgaatggccagcctggctgccttctacatccactttgacatctcatttctttgatctttctcttcatggctctgagctccatgtcagccacctgctcctgtggcaacttcctgggcctgttattctcccacacagctcacctcaaatacaatttgttgtctaacccagaggccctcaccacacggcctcctgtctttactctccccaccagcttttcccttaccaatgtcctttcctctgttctgctggcctctgcataggctctggaaatccctactgggaatggatccacctgggggcttctgagcctggctttcaaaactcagagcctcaaagattgctgcctgttacctcaagtaacagggaggtctcatactcccaggcaatgggtcatactcccaggcaatgggacatgcttccagtgtctgattcactctttatgttttgtgtatctcttatgtttccaggttcactctagcgccaaactatagtgattttagacttcttttcagtctcttcaaacttgggacctcgctacctctagcctctctctcaggaacttcaaaaatactatttcaacagatagca

SEQ ID NO: 95750 - DNA, 1079 bp, Homo sapiens
ctcttgttaggaggaggagcaaacttctggcaactgcccctcatggtggtagtgacattggggttccgtgagaggagaaggagactcttggggatagagctgggacttatggaaaaacactggctgcttctgagttttctgactatgtctgagcgaatgcttcttaaaattttaaatactatttggatcgatatttaagattttcattttaatgcatataaatggtgtatatataaaatgattgatatttaagatttttgttttaatgcacataaatggtatatataaaatgaagtatatcttttgcttgtagaaattatccctaatatcccatgtgcatacctttctctcttctaggatgcttgaagcccacatgcagagctacaagggcaatgaccctcttggtgaatgggaaaggtcagcatttagttattttatttcccttaaacaaactatacactgccccatggaaaattaacattatccatatttttctagatacatacagtgggtagaagagaattttcctgagaataaagaatacttgataactttactagaacatttaatgaaggaatttttagataagaagaaataccacaatgacccaagattcatcagttattgtttaaaatttgtaagtatacttaagatgtataatcaaatctataatcatgttgtacttttgctttttaaacttagattgtaagatcattttaggcttttaattccttgtttctagttctgaagatacagagaggaaaatctgttcattctctgattcaacagacttctgtgccactagtgattaaaaagtatgtaggggctgggcgcagtggctcacacctgtaatcccagcactttgggaggccaaggcaggtcgatcactttagttcaggagttcgagaccagcctggccaacgtggtaaaatcctgtctctactaaaaatacaaaaattaactgggcatggtggcaggcacctgtaatcccagctactcggggggctatggcaggagaattgctcgagcctgggaggtggaggttgccatgagccgagatcagatcatgtcactgcact

SEQ ID NO: 95751 - DNA, 1011 bp, Homo sapiens
tcctgggcatgattttgggccagttattcccaccctatgcctcagtttttccttacataatatggagataacaaaccttcccttgtagaggttgtgggagttaaattctatgcgacaaagagcatcaaatgctcaacacatagactcaggaagtaggagttgatgtttcctcgatgtgcccaggctggggatttggagaaaagagataccacatggtctcttttgcttgccattgtaccaggtagacaggtggctgcagagcccagcacgacgaggcaggccctgtgcagctgcaggggctcagagtactcagtgcgaactgtggagggtccgcaagcagtgccacttgagcaacttaaggaatgagcaagagccttccaggtggggctggaggacctgctaggcaggggaacctgaactcaggatgagggtgtgggagtctgtggtgcactgagggacaccatgacaggcatgggctgggtctcagtgaggatgcaggggaggaaaggaataaagggaaaaagcgggaaccagacctagagaaggcccggagcctgtctgcacagctgcctacagcaggcactctgtggtgccttcaggccccagcaccacatggtgcagctgatccagtgcacagaggctcagcctgcagcactgcagcatggtgcttggcacatatggacacttcacgtcagctattctcacttatttccattttacaaatgagtaaactgaggctagaccatgagggcagtgagggcagggaccaagtccttgatcactacagcctaagtctgactgttgtgtggaatattcaggagatagctgtggactgagtgatgaccagctgacagacagatggacagatagactgatgtgcacagacattgaatgaatgaatgaatgaatgaacgaataaatgaatgaatgaatgaatgaaagaatgtcctgtgcatctgttttctttcttacccttaaaacttggaattaatccacaaaacttggccccct

SEQ ID NO: 95752 - DNA, 1069 bp, Homo sapiens
agacttgctgccctcagcattttcggcaaacaatggggccggagcagggaacgcggccagccgcctgcaatcgctgcatctgcgcccgctcctgtgctccggcgtcctacctaaccccgggaagtcagagccgctgggagtttctgacttactcgaagaagtctgtcctgggcaaagagcacacacgaatagacttcagattagctgcttctctggaaacgcatgtgtgtgtgcaccagttccgcaagctgttgacattgttactgtattttgtttgggggtaccctctaccaaaaaaaaattacacctttattattttaggtgcaatttttttatttgggagattgtcagaaaagtatagaacaaagtatttgggattaaccctaagaatttttaatcgctaggtgagagctaatttgtttattcatcgatttttttttttgcttaaaataatcttagtttttattttacttgcagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatgggtaagcaatgcctgggtaagaggcagttgacgtgtggatggttgaatctgcttgaaggctgtgtgtggcatttaaaatccccttttaaaaccccgtaactgatttattccatctttagatgggaatggaggatgtgtcaaactatcaaaccaacttttttttttttttttgagatgagtcttgct

SEQ ID NO: 95753 - DNA, 3427 bp, Homo sapiens
gccaccacgcccagctaattttttctatttttggtagagatggggtttcaccgtgttagccaggatggtctcaatctcctgaccttgtaatctgcctgtctcagcctcccaaagtgctgggattacaggcgtgagccaccgcgcatggcccacatcaacatttttacaaagttactaacttttgtggcagtgatgagttgaggtccaaacattagctttcaggtctgtcttcattaagctaaagtgtgttttaaccaccaggctttacatagtaatgacattttgcttgaaagggaactgatcatttacagaaaatagcttaataatcaaaagtgtaaagaaagatgacaatcatttttgaaaataacacttttaaaaaaatgaactagttcatgaaagcagtaccaacatagaaccatgaaaatggtttgttttctgcctaaattcctctttgtgcttattgctcagagggtttggacatagtactaatcagattaggttgtaggtttttatttcagggattaaaggcagtagtagggtttgaaccaagagtggctaacataaataccacagaggcccacagcaaaatcatggaaggaactgacctggtggagactggtaaattggagagtatttgccccttctatgtttgggccacacctaattgtggctgtgagggcatgtggtctcagggtgggttttcctatattgcaagataacctaggaatgcaaaattgatgccagataccctgtttcaacattgacagctgattcagattttgaaaacattgtacaagctgaaaagaaacatctgcagacttgatttggcccttgaacctacagcatgtgactttgggtacatactttgggtaaccttggtgaggggctgagtctgtgttgatcgacttgctgttccccaccaatggaaaaggttcatgtcttgatcagtagtcaatcacattgaccatttgtccagattagcttgccatacatgaacaagatagaagtaagttggtagagttatcaattaggaaacccagtacagagtctattataatttagattgtacctcatgatgaaggctaactcaacaaacccatcagaacagacactggaacaaaatgacatttctaaataccatccagctctgtcttcataggcttcagtgaggtaaatcaggcaggcctttgcccatgttatagaattggaaagaacctcagagtggtggtcacttgtcagaggttgggcacacctgtgaggtggtggggagaaatgacagacatcccagcagctacacatgctggctgcacgtctcttgccaaatgccaggaggtaattttttagggtccctccttagggaaaggggctggaagttttattattgctgttactactgctcgtgaactcatttcagccttagaagttcttggcttgtagtttttgttgtactcatgaaaatgctcccccatatatatgatcattctcgcttactataacatccttgcttactaaatgagttaacagggctttatggtgtgtatcgtgaaacacacgtgcattaaagaccctctggaaggtattagcttttcacactttcacaacaaaagcttcacacttgtggttattaagctattttctctaaccagttccctttcaagcaaaatgcatacattggtctctgtaggtgatgggttaatgcatggaaatagtttctccttccctggaactgggaatagtgggtgagatagtgtattttttaatgtaaagacaggcacaaatgctttttttgttgataaatactattttacaagctaattataagttaagcactgttacttgagatgaaatatacagggcttcaaagatcataatctaaataattatgcacagctaatggttatacctgtgaagtaaagtagtggatcctgaggtgtaattttatagtattagctgcatttcagtagatggtgtgatgaagagtttaatgcataggattaaatgagaagttacgaggagtttgtttaaagttaatgtaccgaggtaagttttcagtgttaagtttttgggagatttgttttgggagaggatgagttggggttgggggaggaaaggacttagccagatgtgagtttcttaaattgaagcataaaatttacaatttatgtagtccataattttctctggacattctacagtcttagttcatgcctgaagaccactgaaataatgctgagttgataagtggttctcttgactttgtttagtattctttactcaaccctatccatgaagttcttcaatgaagcttttgataatttattgcaaaatacattttccacaaagaagtcattatgattggtttgaactagtggaacacaaatgtgaggttataaagaggttcgccttagccaggggctcctttagctgcaaagcagttttttgctcagcaacttggggtagagatcagtgtgtcttgaagttttgttttgcaaaactttgttctaatgagaaagtcaagtcttaggaggaatgtatagtagttgagtgtttgtattaacactgttttcatattttccttttatgtctctgatttttctgaagacaagttcaaggaatatatttctctgtggggcaacagatacagttttttcacttttcctcaattttagtctccttacactctgggaggattaacttgacaaatgataccttagtgaataactgattatttttatcaaaatcactcacatgtgttggtttactgagtgcctttttggatgagtgttttatgccatatgtgtttttaatggaaattaaagtgtagtcagtacactaaagtgtagtcagtacaattggaaataagagttgagaaaagtcaggatatggaggaatgctccctagtgtcatgttagtaaatgtcttaaattttatacttgttccctggcacattggaattcacagatgggagttaatggctttctttttttttttttttttttcctcagcgtcttgtgggtacttctcttatagctggtacttgtctgacccctcctttagtttgtgagctccctgggcggggaataatggcctgcagatgctagcgagtgcctgacaaagaggagaagcccaggagatgttgagagtcagtccagctctgcctgttagcctttcagacaaataaagttgaagaaggcaggtagcaagaaaaagatcctgacctctgctctgccaaagtgtttttaattacctggatctagctgtaaggtttgccacgtagtggtgacagctgaggtctagctcagcactactcagcagggaagccacacatgcattaagcacttgacataggactagtctgaactgagttgtgctgtcattattgatacacactggattttgaggagacaaaaaagaatgcaaaatagtt

SEQ ID NO: 95754 - DNA, 1081 bp, Homo sapiens
atgatagtctagtttaatattaaagaagttcattggcatatcaaaaatataagaatacattaaactgtcagtagtgggtattgttgtattttcgttacaggtgggcttttctcccttttttctttctttctttctttcttttttttttttttttgagatagaatcttactgtcacccaggctggaatgcagtgccatgatctcagctcactgcaccctccacctcccaggttcaagtgattgtcctgcctcagccttctgagtagctgggattacaggcacccaccacgacgcctggctaatttttgtatttttagtagagacagggtttcactatgttggccaggctggtctcgaactcctgacctgaagtgatccgcctacctcggcctcccaaagtgctgagattacaggcgttgagccactgctcctggccacaggtggtcttttctgtgtgcctttgtgtatgtacacaattgtcataactagtattatgtttataatcagaacagatttaatagataatacttactaaaacttttgctctttataattttaatctttgtttttggcattcccagcagcctgtcactgggcatgcataccttgtttgtgtgattcagtgttaaccgttgtgtcttttgcattgttgaagattttgtccaggctgatcaagctttggtcccatcaggaccatcaccgaaagtactcggggtgaacattagccccctaatttactcttttggggtctgcctttttattttttgcaaagtgagtaatctctcagggaacatctccatcggacaggatcatggatggatttggtgttggcaggttgctcttggtagctgtctcccccacaggctgctcttgggtctggagcaggttttgggtcgggtcctgcctgccctccatggaacctgggcggagcagtgagtctgtctgagcttcagcttcctcagccatcaagtgaggacatagtgctcacctctgagggtcatggggagtttttccataagcaaatcgacagaaagcccctggtagaaactcgcacaggaatctttccttgcccctcaatgagc

SEQ ID NO: 95755 - DNA, 1093 bp, Homo sapiens
gctcttattttttacctgtgtcttggtctttcttatcatggaggtgaaaacagtaatactgaagaccttaatgtgagtttaggagaaaagatgttaatcaccagtttcctgctactggttttaaatttcatagaggaagccacacttattttgtcatcagaaattcttatattttttgtttaaattctcatctccctcccctcttgcccagatctggttttttggctagaaacaacttacagtaacttcaaattaagcattttaattctaaggaatggtcttaagtgaaccaatgtatatagagttttatctttacttttaaaaggtctctaaagcatttttcttcttatggggaaataaattgggtagtttacctcgtcagtagaaaaaatatagggatttgtgtctttgcactaaagtaatttcagggttggtcttcttttagctgtccttagttttgggattatttttgtttttcagaataaaatggcacaggtcagatacttttaatcccctgaaagtaatctaaagctatagaaatggagctgtggctgtcgcagagacttactaggatgaaggttggtgtagaaaaactaaggagtagtagcagtattcagtgtcccgtgtctttccccagaagaacactggcagaacaccaggggcagaacactgtcacacactattcagagcagcgatttcaggagcacaccaaggcgggccaggtggtcaaggggcttcccaggggatgtcatacaaggcacatggaaagaactggtttaggaccaggtttggcacaggttcactgacaaaaagtggggtgatgattgagagggatcatagatttcctttatagtcccaggggcagaatcaagattgaagtggggcttagaagggaacatttcaattccctacgaggaatagcatcgtagcactcagtgttcttcagcgaggacagcagtgccttaggaaatgtgcatctgtcccaggaagcgggcacacaggctgggagtcttagagggctcctgctcaggtctcccacatggtgcaagatgctgggcttctgtcgtgactcagctggggatgtccttgagta

SEQ ID NO: 95756 - DNA, 1034 bp, Homo sapiens
caatctctgggaggcatcgtgctttgtgacacagtgctcttgaagaggtgcctttcatggtgattaagatgggattggttgttcacttaaatatgggctcccacccctccccacccccaaattagggagaaactaagaagctttccttttgttgtttcaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcataga

SEQ ID NO: 95757 - DNA, 1203 bp, Homo sapiens
ctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctag

SEQ ID NO: 95758 - DNA, 1048 bp, Homo sapiens
agagaatgtatttggcatctaccatatctttgcatccttcaatgacacatttgtccatgtcactgatctttctggcaaaaaaaaaaaaaaaaaaaaaatgtgctgtgtgactggtgggatgaaggtaaagggtggccagatgaatcctctccacatgctgccacgctggccacccaggatgtggcctagaggtgcaaggagccagacaccactggcctacatcaaactccaggccacagatggaaataggactgagatccctggacctggggcctgctcaggtatgaagatcaggtggattgaggatgtcactgccatcccctccaaaagcacctgcaggaagggggttgccatggtcaccatctgtgaacaggactcctcaaaatgttttctattaataaattgccttcaagtaaactgaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcaccccaattccctgtacactacttctaaaggcaggaaatgtgtacagttctagaattacagtcacataaaatgctagaagaataacgtgatttatttaagtgcttagaggtacccccttgaagtttgtgttacctggaagttggcctcggggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggta

SEQ ID NO: 95759 - DNA, 1084 bp, Homo sapiens
actcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaggatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtatt

SEQ ID NO: 95760 - DNA, 1033 bp, Homo sapiens
caagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcactcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgcacctgggaggccatgtctcccggggagtctcaggacctcattgggctggaattccacggggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccac

SEQ ID NO: 95761 - DNA, 1032 bp, Homo sapiens
gctttctaccgttttgatctgaatatttaatgctttataaaataaaaccctgtgttttaattttaactagtttcattcttttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattatcctttttccaggaaaaaactgatgaggttgtttcagaatttgaatttactagaattcctttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaagctcttgttttgatcgtttaaagcagcatttaaattccatttcccccaccaccccaatgttcaacattgaattg

SEQ ID NO: 95762 - DNA, 1095 bp, Homo sapiens
tcagtgaaatacctggtatcgtcctgccaacgtgaagcattgaatgctttatacgtctccatcctgattgtttaggctttgaatgctgagaagtatctgcactttgttggtcaattgtagatggtgctaatttgtggggagtttttcctgcaacttccccctgtgccataatccagaggacctccctctgcccccagtgctgtaggctaggcagctatgggcctggctcagggctgtcgggcaaggattggactctctataggttccgttgggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgttacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactccgccatccttagcactggcttccttcctccaagttatcttatgcttcaagaaggctgctggagctcctgccatcacttctgcattccagacagaagagaggaaggaagtggggggcaaaaggcaaagcctcctagatgtcagactcctctgcaggcctttccttgaattcccagctaaccctttcagcctagtctttcactggccaccctatctgtaaaggagctggaggaggaa

SEQ ID NO: 95763 - DNA, 1065 bp, Homo sapiens
caagaccttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcgcttcttcctggatgtgaagcagaggcacgatggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttcctgaataaagaatgactggagagacattagttgtttgcacacatattaactcatacctaagggagaacagcttttagaacattgtcgatgaaagcaaatatcagctttaaaagagagaggacagaaagactgcagatagtctggaagcagcatttttaggccgtctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccgtggctcaaagggaagtgctgcagaaaaacatttggctgttaagtgttttggccccaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctatgcccatcttttctacttagatagatagaaataggtatcatcgcttccatagacataattaaagaaaccatacaatttacacatacactcagagtggtggttctt

SEQ ID NO: 95764 - DNA, 1567 bp, Homo sapiens
catgatgctcagaggaaatgttcattacagcattttggatttgggatttttggattaagaatgctcagccgaggctgggcgcagtggctcacgcctgtaatcccagcactttgggaggccgaggcgggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaaaaaaaaaagaaagccagtaggtgtaatgcagatattccaaaatctaaaaaaatccagaatccaaaacacctctcttcagaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactatgcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctag

SEQ ID NO: 95765 - DNA, 1089 bp, Homo sapiens
ggacacaagtatgcctatgttattagaggtctgcaggtaaggcacgtaaagggtcatctttttccagtgtcttcaactccatttctctgaggttccatcagctacattctgtgccatgactttatcctcagtgcatttttcggatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtctgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgtgacaaggggtatttcggggagacaaccacagtgaccactgcacctttatagcactcctcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcc

SEQ ID NO: 95766 - DNA, 1827 bp, Homo sapiens
aaagtggggcaggcggactggatgagtggcagccagaggactgagttagcatcctttgttcttccaagtacggagacagcagtttattttaattcaactcatatttcattttagtcagttacttatgaccaagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcacaaccatcaccaccatccatctctagaactgtttcatcttgcagacctgagatctatacctgcaacaataacgcacaaccatcaccaccatccatctctagaactgtttcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagtagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataaccctgctttttattgttcatacacctgttaccttcaagattccaagggtgcttagcagatttttctttatttttttgttttttgttttttgagacagggtcggttttttctgttgcccaggctggagtgcagtgacgtgatcatggctcactgca

SEQ ID NO: 95767 - DNA, 1054 bp, Homo sapiens
attctaggctttctcatagggactgatttaatcttagacacagtaaataatcatttaccttagtggaaaatggtaaaagcttcatctcctgtgaacatggtattgggaaaacactatttccagccaagaactgccagtaataccttatattaaattcattccttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgccggcttcctcgcccattgctataaacttcaaaggtggatctgcttcctttttcattgttgcagattgtaaagactgactgtggctctgtttgctttttatgtgataaaataaataataaaatataatgaatataaaatctgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatcttggtgaggataaactgatgacagattcagacttcttttattagtttgctttattatttgcacagtactcgactgccagtgcagtagtgtttgaaataaggaaatagttacgataaatgagggtaggaagcaatctcattcccacggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccct

SEQ ID NO: 95768 - DNA, 1019 bp, Homo sapiens
ttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttataccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtggtcgggagttgggtccaaggggtcaattcaacagaatggcatagcgttaaagatagctaaataaaagcctcagctttcttcatgtattgtagcagataagaaagctgcagcaggaggaaaagtcagaaagaatagagcaagtcttttcttagagatctt

SEQ ID NO: 95769 - DNA, 2997 bp, Homo sapiens
ccggctaactttttgtattttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttacagtgatgtcatctcttcacctgacagacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctcggttcttcagtgcatcactgcttgtgcccacctggttaaaaattttaccattccactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctggtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttatatttatctattttaaaatttttatttgtggtaaaatacacataacataaaacttatcaatttttaagtatgcaattaagtagtgttaattatattcacactgccgtgcaaccaatctccagaaatttttcatcttgcaaaactgacattctatagccattgaacaactccctgtttgcccctcccaccagcctctggcagccaccattctactttctgttttgatgaggttgactgctccacattggtttagctttgtattgattactgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttatccttctccactgctctgcagtaccacctctattatataagttaagtgcctatacacctgtgtttatttctgggctattaggttttgctggtctgtttttctgtacttgcaccaatactccattgtcttatgagtcttgttatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaagactgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttct

SEQ ID NO: 95770 - DNA, 1641 bp, Homo sapiens
aatgctgatgcttgaaagtaagatctttggcatttatgcttacactttgcatgaggaataagttgagtacaagacgttatgccatgtctttagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggcttacgcctgtaatcccagcacttcagaaggttgaggcaggaggattgcttgagtccaggagtttgagaccagcctgggcaacacaggctgttctccatgaatgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacttagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggatttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgtttggagcatgtttaaggtaggctaggccaagctgtgttgtttggcaggcaaggtgtattaaatgtattttctttttcttttttttttttttatgag

SEQ ID NO: 95771 - DNA, 1022 bp, Homo sapiens
tgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccatctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgattcaagtcatttaactacattattgtgtattgcttaatcagcttcatggattgttgagccagatggccgtgttttatatatagccctgcgacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttca

SEQ ID NO: 95772 - DNA, 1036 bp, Homo sapiens
atatggatttgtgaatatattgttaaagatgtattattctttagtataattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaagagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaattttttttttttttgagagagtcttgctctgttgcccagcctggagtacagtggtgcaatcttggctcattgcaagctccgcctcccgggttcacgccattctcctgcctcagcctcccgagtagctgggactacaggcgcccgccactatgcctggctaattattttgtatttttagtagagacagggtttcatggtgttagccaggatagtctggatctcctgaccttgtgatccgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttg

SEQ ID NO: 95773 - DNA, 1030 bp, Homo sapiens
gatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaagtaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgcttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggt

SEQ ID NO: 95774 - DNA, 1314 bp, Homo sapiens
acatcttatcagtggcatcttatattcaggggatataatattgttctcattataattttgttacttgcgcaaagttgaagtgaattatgtgtaagatttcctctaaaaaaattctatgggttgcaacagcctcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggcgtttcttagttataaatgccctacttccaaaatttctgttagttttttttaagtggctatatggaatgttaagctattttaacataggaagaagttgaagagtggtgtattaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttctttttttttttgaatgcctagagagagtcggctgggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcatatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaaga

SEQ ID NO: 95775 - DNA, 1045 bp, Homo sapiens
ggagaatggcgtgaacccgggaggaggagcttgcagtgagccaagatcgcgccactgcactccatcctgggcgacagagcgagactccatctcaaaaaaaaaaaaaaaaaaaaaaaaaaagaataaaaagaattattattgctctacatagttgccaacatttagtattgattggctttgacatttatatttctcagtagctttaatttgcattttcctgatccctaattaggtagagcatcttttcatatgcatgttgcccatttatgtttccccttctaggaaatgtctttttgtcctttatatttttctattagattgtctttttttcttcaggtttttacaagttctttcaaagagacttcctatactagtccttgatgtcaagacattagtctggtagtaagatgaataaaatgaacttatttgtcaggatagatattgttgccaacttcagtcaggataattgggacagtggcgagtctaaattaaaatttttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtacgcgtcttattaattgttaagatgagcattaggagcaggagattttgtgaatgttctgtcttgtgcctggatctttctttgccttgaatcaggacaagtcctgagggtagtcatggaaactaccatggctatttccctacttgtaccatattagtaattaaccactttgtaattattacataggaaaagggaga

SEQ ID NO: 95776 - DNA, 1021 bp, Homo sapiens
aggattacttaaaatctaatacatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaacccatatgcaggttctgcagggccagttgcaggacttgagcatgcacggatttgggtacgcatggggtgtcctaaccaatcccctgagtattctgagggccttgactgtacttttcagcctgccacagtattgcttattttatttttttttagatgttgtttgctaattgattcttattttcaaatgttttctacatgttacatgttttctttaccaggatgactatcaaaattaagtttcattttgttgccttttagccccccagaagttgcaagtagaacaagaggaaaacaggtgacttttatttagactgtgcttttatgtcaaacacttaaaacaatattatttactgttctgcttaataactttatgttttattctcttataggtttagtttcaggcattctacatctgtttctagtctagctgaaagattggttgtctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattctttttttctcgacaatctcacaactttcatataataatatttgggataccagctttttatcttgatgcataaggaatctttatttgccatttaattggaacatttgaggctgtggctatgtaagctggtctctgagaatggagaactctaatcacctacatacacacctgaaatcattgtgatactcagatatcagaaatgggtggttttggcaaagtctaaaagcaataatataaa

SEQ ID NO: 95777 - DNA, 1264 bp, Homo sapiens
cctacataaagacccgcatgtatgtgaatgtctttggggccaggtgcggtggcataatctcagcactttgggaggccgaggagggcggatcacgaggtcaggagatcgagaccatcctggccaacatggtgaaaccctgtctctactaaaaatacaaaaattagctgggcgtggtggcgcatgcctgtaatcccagccactctggaggctaaggtgggagaatcgcttgaacccaggaggcggaggttgcagtgagccgagattgtgccactgcgctccagcctggcgacatagtgagactccgtctcaaaaaaaaaaaaaataaataaataaataaagcagctttggtcatagtgaccacaaactggaaccaaatgttcatcagtttttgagtaggtaaacaaagtttggtatgtctgtataatggaatactacttagcatgaaaaggaagaaactagtgatccttggagagacgtgaatgaatctcaaagacttatgctaagttaaagaagtagcacaaaaaagactacatatcatatgattgatttacatgatattgtaggatagacaaaactgtagagcaagaaaacagatgaattgtttccagtgctgggtgtaggaggaaaggattgactacaaaaggaacaagggaactttttggtgtgatgaaagtatactatattgtgagtgtggtagtggttatgtgatacaacatttgtcgaaactcacagagctgtacacctaaaatggatgaattattctatgttataattattttctagttatacttcaattatgtagctaggtgtggtggctcatacctataatcccagcagtttgggaggctgaggcagaaggattgctcgaggtcatgagtttgagcccagcctgggcaacacagcgagactccgtctttacaaaaaataaaaataatataaaataataagctgggcatggtggtgtgtgcctatagtcctagctactctggagactgaagcaggaagattgcttgagccaaggagtttgaggctgcagtgagctgtgattgtgtcactgcactccagcctgggtgacaaagtgagatgctgtctctgaaaagagaaaaataatgttaattttcttcctttgcagagtattgcactgtacatacttggtgatgagagcttggtttctgatgaatcctcacagtatttaaccagaataactataggtaagttggtgcaatgttgcctctggaaacaaatttttgtaaatgtcagtatc

SEQ ID NO: 95778 - DNA, 1732 bp, Homo sapiens
ttggttagattctttgtatgccttgggaacaagaatttgctaaatttccatccagggtgggataaaatagaagtcatttaaattctacatttaataacatagttccttatgtactgtggcagaaaacatgaagcattttggagaatatggaaaaacgttattcttttttttttttttttttttgagacagagtctcgctctgtctcttaggcgtgatctcggctcactgcaacctccacctcctgggttcaagtgattcttctgcctcagtctcccaagcagctgggactacgggtgcgcaccactaggcccagctaatttttttttgtatttttagtagagacggggtttcaccatattggccaggctgtccttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttggtatgtatgtggagtgttactacctatctcctttttcttttaaaatttagttttaaaaagtacacctgatattaagtttttttctgtgtatagttctgtgaatttcagtacgtgtatagattcatgtaattactacaatgaggatatagaacatttacatcaccctcaaaaatttctctcatgatttcgagacttatccaagttgtttcctgtatcgacagttcatcgcattctatggctaattagtagtttattgcatgaatgtgccatagttggtttttcattcaagatagttgggttgatttcagtttttagcaattgtaaatatagatgctgtcagcattcatgcttagcgttttatgtgaacataagttttgctttctctaggacaggtacctgggagtaggattgatgggtcatatagttaagtttatattttgtttttaaagaaactgtcatctgttttccagagtggctcttccattttacatttttaccaccaatatttaagagatcatttacctgcattcttgttggtgtttggtattgtcactcttttttatttttgtctttctgagagatgtgtagttatacctcattgtggttttaatttgcattttcctaatggctaatgatgttttcagggttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttaaaaagactatcctttctcta

SEQ ID NO: 95779 - DNA, 1509 bp, Homo sapiens
gtccaatcagtctgaatataaaaatcagttgattattagattatattactagccccggcatcttatacatgtggaaagatgaatacaccagctgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaaggtcatgaaaatattttttttaatggtttttaaaggtggcttgccttaacgtttataactggcttgctattttatagttacttcattcttagcattgtcttttttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaaggtaaatttgtttgtaggttagaaactgccaggaagtcctgagatgactgtcttttccatataggaaccttgtatcatatagggaccttgtaaataagtttctgaaatctaccttctcagaaaactagggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactggctatactgcggtgggagttctagaataacatctgctgttttgtaatatccacattcaaatagtgctttatagttgacaaaatcatagtttacatgtaaagtctcaaacaaggtaagtttcctgttttagtgatgaggaaacttgcctaaatgtctttcctgggatgcgagtgtttgatagttgtggactcattttgctatgctgtccttgttgcagtctgaggttgtccctgtctttgaggcactcatagtagatccacaataagatagttctaataatacgtttcaacacctttcaagagctttgaagcacctggtgtatggctcagaattctagggtcatacttgtgtgttgtttgacctttatgacctttggtgataaagaagttgaatttgaattgaaatgtcaacctctgagttaagacatagtacattttctaatttctgttgtcttttttgagatct

SEQ ID NO: 95780 - DNA, 1098 bp, Homo sapiens
tgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgttgttacaggagtaggagagggaaggaaactaccattaaaatcagtccttagaagcccaggcactgttctagatgtttgcatatattaatatgatttcatttcatctttacagtaacctggaagaaagatatttaaataatgcctttccagatcaaaaaatgagttttgatggcttttctcagttttcgtaattggcagaactgatttctgaatccttgaagttgatcagttgacaggaatgcatttacgatttttatcttttcttttggggttacttttcagtttgactttgaaggatcactttctcctgtcattgcgcccaaaaaagcaaggccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctgtggtctttaatgattatctaaaaattaatacatgtattactgcatgatttcagtttgggtttgtagacattttagtatcaactgatcacctgaaatgacagcatttaccttttttatgcagtgttttttaaattaaggttctcaattgtatcaggttccatggtatattcctttttttttttgagacggagtatcactcttgttgcccgggatggagtgcagtggcaggatctgagctcactgcaatctccgcctcccaggttcaagcagttctcctgcctcagcctcctgaatagctgggattacaggcgcccgccaccatgcccagctaatttttgtagttttggtggagacagggtttcaccatgttggccaggctggtctcgaactcctgacgtcaagtgac

SEQ ID NO: 95781 - DNA, 1053 bp, Homo sapiens
cttttcttattttaaacaattgtatccgagtgacattatccccaatttttctgttctttattacatgtgaaaagattaagcctcatagaaactggatttctacattatgaaaaaacgcgtcagctttctgtagttttgtgtatcattgtccttgtaacttgttgatgagtacagattgttgtgtcctagtctctggcagagaacctatgccccttcgcgtttccatgttttggggaggactgagcacctacccattttttcctttgcagagaaggacatggctttttgacttacttattgcatgataattataaaggaaggaataaggaaatcaattcttgaggccaagttgctttgctatttatttataggactgcatggttaaacccttgttatcttttgtcctcatagtcaaagcttaggataaaatggtcctcattggcaaatggttttcattttgctttgttcagatttattctttttgttttcacatatgtaatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttccgggctgctgtttttttccttagataaatattgaatccctgctgtgggccaggcatgatgccaggtttctcacatataccccagacaaaacagattgttcctctggaattgactgtcttgggggaaacaaataaataatatttgataaatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggagtttgtgtgtgttacattttggttgaagttttaggttagatagttactgttat

SEQ ID NO: 95782 - DNA, 1223 bp, Homo sapiens
ctgggcaatggatgtaaatcaggactgtctctggcaaactgggctatttgattactttatttctgatgcaaaattaatgatcaaaaagctgtccttggccgggcacagtggctcacacctgtaatcccagtgctttgggaggccaaggcgggtggatcatgaggtcaggagtttgagactagcctggccaacatggtgaaacatggtctctactaaaaatacaaaaattagcctggggcagtggcagacgcctgtaatcccagctacttggtggctgaggtaggagaatcgcttgaactcaggaggcagaagttgcagtgtgccaagaccgtgccacagcactccagcctgggcaacagagcgagacaccctctcaaaaaaaaaaaaaaaaaaaaaagctgtcttcagacccctttcaagccttgttgaattcagtagttggttttagtttcagatgattggttaggtaatgtttgcatctcattggctctttaatgacagttttcttttcataataattggcctttacatagtagaagttaaaaaacttggtgattgaaaggggaaaagaaatgcatgcagagtaagaatactaaaattaatctttgcttttaatagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaatgtaagtaaatactattgttttctttatgagttattctgttaatgtaatggttgcataattggtaatataacattgagactacataataggcgtaccatattcaaaataatagaataatattaaggtttattgtatctatatattgtaaataaaatctcacttaatatttaatattaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtggttttttaacaactatgactagactgcatcttctgactccttgtttaacattgttttctgaagacaagattgtctttt

SEQ ID NO: 95783 - DNA, 1039 bp, Homo sapiens
agtacacaaacattgcagtttgggattatttactactaaaagcagatttgggtctcttcacagtggtagccctggccactctgaggggatcattgtatgacagtgtagtgctataattgatgtggagccattgagaatggtataaggccaggtgtggtgggctcatgcttgtaatcccctccctttggaaggctgaggtgagggggttgcttgaggccaggaatttgagaccagcttggacaacatagtgagactctgtctctacaaaaagaaaaataaaattagccaggcatgctggcatgcatctgtagtccttgctacttgggaagcttgagctggtggaccacttgagtccaggagttggaggtgacagtgagctataattgcaccactgcactccagcctggggacagaggaagaccctgtttccccttaccaaaaaaagaatggtgtaaattatgtggtattaactcttaacccttttaagacagagagcctgtgaaacattttagaaactgaacgacctcagaaataaagttataaagctttggttaataggcatgttaactcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttttttgagacagagtttcgctctagtcatccaggctgaaatgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctag

SEQ ID NO: 95784 - DNA, 1838 bp, Homo sapiens
aggtgggcagatggcttcagcccagaagttcaagaccagcctggataacatggtgaaaccctgtctctaccaaaaaatacaaaattaaccaggcatagtggcatgtgcctatagttccagctactcaggaggctgaagtgggaggatcacttgagcctggtaggttgaggctgcagtgagctgagatcatgccactgtactccacccacgggaaaagagtgagatcttatctcaaaaaaaaaaaaaattataccaacatatttgcagttggatagtggaattggatagattattgacatttgaattgtttctttgctgtgtttggtgagtataaacttagaaatatcaaaagaaatatatgtttatattccttaacattttatttaaggatatgatgcattaaaggcaatatttttttttccacatgtttttattgcttaaaggtgggaaaggtttttattcctggactgccagctccctctctgacgatgtccaacacaatgcctcggcccagtactccactagatggcgttagtactccaaagcctcttagtaaactccttggatcattggacgaggtaagaaaaggactaggtgttgccaaaaagttaacattttttaaagaagtttggttaaacattagttctttccatggttaacttaattttagtttctacttgcagaataaatgttttcaaacagaagtgattcagttaacatacactgacctcccttgtgatgtatgtgatactttttgaaggtgctggagagatggaaatgatacattcttttccatctagggatctcacaattgtgtggagttgatgtactgtctgcataagaaattagaatttaagaaagactcatgactcagtaatgtggaaaagagagtaccatcgttgattgactgatgggaagataacatccgatgggaagataacatccaatgggaggacatggcaaaatcaaagcctcactgagagacatgtcagtcttcgtttggaccttggggttgagtaggatatctgtaggtagaaaggagcattcagggcaaggagaaaccacacaggcacaggcaggaaggccagataatgtggaacattttttagtggatatttgtatcttcatctcctagtcataaggactcaataaatctgtagaataaatacttataaaagtacaagtagtctgtagggtgaggcaggatagggtttggataacaataataaccttttttgagcattttctatgtgctaggcattgttctcagtgctttattagtattaattatttccttagaatagctttattgagaagatagtactatgattcttttttttacaaatgagatagaagttacaaatgaaataaacctaataagtggtagaactgggatttacactcttactaatgtgctcttaaaggcagaaaggataaaaaggtggttttattctgaatgcaattgacagggcattacaggattttgagaaaggagttatgaggttttggatctgtgttgtaaataggtgtattttgggattaaagataaggagaccggttagcctccaagtgaggttgtctgtgtcagtttaagaagtatgaagagggtctgagctagggcagtatatgtgtggaaaggagggattaatatgagaggccttgagaggtggaaatgagtttgtcagctgattggttttgtgctgctgggctggggaaaggtgatgtggaacgaggctccgaattctctgaatgacctgggaaggtacctggatttaccaagttaggaagcctggagaaaagtggtttgtatttaaaggacatgtgagtgtggatgttta

SEQ ID NO: 95785 - DNA, 1045 bp, Homo sapiens
tgccttggcctcccaaagtgcggggattacaggcgtgagccaccgtgctcagccctgagccacttttactaagatttctaagtttaccatgtcacattctttcctgagtcatattttgaagctgcctatgcttgacctaaggttagttgcctcatttctaccactatgtgggcaacagtttgatgaatattaattcccaaaatactgtggcactattttatttttgccttaatttatgttagtttttcttttttttttacttgttatttgatatgtaaatgtatctatttctctatatagatatatatttaaatgaccagatatgtatatctggtgctacagggacattgttttgttgataaatatatatgtctgactatacagggacatagtttagagctttttgaataatcattcattttccgaaaaagaagatgatctaagttttagttgtaaaagatgagttcttctaataataattctaaatctttagaatatagtaaagcacattgacatgaaccatttaaatagctactcctttttgaaaaattttaatttctgacctggattatgccatgaatgctcttctgtctgtggaatttttggaagtgtcattggagtgtgtgtcatataagcctgccttgctaactgtgatgtactctctcctctgtttattttgcagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataaggtttgttatatatattattatattcaaagaaaaatgttgctgaaagtcttgggaaatatatggcattttgtttaaagtttccttttaatgtgatcagttattaatatatgtaaaaatatatagagatatgtattaaggccacctcagtttcag

SEQ ID NO: 95786 - DNA, 1545 bp, Homo sapiens
tagtcaggatggtctcgatctcctgacctcgtgagccgcctgactcagcctcccaaagtgctgggattacaggcgttagccacctgcccagcctcgaatgatgaaatttcttaatggccttgtccttgggcacacgtcgggcacagtttgtgcaacgaataggctgcatgtggctgtgcccctttttggcatgattgttgttccttcttttctttgtcatcttggaggcacggactggagggaggagtgtagccattattgatcatatttttgactaatatttagtgaactagaagttgcttatttgtgatgtcaagtaggatacaaataacacagtatgattataattttgtaaaaatgtataaagtgtgtatatatgtatgaaaaaaaccaaaaattctctaatgtattaatagtagatattttgagatggtggcatgatttttatttataaagtatttcttatgattatagaatcatattttaaaatttttcagtattttaactgagtgggaaacatttcctgtcaaataaggatatggagaccagtccatggtactttagattaaaagctgaactcactgggaaaaaccttattttgcatgtgtaactagtaaagcagaaacaacagtgtactgttcggcactgtctgaatagtaattatagagtacagctttcatacagaaaaacagaaccaataaggaagtcaaacttggcagaatagttgagtgcaatttataaataagtcagttgaagaaatcatcgaccttttacctgtggctgattcgtgtaatggtgagagtcagcacaaatcttaacatttagcaacagcatgtatgtgaagctaaaacttgtaatgctctcatctttaatgtattttaaggaagttgatgcctaaagtaaatttattaaaaattcagagttaattatttaagatagtaataaattttgtgctctctttggcttggttgttctttatctttaacaattttaagagctctgttcataaatatcagtcttgtaaagcccattgttctatacctgatttttctattttatttttaaggtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggtaaggagaaaggcaagtcacttctccttaataggaaagggtaggctgggtgcactggctcacacctgtaatcctagcattttgggaggccaaggcaggcggatcacttgaggtcaggacgttcaagaccagcctggccaacatggtgaaaccccatctataccaaaaatataaaaaattagccaggtgtggtggcttctgtaatcctatctactcgggaggctgaggcaggagaatcacttgaacctgggaggtgtaggttgccgtgagccaagatcatgccactgcactccagcctgggtcacagaatgagactccatctcaaaaaaaaaa

SEQ ID NO: 95787 - DNA, 1036 bp, Homo sapiens
cccgtcttcgctctaaaaaaaataattccttaaaaaatgtaggcttctggccaggtgtggtggctcacgcctgtaatcccagcactctgggaggccgaggcaggtggatcacctgaggtcaggagttcaagaccagcctggccaacatggtgaaaccccgtctctactaaaaatacaaaaaaactagctgggcgtggtggcgtgtgcctgtaatcccaactactcgggaggttgatacaggagaatcgcttgaacgtgggaggtggaggttgtagtgagccgagatgatgcccctgcactctagcctgggcaacagagtgagactccatctcagaaaaaaaaagcagacttaatttacttgaagtagtttgtttcttccttttttaaaaaatgcattcctttgtcagcagatatgggagaataaatttctttcttagctgccaaagacacactgccagtaagagaggtcaataaaaaaagaccgctttatgcacattactccatttgttctgtactgtgatgactgctgtttgcagaaattccctggctatattgatttccctctgttcgtgcattgatagaattactctaaggggagagatttctaggaatgaaatagaagacaatgtgaaaaatagtatgtacaaagtttagaagattgcattttgagatagtaggtttctagttgctcatgtaatctggagatttcttttcaatagaagtgcaaaatttgtgcacagacatactcgtattggtaattaattgattatttgtttattgctagagaacctttacctactatgttcagcatgctgcacccactagatgaaataactccacttgtttgtaaatctggaagtaagtgtatttctatattcttttagataagctcttttttttttgactttggtgagggaggttataaaggcgcttatatgaaaactgacttataaaaataatgtaaacattttacaaaaataacttctattttgactttcttgaatatcatggtattaactgctcaacagttatttta

SEQ ID NO: 95788 - DNA, 2109 bp, Homo sapiens
attttgtaagatgggcttttaagaaagggaggagttagtttttctaaagactttttcaaaagtcagtctagagagagtctaagatcagttgtttaatctggagattataaagtttgaataatctttagttttgtagaggatatagggtttagtatggtttgagctactatttgaatttttgctgcaaagtttctatctggtagattttttgattcttgtcttctctttttgtaaaatttatttttttaatttaaaattttaattcctatggatcttttcataaaatttaattgtaaacatattttgcctttccttatcatatttatcatttattactctaatttattttttcttattctttttgttcccatgattgtacatgttgagctgaggaggcaaagttattacgtagatgctattattattatttagatgccattagttaatagatgattatttagatataattttcttaggtaagcattttgttttgattttaggcattgtggtgtgacttcattatatcacaggataagtctgaaaaggcctacagtaagtttctttttgaaattttatttttcttatgatgattccaaatatttatctcattgtatttttcattcaaatgaagtagccactagtaatagtggtttaccataagcatctttatattgtgcattaaataatttgtgctgttaggattgaactcctttgagggaaaaaacacataagtcttgttgtaccctttcttttcaggtagcaatgaagtagaaaaatgcatatgtatattgcaaagctcatgtattaacatgcatagcatagaaggaaaggattacatagcttcattaccatttcaggtaaacaagtgtttcaaattttgggggggttttgttggagaacatttttgaattaattggttttagaggcatgtcttatgtctcatgtttcgtagtagtcaaaaatgttatttttactcaaaataactaaattttggcagctttagtggcttaccatttttctgtacttcacaagaaaataagttatttagtgaagtaaattaggaagtcttctgtggtatgtgtttgttggtttaaatgatacctaagaacttttggttatattaaataaggcatatgaataacaccagtctttttttgttactcatcgtctttttaatgcctagggctattgttaacacattgtcattttgttactgatcctggccagtggcaggaatttcacattgaacaactcctctttattagatttgattttatcttagagttgcttatttgtattactttttaagaaaataccgtatttaatgattatgttactttgtaaagctattactaaattggaaaataaaacattctgtaatgtttctttaaaacattttataaaggggtaggttctcttacttctatcttttcccacccttttacctgaaaggttgcaaatgtttggcccactaaatatggattgctgtttgaacgaagcgcttcttcacatgaagtacctccaggttcacccaggtattcattttattcacttcagaatattactgcttgggatttgtgtgtttgtgttggttctgaggtttatctaaaagtttgagatgatgataattttcatgttgacagcatagatatatgccattttctctcatctcagtacaagttgagtatccctgatccaaaaatctgaaattctccaaaatctgcaacttgttgagctccagcatgacactcaaaggaaatgcttattggagcatttcaggttttggattctcaaattagggttgctgtcatcaaaaagatatgtcatgatcaagtgggttttgtctcagggatgcagggatggtttaacatacacaagtcaataaatgtgacacatcacataaacaattaaaaaccatatgatcatctcaatagatgcagaaaaaagcattggataaaattcagcatcccttgatgataaaaacaaactaggcatagaagggacttaccacaaattaataaaagtcatatacaacaaacccacagccaacatcatactgaatggggaaaagttgaaagcattccccctgagaactggaagaagactaag

SEQ ID NO: 95789 - DNA, 1095 bp, Homo sapiens
agaaggtgaatatatatgtgattgcgaagcaggaagtctgcatttgtgtgtgaactccccaagtgattcccacgtgcacctcactgtcctttccctaccctacctcatatacttaatatgtccttttagtctcccaagcatgtgatttgacttttggaactatagagaaggtgtactttttgttcgtttttgtttttggcagagtaatatagaggaataatataaaacattcaatatagagaattattgagtaaattcttcatgtaattctgtagtgtaatgcatatatccacatcctccgttaatcagtgtaccaaactttgtaggagttgtgtttgaattgagtcttactccatgggcaaataaattttgttccagatttttgaagaacaaaaaaagagtgcttgaatatgttttacatgtgttaatttttaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggtgagttgatttgaattttagcatttgattcactatttaatgcaattaaaaaaaagttttgttttaaaatttaacagaaatgataaaaccagcctaatgatctcagcagctgggtgtacgttgtaacatgacataatataatgtgaagataatggcaggaaaataaaaatttaattttatttttatatcatcactttttttacactcttctttgtcactttaatggtaatctttaaacactctgtccttatgtaattcaatttgttattgccagcaaaaacctataaaacatgaagagtacagaaatattttaacacatgattactataattgattgcaaagatttgaataaataaaaatcgtgggattcataatggtagagagaaaggaaaaaatctgctttgcagccattgcagttggctgttataactaactgttctgaaagttgataatgaaagggaaagaattaagcatttgccatattttttcaggaagac

SEQ ID NO: 95790 - DNA, 1075 bp, Homo sapiens
cagttcaacctctgatgaattagagtaatgtgtggttttttattgttttattccaatatgacaatgatcccttagatgtacttttcaaatgaggttctggcatctaaccagaaatgaccttaaatgttgaaaagccatgtagttatgggaccatagaatacaacttgtctaaatacttcatatataaagtatggaaaaattagcgtatagtagtgggaaacacgggataggtggtgcgggacataagtacttgttgcatctcagtggtttcctatagtggtaactgtcagtctgtgactaaaatgtgataattgcaactgtctgaatcagatctagaatgcccttttatgttatgaccaacttatatacttaccagtctgatataattacttgacacccatgtaaggattaatgacttgtgtgtttatggtatttttattctagttttgagtctggaagctgaccagaatgtgtttgaattcatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggttccattgagtttcccattgtgtttttgaaatgtagagtgatataatctacttgtaatttaaggctactaagatgcaactgagagatcggtgtgatgccacttctagagtagagttaaggtgtggtaatttcaataaatgttgaaaataatgactttattacattgtcatagcgacttatttagataccctctataacttgtggttttatttattttttatttttcaatttttttgtttgagatgaagttttgctctttttgcccgggctggagtgcactggtgcgatcttggctcaccgcaacctctgcctcccgggttcaagtgattctcctgcttcagcctcccga

SEQ ID NO: 95791 - DNA, 1050 bp, Homo sapiens
tggtttaaatttttttatttttattttttgtgtttgttttgttttagggtttttgagtgtgaacatccagaaaattcttttttttttttttgagatggaatcttgctctgtcgcccaggctggagtgcatgtggcgcgatctcggctcactgcaacctccgcctcctggcttcaagcaattctctgcctcagcctcccaagtagctgggattacaggtgccctccaccagacctggctaatttttgtattttaagtagagacggggtttcaccgtgttgggcaggctggtcttgaactcctgacctcgcgatccacccacctcggcctctcaaagtgctgggattacaggagtgaaccacctcacccagctcagaaaattcttttcctttttaccacatcgagctaggttttcccaatgaggtcagttggctgcaacatagagaaaatgaggctttggttcttagagtagattccgtgtacaggcgtgagtatgtgtccgcaggtggtcttgtaggaaatgcaaagggcgccaggtgcactcctggcttctggtacttcctgcttaatggcatgggtgagccaaccctcaggtgcccgggagggagccctgattactctccctctggcactctgggcattggctaacccgtgaccggagttaaaccagttccctctcttttcattctatgtctcccactcctgcctccagccgaagtgctaaaaatgcagcctggcaggggcagagaattccattaggatcagcaggccccttttggagaacaaggatactaagaatacctgccatcctggcacttcctccctcctaggccttacttttctctgtctgaaccatggctgttgaactgggtgattcttagccacaggaagggagggcctagatcttccctagttttgtgagactctgcagctggacagccatcccttcatgggagctgccacattttcactctcggggcctctgacaggcactaggatctagggacatggccggcatgtgaaaccctgggctgctatggccaggtcacctc

SEQ ID NO: 95792 - DNA, 1043 bp, Homo sapiens
tgggcggctactctgggacctgagtgggaggctagtgatccaaggcagcttagcagcactcgtttatgtgaagttaaaattccactccagctgtttatccagtccacatgaggaagcaatcctggaagaaggtgggagggataaggtggagatttcttgtgaattccacccaaattacaaccagaggcaccccacttttccatgtgctgtgtagaaaggaccacatttgcattaagtctttgatgtgggtaagcctttcagtctgaattcatctgcaatcactacccaaaaataattttgagagtattccacttctgtgggggaaaaacagggggaaaagatacgttatacaaccaaagtaatagaaacaatgaaaaatttagcaacttaaaatataatttctaattcatcattgcccaaacccttgggtccaaaaccttggaatggtttttgttttggcttttttttcttcacattttgtataatcacccagtgcccccacacagggctggtgaggttatgcattgcacagctctagagaacaatttatacagccaacaacgatgtgaatggcaataccaccccactaaaattgtgcagtacgagcctcaccaatctcaccagccacgtgggggtccagcctcagtcccaacagttctcaagggttagaccatggaagatttttactaactcataataaaatgagaaaataattaaaataatagctaacattgagtgcttactgtgatccagacagtaataactcctttattcccgttggcaaccctatgaggcaccatggttgccatccccactttccctgtgagcaaactgagcctgagcagcctcgagccaccagctgtccactcctgagaactctcctttatgccaggatcgcatctttcctcaatatctggtgtcagactgactttcctttgtggaacactggtggtagtgaggatgctgttgctgtcagccccctcttcttggtctcctgtatccttcctactcttcactgactgcccctgtagtcaggtcttcac

SEQ ID NO: 95793 - DNA, 1635 bp, Homo sapiens
gcccccggctgggcagcacagtaggagaaaaaagacccaccacatgggggcttcatcagggaacgttacaactctaagatgaggtgaagatcccaaaagcttccagagagaacagaagcagatcacttatgaatgaatcagaattacatcctgcttctctagagcaacccagaactcaaaggaaatatatcagtgacttcaaagttaaaacaaaaaatattttcctttcgaactctgtacccagccaaactacctcaaggtgaaggtaggaaaaagaatggcattttcaggcatgcaagtcccaggaagttagtgacggataagctccttgccaaagtaaaagagtaaaagccaaagagagtgagaagcggggagcatgttccaatgaaagctgacggctcttgactaccacaaccccgccggtttcaactgcaaagatgaaacagaatttagaaacttcactgtttggcttgaagaccagaaaatcagatactacaagactgaagacagaggtaatttaagaaacatccacagcagtgactggcccgagttctttcaaaagtatctcagagatgttaactgtcgtttaaagattcaagatcgacaagaagctattgactggcttcttggtttagctgttagatttgaatatggagataatgctgaaaaatacaaggacttagtacctgataatgcaaaaactgctgacaatgcaactaaaaatgcagaaccattgataaatttggacgtaaataatcctgattttaagcctggtgtaatggctttggctaacctgcttcaggttcaatgtcatgatgattgcctggtaatgcttaaggcaattcaaattttggttcaggagcacctgacacaggatgcagttgctaaagcaaatcaaacaaaagagggcttgcctgttgctttagacaaacatattcttggttttgacacaggagatgcagttcttaatgaagctactcaaattctgtgactgctgtatacagaagagctcagacagctacagacaaaaattaatgaagccatagcagctgttcaggcaattattgctgatgcaaggacagaccacaggctgggaaaagttggaagatgaacactttaggacttcagcttttcacctatttagtctatttagtacaattgggaaccatgtatacttccggcatgtttggaaatcaatatatcacattctcgggggaggaatcccagaaaattgagtaagttctagaggtttaccaccattacttttttctttaataaagtttaggaaagtagaaaaaaaaaagagtagaagccaagaaagaggacctgggctctaggaaacaggagctggaccacaggaggcatagaggatcctcagaatagtagtaaagatagctggaccccagacccagagggaacctgattagacagaggcagaagggaagaagccaggacaggcatctcctaaataaataaatgaatatcagtactgataattttgttgtggtgtgaggagatgcatacattcctttagagaagaatgagtgattgatacttaggaaactattaaattcaagataatcaaaaagctactcaagaatcgctatggggctgggtgcagtggctcatgcctgc

SEQ ID NO: 95794 - DNA, 1066 bp, Homo sapiens
tcttacctgtggtccaatctttctcgttctcatccccctaccccaccaccatagtgagtgatgctccaccttgtgattaaagaggttctcctaaaatacagagcttctcattcctggcatgactccccactacatgcaggttaaaatctaccattttaccctgaagtctgagacccattggggcttcagcctaactttcccacggtctccgcctgcctcacctgcaaaggcacctgcttgtgagacctgatgaacttttcgcaggcccatgagcgactgtgccttcttgccaagctgccttctcattgtctggcaaacccctgttcacttgacacacagatcacggctctcctctgaaaaccttcctggtcacccccttgtctgtatattcacaaggcctcttccccattgcattgaagaacaaaccctctatctatttgtcaggcctccaagaagacttactaatcaagtgattattatgtatgatttattagttaggttagccccatcacccagcacagtgcctggcacataagaactatgtgaatgaatgaatgaactaatgagcaaacaaatgaattacaaatagtccccgagttttaggtcctttcactgggacaaagggacatcatgataatgaagtaacttgtatttataaaattatttttacatttaaactcttatctcttttctcatttatatctccagctggtcctgtaaaattaatagaacaggatctttaatgtccattctgtagacccaaagggctaaaacaagtccagggaggaagggcgtggggcccaggctgctgactgtggggattgtgctgggctcacaggggttactctcaaaagtcagctagttgctgactgttcccttgtgtctgcgttttgtaacattataaaagaactacgtaaaaacttatttttaattaatttttttttaattttgaggaagctttagtttgatacctgagtcccttccagtaattcatgtatgaggaactaggtgctgaggtcagctttggggggccttgtgcagagtagctgcccctgacatgctgatg

SEQ ID NO: 95795 - DNA, 1077 bp, Homo sapiens
tgagtatttccacatcttttccagttcaaaggtctcctcatttcattagtgaataggaaagtgggtctgcgttcacttctttggcccttcactggaagacttctttggcccatccataggctaacacaattaccctcaggcatagggaggctcctcttgaaaacatgtttccctttactaatctcaaggaacgaaaacaggtattaatgcatttgtttggtagctgtagcctgtcatctataattgtgtttgtgtgtgtatgtgtgtgtgtgtgttttgttttatgcagcaattccctccccaccaactgaagtcagcatccgtaacagcactgcacacagcattctgatctcctgggttcctggttttgatggatactccccgttcaggaattgcagcattcaggtaaagttccagggtgaagagggaagtagctgtttggtgctctctgtgggtttaaggatttttcttccttccaaggatgggcatggagggcatttctccatctctgtacagagtcccctgacctccctgcttcagtgtccagcatgcatgcactattccatgtccatgctctgcccatgatactgtgtccttcctgtgcaggattcagggctcagtcagaagcaaaacgtgtttccaagggagaacatcatgagaccagggagagttcttcttctttttttttttgagacaaagttttactcttgttgcccaggctggatgcccaggctggagtacaatggtgtgatcccggctcaccgcaaactccacctggttcaagcaattctcctgcctcagccccctgagtagctgagattacaggcgtgcatcaccatgcccggctaagtttgcatttttagtagagatggggtttctccatgttggtcaggctggtctcaaactcccaacctcaagtgatccgcccgcctcggcctcccaaagtactgggattacaggcgtgagccaccacgcccagccaagaccagggagagttcatttttaaggtcccgaaacacatgcttgtgaccaagagttgaggaacccaggcactccccagtgtggctccttctgggc

SEQ ID NO: 95796 - DNA, 1051 bp, Homo sapiens
gtggtgcatgcctgcagtcccagctacttgggaggctgaggcacaagaatcgcttgaacccaggaggcagaggttgcagtgagccaaggttgcaccattgcactccagcctgggcaacagagctagactctggctcaataaataaataaataaataaggaatgttttattatacaggactttatttcattttaattatcaagtgaaagaaaacacgctgacaatttttgtacatactatgttactcctttttcagtacatagcttgggagtcagtgaggaactacaaaataaactagaagatgttgtgattgacaggaatcttctaattcttggaaaaattctgggtgaaggtaagcaatttaaagtaattcttttaaaatgtgggataagaaggtagcagtttagaataattctttaacatatatttattaaataaaatagcatctcaggactctgagttatactatggatagttatattttattatttaaaatgatagactattgatttttgaaactcagatctggcacatgaaaagattctcttcaatgcctagcacatacaggtccttgaaaaatattaattttctttcttcattgaaaagcatgtaattcattgagtagtttcctatgtactttaagtttattcctctagttcttaagttcattgttcttggcacctttctaattaggaacaaaaatgaaaatacgtatttaacttgttaagttgttcttaggatgaatgataatggtattaaaagtttgtgctttaaaaacttcaataatatttttcatgttctcttctaagtgtcttggattggttataatgcttaataaagtgatgagcaaaggtaggcccaagccacccaagctcgtgacaagcaggagactagagcgtggcgcatcaccctggtttgcgatgtgggtggcctgggcaggctctgcctggctgcccgtgggtgagttgctctcataccacatgaaaccagcagctctggcactgtagcatttctgtggtcagggaagagtttgcacagtgtccatacaggtg

SEQ ID NO: 95797 - DNA, 1048 bp, Homo sapiens
gactctctaggtacttcatgtaagtggaatcatagagtattcatccttttgtgacaggcttgtttcacttagcataatacagaattttaaatgtctctctcttaagccagtttaattcaaaaaatttggtatgaaaatgcatccaactcacaaggcgtggttgagcaaccagacttgcaggacatacaacaatagaaacagagaggtgtggggttctttctttttttaaaaaaagcaaatataattgcaacagatcagttagaattgttctttgttttggtgttggggttttttttttggaattttttttctttaccattagactttaactttgtagagcagtttcaggtttgcagaaaaattgggcagaaagtacagagaatgcccataggtcccctcctgacacacataatttctcctattattaatgtcttttattagtgagctgcattttttgcaattgatgaacccatactgatacattattattaaccagagtccatattttacattagggttcactcttggtgttatacagctctgtgggttttgacaaatgtgtagtgtcatgcatccatcattatagtatcatacagaattatttcttggccccaaaagtcccctgtgctttgcctgtttgcccctctcttatctcccctagccctactagcccctgacaaccactcatctgtttcctgtctctatactttcatctcttcctgacctgggttttagagaacagaactgctgttgcccacccactccccttaattgagtaaattatccatacttaaccttttctattttctcctctagtggacaactcttcacagcgggagatcgaggagtttctcagtgaggcagcgtgcatgaaagacttcagccacccaaatgtcattcgacttctaggtacttccgagaaatgcaggagtgggtggccaagagggctctgctgatctgctctgtgccaaaggaaaaaatctctggtgtagataagtttacacttcgtataaccccaacataacttataacattgaggttttcaccc

SEQ ID NO: 95798 - DNA, 1131 bp, Homo sapiens
tgtaacattttactccctatgttgacttacccaccatgagcactgtgaagccctgggaatgttggatgtagctgtagaggcagttacggatcatctaggaaatttaggaccatggagacgcttgcctttcttcagggtcaattttcagtattgactttgagggctgtagcgttaaggaatcatagccactggggacattgtatctttcatttcctaggcctccttatctgaaacaaaaacagtatcctcctgttatgttttgtggacaaacggtagactgcgagcaggcggtgtgtgtcctgactacatgcccagctaagcaggacgccccttcctgccttgcacgcatcttctctgttgcaaaaggcagcgatcctgcggggttctggttgggacacatgtgggaacagggtgtggctggcctctgtcaacagtcattctctgactgggcaaaaggcaaaagtcactccagatcatcactgcccttaatcacagctgtaagaaaccacaggtcctgggaaggaaccgaaccacccagtctacaccttggcattctcggacacaccccacctttgtccctttagctgccatcagtatgaggaccgctgagtgcagtggtgcaattaggaacaactgcttccttcactgcatcagcgatggctccaggaaagaattcttgctgctcttgcttgatggtctgatgagtccacaggatgaaagtgcaaggaaattagttcttagggaccatgaaaactcactcccactggctctgcagacaaaacacaggggaaaatgtcccatgcagcaccagtgtggtggagttctgcacactcccctgtatctacaaacctggggtgacagtggcctagggtcagccaggtcgcttttccaagtgaagcagtgccatgggactcactcacaaactattaaccaaaggaagtttattaagttctgcccaggtgcggtggctcatgcctgtaatcccagcacattgggaggctgaggcgggggaatcacttgaggtcagttcgagaccagcctgaccaacatggtgaaaccccatctctcatgaaaaaatacaaaaattagccaggtgtggtggcaggcaccagtaatcccagctacttggga

SEQ ID NO: 95799 - DNA, 1003 bp, Homo sapiens
gttgaagcagcccgaagactgcctggatgaactgtgagtgggcttctctgtctcccttccatactctgcatggggcagccacctggctctgcactgacctcggaaacacagccatgggaggggaaagggactgctgttagccaggtgggcatgtgcagaggggtggaacccacagacaccccagcccaggagccattcctgatgtgggagatagtgtgtggtatctccagtgagcccactgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagttatctttctccttctatgtagcatttcaaacactccactcacagtagtagccttcatcaggaaactcagaaatctaaaccaatgactttggggtcaggctgctcatcagaatcgcttgggagatagtgtaacaatacgattcctcggccctgttcccggaaattatgatgctttcggtacaaagtgggcccagaaatgtgtgttttagaatgctccctggggctgggcgcagtggctcatgcacgttatcccaacactttgggaggccaaagagggcagatcgtttgagcccaggagtttaagaccagcctgggcaacatagagagaccctgtctttattaaaaaataataaaataaggccgagtgcggtggctcacgcttgtaatcccagcactttgggaggccgacgcgggtggatcacgaggtcaggagttcgagaccatcctcgctaacacagtgaaaccccgtctccgctaaaaatacaaaaaattagccgggtgtggtggcgggcgcctgtagtcccagctactcgggaggctgaggcaggagaatggcgtgaacccgggaggcggagcttgcggtgagctga

SEQ ID NO: 95800 - DNA, 1065 bp, Homo sapiens
agccggggagcggggagcggcccctcctccggcccgacctgggctgcaggcaagagccgtcaggattgcgcatgggacggccctcgggtccgagcgctcggactgttactgagggtcaccatgcccgacgccgtggccctcattctgctctgacatgttttggctggatcaggaatctctcggcacatctagcagcatctttgggattcgactcttcctgtccggatgcagccacagtgggccacacccctgaggccgcagggaggacttgccagcgcttcagtttctgcataaacttagaaagcgggtctgccgcttccttaaaaaaaaaaaagaaagaaaaaatttaaatgagggggaaacgtgcagtagtcaccctacctctatttctctcttcttgagttcctgaatttctctacagttcctgtcacagttccgggagagagagtgtgtgtgtaggtggggcgggacttgtgattagggagtgcttgaaaggcgaatctggaggcatgagtgggtggaaactcttctttccaaggcaggctattagaaaacttggcgtctggtaattagaggagatgatgtgggagagatgcaggggcagaattatggaaagtcttgcaaaagagagacaggaagtctggaagaggcattatctccggcttctctggggtcagatgactcatccagcactgtttgggatgggtattttccacatgcatgaaataatgtccaggttctaaagatgagacttatattttgatttccttaaccagaaaaagaaagtagttccaaagactacaaatacttcccacaacacaaaagctactcagaggaacacgctgggtatctttctggatcttttaagacctagtgcagccatttcctccaggattggattcttctgggttggtgacctaatttgtgtgccagttatagtctgcacatctccattatttaatttcctgaacgggaaaaagtagaactcagtgaactactctcatggcttcctgctgctacgatagtgaatagtcaatataactatattggaagtgaatcagttgc

SEQ ID NO: 95801 - DNA, 1544 bp, Homo sapiens
tacggataacagatttatgagtagatagtcatatacactgtgatatacttgggatattactggagcaccaagggggtcacctaaccctgcttcctggaggagagacctgcctcagtctttttttttttttttttgagacgaagtttcgcttttgctgcccaggctggagtgcagtggcacaatcttggctcactgcaacttccacctcccgggttcaggggattctcctgcctcagcctcctgagtagctgggattacaggtgtgtgccaccacgcctggctaattttttatttttagtacaggcagggtttttccatgttgatcaggctggtctcgaactcctgacctcaggtgatcctcccgcctcagcctcccaaagttctgggattacgggcgtgagccaccgcactcggcctcagtcttaaaagatggataagtactaccttgatgaagaagaggaggggaacagagcagcagcagtgcaggaaattattggtgttcctgctacatcaagttctggcagggttgttagaggggactcaggtcaccacaagctttccatgcctgagcttggccttgagcctgaggccagaggcctcaaactcaaggacctgtgttggccaaggcaagtcatatcattaagcacagtgagctaagttcaggactggagggggtagtgaggaatgttgtggactacagattgcatgcccattctgaagagggcagctgccatttggcttcagcttactctgcatacattctagcagagtgggcacagaattgccacagctcgtttttttaagtgagactggaatccatctttttattatgtcaactaaagttttaaaaaggcctcttgtgggcccagtatatcccatttttaggttggattagacctccagactcccagtagctactttaggatgtgaatgagggagccattgaaagatcttagacataatgctaatcactatggctgctgtctaaagatgaattataggatcagatctggaggtagaagtaccagttaagctattgcagaaattaggcaggaaatgcagagggcctaaattagggcagtggtgacagagatggagaggaagaactaaatttgataaatgtttgtgagataaagtaggcatgccttggggattgggtgatggaagtggggaactggaaggagccatggcttgggtgactgtagatggtaccacctccagccaaggtggacaatgtaggaaaagttggtgagcagagaggagtgtgtctggtttaaaacaggtttgtctgttggacatctgtcagtggacatgtcctttaggcagttgggtatttggatctggagctcaaaggaaggatccaagttgggaattttattgttgttgttgaaactctgttggggaagggaagaggttaccacttgtcctatcagtgttttttgttttgttttgttttgtttttaatgcctaatcatttgtacatttaacacagtctctaactgcaggatttttattcctgagaagacattaaacaactaatcaat

SEQ ID NO: 95802 - DNA, 1803 bp, Homo sapiens
ttcacatttttgagtgctggaggacgttgtagtcctttaacaactttgttctagcagacatttaagttccttgtgggtcagtttgatgctttccagttttcttgttaagttcttttaggatggttctgcagtagccttttgtctagggcaaacttaacagtgcttctgtggtgtggtctttctgcttgtcttccaaatacctggtatatttactgaggcctttccactctggctagtggaaactcaaacagttcccaactctgtgtgagctctgagaattgttgggcttgttcctatgcatgggcaggctgcccttcagccagaaactccaggggatcactatgcagatttctctttctctttatgtagcttccatctcttgggtactgtcccccagaaaatctaccagcctcagtttgttgaacttgaatctctggtctcagtttggtttcgctctttgtcattatcagcctttgagatgtctcccagtgatccttgcttcctgttattcatgatcttgtgtggtcctctaacacattttatcagagttggtctgagtgactgatagagcatggtggaaataatggcacatcccttctgaggctaagttataaaagatactgtggctgcatctttgctctctctaatcactcactctggggtaagccagctgccatgtcgtgaggacgttcccaacagagctctccttaactccagacttaatgcttttcagtctgcctatttgtgtcactctcttacctggatcattcaaaagaaaggccaaactcctcagcagggtctaagacctcatgaattttccccagcactcttctccagcttcaactctttctcctttccccagcctgtgttctaagcatagcagactattttcaggggtcatactcatgctgtgctttcactcaccctgggcatttacatgtttggtccacccttctcttcaccaggctaacttctgctcttccttcaagttacaggtctcctcctccagcaagcttacccagaacccattcttcatgctctcctgggctatgataggtgacctgctcagtgctcccttgactattctcagcctctgggactactgagagtgcctgtttagttgttaaaactcactcctccagtacctcttaagtcatagacaggcattgttcttgtttaccatcatagctcacaggatggcacacaggatggggctcactcagtatattttgaatgaatatgtgagtgagaaaaatgtttgagagtgaaataagcagtgacttagcatatcaggccactcagtttatttaattttagacttatacgtgaaatgagcagtattacagcagcttttggttaactgtaacaatttaatgaatttatctgtctcactttacagtgactttttggagaaattagctaatgttttactcattgttacattaaagtagcctatttttaattgcattctcaaaaccttaagtttatattagagtgtatgtattattcatgtaaaacaagactttctttttctaaacagttaagtcattccattgttctgggcctgtgaagtttaccatagtgtggcatttgaagtatcatacctgtcacaatgagcattctaatctggaagtaagtaaaacacaagtttttaatgtatataaagctatgaaggaaaattatgggtataaagattagctcatcaagcgaggaggctagaaatagagattacagttttagaagtgctacagattaattttgggacttatggcaataaaccaagttacatgctgagaatactac

SEQ ID NO: 95803 - DNA, 1030 bp, Homo sapiens
tgataccagcctggccaacatggcaaagcctcatctctactaaaaatacaaaaattagccaggcatggtggtacatgcctgtaatcctagctacttgggaggctgaggcatgagaatcacttgaacctgggaggtggaggttgcagtgagctgaaattgcaccactaaacttcagcctgggtgacagagcaagactctgcctcaaaaaaaagttttcttatatatgtctatatgaattttgtatatactgttactatctttgtctaaaaatatccttaaagcaatttaagatgcatttctatgcagcctttcttttctttaaaaaataaaattccccctctaaatgtgcaagacagcatagcaatgggctgtgcgtgtcattaaggatttaaagaaatagaaaccatgaatgtagcatgtgggagggaaattttggcattctggggaattactaaaagttagaagactgagtaagaggtcgaaagggatgggagttatgtgtagggactgaaaacaggtttgggagagcttaatgtttgcttttatactatgactcttcatgttttctcttcaaccatcctaaagaagtctgataatggaaaggcactcgctctgcagtggccaggacaaactttgtacaaaatctgtcatatgatgaggagtaggaaatgaaagaaacggataggaaatattcaggaaaatggagtataagaagtgtgatccagttatgggagggcactggagaatttacaagcattacagtgggaagttttattccttagtggaattgcaagtaacatagtgccttaagaaatttgaatcatttagcttatgtacttaatctgagtcatttctgacaatgttatctaacttcctcttcccccaattcaatttaaaaaccacacattaggccgggtgtggtggcaggtgcctggaattccagctactcggaggctgaggcacaagaattgcttgaacccaggaggctgaggttgcagtgagacaagatcgcaccattgcacttcagcct

SEQ ID NO: 95804 - DNA, 1554 bp, Homo sapiens
tctgcttctctctgtgatcactgccggtactctcatcatctcttagttttctggaatagtctcctgagcattttccttgcctgcagttttgttcctctccaaaccattgtaggtagagcaatcttgataaaataaagccatccattttattccagcagtcagcacattttttctgtcaaggccatagaggaaatattttggctttgcaggccatatggtctctgttgtaactattcacccttgccatcaaagcataaaagcagccatagacaacatgcaaacaaatgagcattgctgtgttcccataaaactttatgttcaaaaacagatcagatgtagggccagatttggcccatgggccatagtttaccaatccctcctttgttcttttgtttattgttattgacttcccactgcccttaacatcgagtccagactccatgacaggggctccaaactgcatgattggtccctgcctttatgaccagcctcttttcttgacatctaccattacactctctgctgcaggcataatgaactttgacttcttgcagcatagtttgcttttcctcttttcttctctgtgcctttgcacgtgccgtgttctttgctttgtcatcccccacccccaaatacttaactcctacttagccttcaagtcctgatttagatgtcactttttctgagtttttcaggacccaattctagttcccccaggtgtagattagactggccttcttccaagtctggagggatgatgtgttacctcttgctcttaccacactgagttctatttacttagcctaaccagagtacaagctccatgaaggcagggatcaagatgtctttttcactattatagccacacagtaggagcatatcagatacattttaaatgaatacatgatgaggagatcctggagaaaagagaactctagaggatgttgtggtttttaaatatttacaggacaagaagagagagttctgtaaagagcaagaacagagggaagctcagggagacagtgttcgggctgatagaagaaagctgtgcccagtggagcagattagatagatagggagtgaattcttgaggcgagtatgaatccttcactgaagttttcaagcatcagttggattcagtgacttttaaatcaaatgtggctgattggtctgaagttcgaatgtagttatacacaggacatgttgttgagaatcttggttggcaggcttccaggtgtagacaaagtgaattattttatttttttcttcctcagcccaaggcttattgatatttgcggagttgatttctgcgattaagaggacgttggctcgccttctcgtgatcattgtgagcctgggctatggcattgtgaagtaagtactggcgtgtgggaaaaatgctgggtcccagcccagtgattcagtccgtctacattatgacctttgtgaaaatggaacttctaagtattgtagtacaaatccctttgggaaaaatctacaagaacacatttttaaaagatttccacatacttgctattttatgttatcttccaa

SEQ ID NO: 95805 - DNA, 1116 bp, Homo sapiens
taacaagttagggagtatggtccttcattcaattaattaagctgcagactgcgttttttaaaaaataaactatcttttctggtaatttatagatatttatttcaaagatttcttgttctttttttttttttttttttaagacggagtctcgctctgtcaccaggttggagtgcagtggcgtgatctcaactcactgcaacctccacctcccaggttcaagcgattctcctgcctcagcctcccgagtagctgggactacaggcgtgcgccaccacgcccagctaattttttgtatttttagtagatacggggtttcaccatgttggccaggacggtcttgatctctttatcttgtgatcttcctgcctcagcctcccaaagtgctgggattacaggcgtgagccaccgtgccctgccgatttcttgttcttaaccatccacaaggtagttcattgggaaaaacacttagtaatgcagcttggcagaaaattccaaagaaaagcagctctgatggctctaatccatctggatttgagtgggggtaatttattacctttatgaacagcattgactttcacacattccagtatctgattagtcagattggggtaggaaaataaggaaaacagatgaaagacttagtttgcttaattatgaatatttataatgaaaatgtttcagggaatagtcaaagaaatctaaaatgtgaaagatctttagtgtttcatggtgagacaaaggaagtctagtgtctatttctgcatgagcctgaatttgtgaagtttgctgtcagattgctctttggtaatttttatcactaaaatgaaatgtctgctttttctatacagaaagatagcagatttcctaaatgatataaatgacaagaaaaaaaaaagcagaactaaatacgtatacaattgagtgctttggaaaatgaccctgcttcctttgattttgatgaacttaatataaccaatcctctaagaatctaattctaaagtcataggaaaaaaaataggctgaaaaattcaaaagccatagccttagcctttctcctgtggcccttcctcccctttttttcttcttgtttctctttcgtttctcttttcttttctt

SEQ ID NO: 95806 - DNA, 1045 bp, Homo sapiens
gtgcactgctctatcccgtgttgcgggtgcatggcattggtggaacgcatcatgggtcttccgtgttttttccttggagtttgttttcttagttcagacaatggtaaattgtaaaagaaaatctgtgataaagtataatgattgtacaatattggccaagataacattttctgtgttttcattagcttcaaattttaggaactgtatttagcagtactgactttgggaacatagtagaagattctgttttttttttttaacctcttattattacttggaatgtttttccttaacttttttcacatttttattagtttggcacaaactatgaagaccctaaggctaagaaagaacactgtgaaattttcattatatagacattttaaaaatactctgatctttgctgtgctgggtaagctatttaatttttcttacagtaaattatcttagtattgttatattccttcaaaggtgactttttgtgtgtttcagcttctatagtgtttatggggtggacaactaagacatttagaattgcaaaatgccaatcagtaagtataaccttcctatttaaacagttatttttatttatactattttgtagaattttgaacaatttagtttatgcttgcaaatagaggtgattttaatggagatttatgtttttactttgaactattttttacagagttataaaaacttttggctgggcgcggtggctcacgcctgtaatctcagcactctgggaggccgaggcaggcggatcacgaggtcaggagatcgagaccatcctggctaacacagtgaaaccccgtctctactaaaaatacaaaaaattagcgggtgcctgtagtcccagctactggggaggctgaggcaggagactggtgtgaacccaggaggtggagcttgcagtgagctgagattgcaccactgcaccccagcctgggcaacacagcgagactccatctcaaaaaaaaaaaaaaaaaaaaaaaaacttttaactcctccaagtgagtctgaaaaagttcctccgaaatctcct

SEQ ID NO: 95807 - DNA, 1011 bp, Homo sapiens
tttattacatcagcttatgttataattgttctagtttatggagaagcaatatttgcaaattagtgtaataacaaaagtgactacttactgggcatagattgtgtgtcaggcattttatatgtgctaacttgttcaatggtcactagaactctatgaggtagaaattattattatccccagtttatagtcagaaacactaagtcacaggaagttaattgccttgcccaagattccagtgaggcagacacttagcctttgctccactgaaactgcaaacatgcagaagagccttggtcaaatatgaaagaaatcttgatctttcctatcttctttatgccatacgcacatttcaaaatttgtacatcagggatgtaaagcatacccaaagatgtgttttgttcttgaatgtaccatgaatcctgaagatttttaaatccataaactttaaaataattgcaattaaggaaatatgtatgcatgtatacttgtttaaactctaaaactaggattcaaacaagaaacttgaaaacctggtggttctgacaaatagtttccaaaaatctgtgaacttttttcatatatttttcctacattcccaaatggtaaatccagcatcctgcctaaagtttccattattaaccctccatttctaaaaagatatagtattttttcttatcagattattaaatttctaaaggaaaatattattttgtgattttatatatatgtttataatgtctctcgtagccgaaggaataaaattaagagcctcaaaatcagtttccaatggaacagctaagcctgccacttctgagaactttgtgagtatggtatatatttagtacaatcttagtcttccttagtcttcactactttagagagctatacgagtgtcatattcattgactctcagaagaacagtttttactaagattttgttgttgttgttataaaaattagtgttgccaagtgccaagtagcaatcctggttgtccataactgaaatacctt

SEQ ID NO: 95808 - DNA, 1654 bp, Homo sapiens
gaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcat

SEQ ID NO: 95809 - DNA, 1081 bp, Homo sapiens
gttggcatgcaacctcaatagggttctcaaatagaagtatttttcttcttcctccgccactaaaaaagaattataaaatatttgatatatttacatacctatatggatctacatcagcctgcttccttgtgtgggcttgtctatcaggtatatttttattctcctcttgtgtttctttgtagatttaccaaatacgtataattcacaaaacaatatatttagttttgcttatgtttggattttatcagactgtatcatactctctgtattaattgatgacgtggctattttcacccaacattattcattcgtgtagatgcatgcagctgtcattcatttttactcctatataacatttcactttatgtttatattagttatttggtcattctactattaatgaatatttaggttattttcaatttttaaaaatactaactcttgtaaatatccatatacatacttcttggcatgaatgtgcacaagttatccacagtatgtgccaaggagtagaatcatatcatcataaaatttaatataatatcagtttttttctcaagtagttataccagtttatactcctacaaactgtgtagaagaactgtcattctacacttgccagtactttatattgtcaatactttaatttcaaccaatttagtggatgtaaaaatagaatctcgtaacttaatttgcatgaagtgcagcatcttttcttatgcttactggtttttgagtttcatctttggtgaaatgcctgttaatgtctttgcccatgtttttattggtctgattgtcctttatacattgatttctatatattccttatataattctttgtgaggtatgtgtggcaggccttctcccattttgtggacggtcttttcgttttttgttttttttttttgcggcatctcagtgagtagaattacttattttgggaatctttttgtttatgcctacttttgtgttttgtgtctcatttaagaaattattccctgtcatgaggctgtaaagtaatttaactttttttttaagttttggagctttgctgtatacgtttatattttaatccattggg

SEQ ID NO: 95810 - DNA, 1055 bp, Homo sapiens
actatcaatgactcgggaaaaatgggaagcccagagaagatcaaatagtcatgaggcatttcaaaggccactgagtcttacaaattttttactactaaagtccctcatcctggctccctctggaaattaaaaatcaatatttctgagcattggccttactgaatctccccactccccaccttcctgtattttgattttggtttttagaagttccctttccttggtctgtagatgtaagcagggtagaataataagtacctcttctggattccacttttctgagggcttttaactggatggcaactttttttattaggcttggtcatatgggacaagggtaaggggtggtaaaatattagaaatgccaaatattctagattgaaaaacatttatatacagtctgtcccctgcctccatattttatgaatgaggaatctgaagccctgtggttcaggtaattacccatagtcacacagggccaagccaggactaggattttgtttctcaaccccctgtcaatattctctttgatttgatttacatggctcaaatgattattcagccaaagctgacagcccttctacacaaggaacaaattctaaacatatatatagaatttaataatgttaccaaataaaacaagatttaaactggcagatatttataagacataaatttgatggtgctaagtggaaatttgacattattataaatgactgtacagtcagctcccttgtttgtacatactgtattcctaaaactgtatgcaaaaatttggtatacagaagctgtaatctgtagcataagttaacatgtaaaaagtaccttatgtttctgaagagcttaaatgtattataagattttcttcctttttttaatgtaaaaatctccttttatacctttatcaccatctttgacggtgtatttctagttgcgtgtgttaatttgagctgataagtgtgctcaactcacacccagtgagcatctcattgaaactatagattccactgcttttggttcactctgatttccaactttgtctctaccactctaaa

SEQ ID NO: 95811 - DNA, 1002 bp, Homo sapiens
gttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacagggtaagagtcaaactattttatcatttaaagtttatctagagaagcagtcacagttgtccatatacggacagaggatttttctttgcactttatcttatgataagactatggttttcatgaatatttataccagacatgagcttgcatggccagagaccccatctgagacctggccacttggtgcattaaatgcttagtttgtagagggagctggaggatggaggtgggttatcaaaggccctgactatttctaaagggagaatgctaaagccctggcctctgcatgtgtgaaggataggatatgcctgcttgtattgctgtcatttaaagaggattgactggaatggttgtatgtcagactgtaactcagaaatatattcttctagattactaaaatgagatttagccataaatatgagggcaaatggcaattataaatgaaatttttggccaggcatggtggctcacgcctgtaatcccagcactttggaaggccgaggctggtggatcacttgaggtcaggagttcgagaccagcctggccaacatggtgaaacctaaaaataaaaaaaagtatcagggtatggtggcacatgcctgtaatcccagctaccctggaggctgaggcacgagaatcacttgagcctaggaggcagaggttgcagtgagccgagatcacacagtgcactccaacctggacaacagagcgagactctgtctcaaaaaaaaaaaaaaattaaaattttaatgctgtcatttttttgttgttttctttacttaaaatggatctgtattgcttgagcccaggagttcgagg

SEQ ID NO: 95812 - DNA, 1054 bp, Homo sapiens
gttccttctgaggctgtggggaagaatctattcattcatctcccctagctcctgatggaatgctggcaatctttggtgatggcttgcaaaagtatcatcctgatttctgccttcatattcacatggtgttctccctgtatgcctgtgtctgaattgtctgaatttcctttttttgagacagagtcttgctctgtcacccaggttggagtgcagtggcacaatctctgctcactgcaacctccttctggactcaagcaattctcagcctcccaagtagctgggattacaggtgtgcaccaccacgcccagctaatttttgtgttttttgtagagaaaaaatatacatggggtttcgccatgttgcccaggctggtctcgaactcctggggtcaagcgatctgaccgcctcggcctcccaaagtgctgggattacaggcctgagcgactgtgcccggctgaattttccttttttataaggaaatcagtcactggactagggcccaccctaatgacctaatcttaattaattacacttgcaatgaccctatttccaaaaaaggtcacattctgaggtattaggggttagtagttcattataagaattttgggagggtgcagttcaacccataacaaaggtaatgtatattcctatcttgcccttcttttctgtttttgaacatggagaaacgccatctctactaaaaatacaaaattagccaagcatggtggcaggcacctgtaatcccagctactcagggagctgaggcaggagaatcgcttaaacccgggaggcagaggttgcggtgagccgatatcatgccattgcactccagcctgggcaacaagagcaaaattccatctcaaaaaaaaaatgagttttaacacactatagaagaatgggttaaattgtcactgagacttataagacagaaatagactttaatagtgtatcttttacttagctttcttgcttgcttgctttttctttttctttctttctttttttccttttctttttctttttctttcttttctttctttctttcttttcttt

SEQ ID NO: 95813 - DNA, 1569 bp, Homo sapiens
catcctggccaacatggtgaaatcccgtctctactaaaaatacaaaaattagctgggcgtggtggcagacacctgtagtcccagctactcaggaggctgaagcaggagacttgcttgaacccgggaggcggaggttgcagtgagccgagatcacgccactgcagtccagcctggacgacagagcttgactctgtctttaaataaacaaacaaacaaacaaataaataaataaaataaacaaaattctactatctgaggtaaaggacgaaaaagcttacagaagggcaaccacggcggcgcctgcgcagagccgaggcgaaggaggcagggagagacccggcctgcccagagtcgcggagggcggtgcagcgcatgcgcggggcaggtgaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaaggtgatcccatatcttttcatcttttgaatgcaggggctcagcgggactccgcctcttagtttcttctggattggaggcagtccggggccacgtccgggccgcgtcgcgagggcccgtggggagcacgtgggccggccgggcgccaccgtctgacctatagaggtcgtgcggggtccgggtgggagcagaagctgaacgcggggctcaggcttaggccgtcagggccggggctgtcgagagcctgggcgggggagcggggtggaggcgagaaggctccgggatgcgcccctttctctgcacagcagcgggtgaggagcccgcctctgtggtcccgtagcgtctgtctttaccgttgttgcctgtttccacgagaccgtaaactcccagaggacactgatgtgacctttttcactgacacctcctaggttcttttctgtagaaaggatgaaaccacaagtttattgaaaggtaaagaataggcaatactctgccattagtccactgatttgcatggaaagaccctaaagaccacaataaagcaacagacgtcatttggacttaatatttccattaggttggaaaagcaagtgagactcttggtcagatggccctaatttgtagattatatttttggagcagtgtctagtgatttgaaatgctaaaaaccaccatctttgttcttaaacctacgtcttttatttccctcaactgagatatatttccagttgtgattgattttaccattcgatattggtcagctgttcactctatctcaaattttaccttaactgatcatccagagctttaccttgtgctttacatgaaataaatcacttaatcctcaaaacaaacttaaagagaagatgatgccgtcctcgttttacagatgggaaaactgaggcacggagaggctaaataacctgccgagattgcacagtgtaagtggaagagctatgtccaggatccatgattttatca

SEQ ID NO: 95814 - DNA, 1047 bp, Homo sapiens
caccaaaaggccatctgttgtatacagtcttatcccttggaatttgagatggcaagtttcaagtttaatatgttaacacaaaatacttaggctttgcagaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagac

SEQ ID NO: 95815 - DNA, 1030 bp, Homo sapiens
tcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaat

SEQ ID NO: 95816 - DNA, 1093 bp, Homo sapiens
tttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatct

SEQ ID NO: 95817 - DNA, 1141 bp, Homo sapiens
agaggaactgtttatgaaactgtaaagagaaaatggagatacaaaaagccatccaagatgtaaatgccgaaggccaagttttgagataaacagaaaatcacgaaaactcatgtctggtggatcttccatggccccagtgtgagcagacagtattttccttgaggagaaatactagtttggtgggggtaaggtagggagttagtttaaggattaatcaagagaactatacatgtgctatttaggttgagggaaaagatcagaataggcatgggcaaagcctagactcaaatcaagttatctatcaagcaagctgacatattcagacagtttattaattacttagagaaatgcatgatcagcatagtgtcagctcctcatgtccctcatccgcagggtaacactgaaactaaacgggaccacatgataggtaacatgagtggtgggcactctggctgaggaacagtttccatcctgtagctaagtagttttttagcctacagctacatcctaaggagtgggcaaggtggtgaatctcagacctcatggaaccagggaaggtggatgagaaactgcctcccagcaggctcccacaaaatatggaggttggtaagaaatagccttgtagcagcacctcacaatactgcctatctttccatattctgaaggaacacagagcattctgccaaagcttaggtcagcctatcgttgggcttacgtaagtagcctatgtggaggcatgcgagttttccagggcacgagtacagagcagttatcctaccttatcatctatagtaaggaagaaacgaccgtgtgaattagtacaaaagcatgaaaagaaaaatgttataagtaatcatttcaaacatctaggaaattttgttctgttggtcttaggataagcattctgcttctattaagttgtttgctcctggactgcaaagaaatcctagagattctgacacagtcacttggcacattctgaagattgtctttttttgtggtgatcatattatcccaagaagtttgcattcatgagtaatgtcattgtactatcatctatcaggagtacttgtatagtcttttatagaggcttttgtgtttcttccagaagactcagtttctgatctgtagcttgtaacag

SEQ ID NO: 95818 - DNA, 1214 bp, Homo sapiens
ttccctccttccttcctccctccctccctcttgcttgcttgctttttctttcttatttctctctctctctctctgtctcttttcttttcttttcttttggcaaggtctcgctgtgttgtccaggctgggtgtagtggcgtgatcttagctcagcttactgcaacctccacaccctgctccttgccaaccccctgccctgcaccgccccccacccctgcccctggggtcatcctcccacctcaaccttctgaggtgggcactaccatgcccagctaatttttgcattttttgtagagacaggggtttctccgtgttgcttgggctggtctcttgggctcaagcgatccagctgccttggccttccaaggtgttgagattaaaggcgtgagccactgcgaccagcccatttcaactttaatattatttttctactaaccaaacttaagtcttctagttttaaatgtgaggaaaagactcgctttgaaatagtaatctttgccaattatttttaggtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagtaagtgaaaaactttcaaaatgacatcaaatatttttttctgaaaattatcattaagaaactaagtcatactccaagctaatcatgtaattaaacttggttagagatagcacatatctggcatgcacgcagattgttgcttccacctttgttttcggttcccacctgctgcttgccatcagtgctttcccatatggaatccttatacagcttctgaaacttctcagcatagtaatcctgaagaaccctgcctggtgggtggatttggcattttcacttgattatgaggctgcattgtcattgataatgccttcagattgtgggaaataggtctccacatatttgattattttgaagagcaattccttaggctattggcggaagacctctggatccagattttcattttctaacaccaccatttcagccctgctgccagtccccaagc

SEQ ID NO: 95819 - DNA, 1054 bp, Homo sapiens
atgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctg

SEQ ID NO: 95820 - DNA, 1086 bp, Homo sapiens
gttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactga

SEQ ID NO: 95821 - DNA, 1084 bp, Homo sapiens
aatttaagcacccattccttttcttgtttcagcagcctgaattattgaactagcagactgaatattcactcaggaatcaaattcttatgaaaatccacacaggagataactggaaagaaaaagtcaaattaaagtgttcggcaattcatcatttggtttcattagttccagggcctaatttcctttcagtttcccacaacaggactttttgaagactcacagttgaaccttatttttatgcctgaattgattaaaacttttagcttcttttacagactctagtccagttcttatttccatgaataagcaggaccgtcagtacagcagaaacagcaaacctctcttagctccatgcataaattatgatgtctgcttgttagcaatactctctgtaacatcagcagcagagtcagctaacagttgctggcaggtgccacagtctggaactctactatagatggacatagatttctgtggcttggtaaaccatctggatttcttacatttagggtgaatccaattatttgttctttcctttggagggtgaaaagtgtcttcccaacaaggtaagtcaatctgtccatgtttttctccttgttgattctctatggttggctactctctcgtgattgtcaatcaaaagtggattatgggatttctacaagttatgctctgaatgtgatggtgttggctgatctctagatgtattcagaaacaggaataatcacattcctcttttccctatgtgttaagctgtttgttaactgggatcatttattttataatacattttggtgtcttaatatgtttcattaacagagttcatgctaaaaaacattgtgtgagttagccatttaaaaacgaaagagaagatctactaaagtaaacaaaaacagtactagatacaatacaaccacctctgtttttggataatttaggtgtgttaggattctacatgtcctccttccagctctataagcacttcatgtcgaagatctgtagatgtgcagaaaggaatgtcccagagatattgtgggttgtgggggaatggtgcaggtgtgccagttgggcctcccaaacatat

SEQ ID NO: 95822 - DNA, 1037 bp, Homo sapiens
cgccgcgcgcccgggccgccgggcagccgccgcagggaccaggcggccgagaaggcggctcagcgcggaccccgcccgggcgcccgccgcggcccggcccccgccgcccgcgccggctaccgcgcctctcgggtgccggcggcgccgcgcccgggcgcccgccgggtgccggagaggaaagcgccgctcgcacgcccgcccccgccggcgcggccccgcctctgtcccgtgattccgcgcggcccggccccgccgcgctctggaggagcccgtgggcggcggcgccgcgccctttccgtaccctcccccgggggcggcggcggcgcagggttggagacccgcggcggtgggcgcggctttaccgcagcgggcggactgtgcggtggaaccggagcccgggcctggggtggttctttccgagccccgggtcgcagccggggggcggtgccggcggaagatcccagtttgcagggctcgatctgggtttttcttctattgccaaaggacctttaatggataaaacccaaaagttctaaggcccggtcctgtggcctaatgaagaagcgcttcctcttcctctttgcttaacgactacggagacccggagcgtcggttttgtttgtgtcgagtgctccttccttcggctgagcccagggtggcgcacggccaaggggatgaccttagactctgctggtggaagcaggtcccaaaccgaccccctggagccctgggctccgctcttttcctgccttttaccggcattcagccacttgctttcccttctccggacctcgatttccccttatgagcggcggagagtggctcttaaaagtcccttcggttctgatagcccactctgaagactgtgctgctgcatttgagatacaaagagaaggcaatgatcatcagagctcccccaaacttcctacagtccctcataaattacccacatcagccctgcgccttgcatcttttactctcctgtagataaagaacaccctggggcctctccccttcctgtcccccgatgctcacgg

SEQ ID NO: 95823 - DNA, 1959 bp, Homo sapiens
ccagatcggttcaactcacatcctattgacctgagcatagtctcatggcctccctctctgcacagtcatctgggaattgcatcttctctccggggagccatgttccttgccagaattcaccagaggtgggggccaattgtattccaaagacaaggggagaatcgatacggaggaagagtcacctctaccttggagggcaacccagagagagcaatgttctatgtccaggagagaaaacagtttttagaaataggtgtggtcagaattcaaatgggtaaaaactgaatacgggccatttggaattgactggtcatttatgagcttccatagacagagcctttgggagggggctgtgtaaaactcaaatcgttggaggaatgaagagctgcagtgtaaagttgctggattttcttcttttgaatagtacctgggacaacttttcattggtatacaagtttatgatgtagaatggtgactccatggaaggacccatttgaacacccagaaatcttagaatatggagactgtgcctggaggctccctttggttaaccggtgtcaggaagaccctagcaaagagaattcatgatctgaaaggagaggaagaattgcttatagttgagaacaattatttgttccttgcattgtccacttccccttccagacttcctgacttccctctatattcttggcagtgcctagctgtgaaagcttaggtggaatcataacattaaaaacaacaaacatggctccgcccaggcagaggtaggagtgactggcattaccctggtgcttaagcctaggagtgagaagcagaagcctccagaatttgaatcctgaacagataccacaaattcaggagatgatcagtaaacgtttgagctttttgtttgtatgtgtttttttttttttttgtagttttgttttttgtttgtctgtttgttttgcgacagagtctcactctgtcgcccaggctggagtgcagtggtgcaattttggctcactgcaacctctccctcctgggttcaagcaattctcctgcctcagcctcccaagtagctgggattacaggcgcgcatcaccatgcccagctaattttttgtatttttggtagagacaaggttttgccgtgttggtcaggctggtctcgaactcctgacctcaggtgatccgcccacttcgtcctcccaaagtgctgggattacaggcatgaaccaccgtgcccggccaacatttggtttttatgggaaagaaaacagcatcctacaacaaaattggttatatgccatcactgttaagggatatttaccttttgcttaaagtgtactacatgaaagccaaggagaagatttatagagctaggtaaaggctcaggaaggcaggtgccctgtggataagaatgtaggcagttcaggtgggaatcaggtctgtctgctcagggagaccagtgagagccagctaatgcctgcctgaaacttttgatttgactgtatgccattctcagagaaattattctttcttctggcattttcaactgaaaattcctttggtcttactttgattttgttactggaaatacagtgtgttttattaagatttgaaacaaaacattttttattttattttatttttgagatgaagtcttgctctgtcgcccaggctggagtgcagtggtgggatcttggctcactgcaacctctgcctcccaggttcaagtgattctcatgcctcagcctcccaagtagctagaattaccggtgtgcgccaccacgcccagctagtttttgtgtttttagtagagatggggttttgccatgttggccaagctggtcttgaactcctgatctcaggtgacttacccacctcagcctcccagagtgctgggataacaggcatgagccactgtgtctggctgaaaacactttttatttttaataaaaattgtttttctttgtgtcct

SEQ ID NO: 95824 - DNA, 1035 bp, Homo sapiens
ttatatgaaatgtccagatgagacatccatagatacagaaagtagattagtggttgtcagaagctggggtgaggagggagtagtgagtgactgctaataggtacaagagtttttttggggggagtggtgaaaccgttctaaaattaaactgtagtaggccgggcatggtggctcacacctgtaatcccagcactttgggaggccaaggcaggcagatcacgaggtcagaagaccaagaccatcctggccaacatggtgaaaccccatatgtactaaaaatacaaaaattagccaggcatggtggtgcacgcctgtaatcccagctacttgggaggctgaggcaggagaattgcttgaacccaggaggcgaaggttacagtgagctgagattgcgccactgcactccatcctgggcgacagagtgagactccatctcaaaaacaaacaaacaaacaaagaaataacaacaaaaactgtagtaatggtttaaaactcttgaatatactcaaagccattgaactgtgcactttaaaaggataaattttttggtatatgaattatacttcaagctattaaaaaggatatatcaattatttaatgttaatggacaattccaatgtatccagttttttctattgcaatgctgcaagggacgtacttgaacattcatctttatgcctttatcttcctggtagttctataagatatagtgaaggaaggggatttattgttgttatagtctttattgtggtagccagtgactagtaatagaatggtatttattttgagtgcttaggcactacgaatttctgtaaaactgacgtttcatggttgtagccagccaagatagcgttgacacctgtatggagaaagagttggtaggataatcctgggtgctcttgaggggagaagggagcatgtgggggactggagtaaggaagggagggaaaaaggtgagcgggacattgaaagcctcttgtggggtttttgctgttcgtatttcctttctggatttatagagagctcttggtttga

SEQ ID NO: 95825 - DNA, 1022 bp, Homo sapiens
ccgggcgtggtggcatgcgcctgtaatcccagctactgaggaggctgaggcaggagaattgcttgaacccggaaggcggaggttgcagtgagccgagatcacaccattgcactccagcctgggcaacaaaagcaaaactccatctcaaaaaaaaaaaaaaaatcatctgatttttttatcttttgatcaaatttccctgttatttatggtaaaatgttttgtttgcctcattgtagtgataactcactatcttagctaaatcataacatgcctcttatagttttagaaacttcctccttccctagttgcctcccactccttacctaccccataaaagaagtcaagatgtggggattgatgtatataatatgcagaaactttggatgacttgagtaaagcagtgtttttgttgaattgcagaagctgggtcttggtggatcatcagtataatatctacctctatagagagggtgtgcttcggactgcttcagaaccatatcatgttgataatttccaagacaaaacctgccatttgaccaatcactgcattcaaaaagagtattcaaagaactacgggaagtatgaagaaggaaatgaaatgttcttcaaggagttcaatcagtacctaacaagtgctttgaacattaccctagaaagtagtatcttactacaaatcaaacatataataaggtaacttaattgtatctttttggattacgtgtttcttcttgaaggagctttggcgtctatgcctttcaaagaattgtttcatataagttgtctaatttatggtcaaaaattttttgtaatattcctttattttccttttaatgtctgcaggttctgtaatgatgtctcctctttcgtttctgataatggttatatgtgtgtgtgtatgtgtgtgtgtgtgtgtatatatatatatatatttatatatttatttatttatttatttttttgagacagagttttgctcttgttgcccaggctggagtgcaatggtgcgatctcggctcaccaca

SEQ ID NO: 95826 - DNA, 1030 bp, Homo sapiens
cagactagtatctgcacctgccttccctgccagaatgtctcccgtctgcctccagacttacccatcttggtcggtcaccaccccctgctccccccagagactaagctcgaacctgacagtgatcctgcctctgccttcccttcccctcaagtcctgcccatcagggccctgtgggttgtacctctagcctccggagtcctttgccctccatttgcactgtcacccctgcacagggtgtcttccaccatagtgaaggttttggcatggagccttctaactggggtgcacttctgctcttgccccagtgaaatccatcctcccagagcagccagtgtgtaaagtcgacaccagaccatgccattctccagacttgccattgcacctaggacacaaaccagactcctccctccacctccaaggccgctgccttacccacctctccagcttcatcccaagtcaccatttcccttgattgctcttatctgcagtgggcctttgtgctttctgttacctgtgtgtggaatccccaccaccattaccaccaccaccaccagccttaccgtggctggcttcttctttaccaaaacatcttgaggaagctttctctgaacagtcctagctctgattttctctaggcagagcctttgcagtttccttcattgcactaactgccatcagattaactcatcagaagaaactgtctgtgggtgtgtgtgtgtctgtgtgtgtgtgtgtgtgtgtgtatccgccccttcttctttatttctaccctgtcatccattctctgtctgccttctattcattgggtcttggcttagctgccactggaaagtcttcccctgtcactggggagtcttcctctgtcactggggagtcttcctctgtcactggggagtcttcccgtgtcactggggagtcttctccagtgtcccttcaattatgctgagttggtccttttcctgggtagggcctgcccctgtctgtaatgcaaggtggctcttacatgctcttgaaatgcctgccttccctg

SEQ ID NO: 95827 - DNA, 1046 bp, Homo sapiens
gagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtttttgtgctctttggttcttgttgtaggtattgactgtcctgggatatcactggtcatttaaattcaccatataattagccgggcatggtggcatgtggtggtggctgagg

SEQ ID NO: 95828 - DNA, 1259 bp, Homo sapiens
tgatcttcttcctcagtctttgaaaatactcatttgttctcgtaaatgcagatatttctgttaagtaactttttctcttgttttcatttaggctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggtaatgacgggcgtccaggcatgagacagtagagaaggcctgggttgggagtaagaagacaagaagtgtgtcagtgttttctttctgtgctccaatttctggataggtgaaagagatatcagtatcttgcctgcatacagtgtatggctctgaataactatcaaattagacagtatgaaaaagtggctgtaaaattagagaatattattgttcggggggaagaactggtaggtttttccctaattttctgaatgatagagacatacttccacaaaatttgttttttttttcaagctgtcttaatccacaaagctattgtcaaaaatgtctatttatctgggcatggtggtggcatggatctgtagtcccagctaactgggaggctgaggcgggagcatcagttgagcccaggaggcctcactacagtgagccatgattgtgccactgcactccagcccgggagacagagtgagaccccgtcactaaaaaagtgaaataaaaatgtctgctttgctaacagtaagattctgtgcgcatattaaatgacttatatgcattcccttcatcatttctttcagctatattaggtggctttgcagagttgagttgaggtaatcaagatgaacaaacagtgcctactaaataggtagatggtgttatgtggtgggaagagggttttggtgtcagatctgggtttgacacacagctcttccgcttatcagtcttgtggtttggggaagttaatctccctgagcctcagtttcctctgctgcaagtgggtataatagctaccccactcattgttatgagaattaaatgttatgataacatagagcacctactataatatgcctgtttcatagtaggcaattcgtaaatagtagctgtttattacagaaatgtgatattgagcagagctattaaaaatatttttctatttagctaatccaaatttctggtttccagagctttcatacaatcaagtttttgaacgtatttgggaaaccatactcgtatggaa

SEQ ID NO: 95829 - DNA, 1858 bp, Homo sapiens
tcttgatctcctgaccttgtgatgctcctgtctcggcctcccaaagtgctgtgattacaggcgtgagccaccgcgcccggcccagtttttatctttcaacacctctttggagtaagttttttttagtgttatttgaagactgaagtcattttaggggacagaaaggcaagataggttgagcctgtctgataaagagaagtaccctgtttttcttccatacttttttcccatgtccctaggacctttgtaatatacttgagaaaactgttaattcacacaaagacagtgtctgtgtactgttttcaagggatcagtagtacatttcacctctgtgttcctattctgtgtgttgtactacctttggctaggagtgaggttcatgtttacagttagtcatgtatctttgtttaacaagttgcaattcatctttttggcaggaaatggggggctattttataatcaatggcattgaaaaagtcatccgaatgttgattatgcctcggagaaattttcccattgcaatgataagaccaaaatggaaaaccagagggcctggttatactcagtatggtaagttctggagattattagaatattttttaaggaaaatttaaaactttttttttttttgaagtagatgcatccaaatggtctttgatatttttgtttctttttttttttttttttggtagggatggggtttcaccacgttgcccaggctgatctcgaactcttgggctcaagcagtccttctgcctcagcctcccaaagtgctgagattacatgcatgagccaccgtgtctggtctttcttttgttttttgttgtttttctattgagcattcttgtgttaagttttcataattgggatggaagaagaaatggagagatgttagtcagaggatacagacttgcagttacaagatgaataagttctggggatctgatgtacagcctggtgatgatagtaatactgtactgcttaaaattgatgagtacattttaagtgtctcaaccacacacgcgtgcacacgtactacaaatgataactatggtgattgatgttttcatcagtttgattgtggaaatcattataatatatgtatatgtatattcaaggtattgtacaccttgaatatatatgatttttatcaatcataagcattttaaaattcacttttgctaactgaaagagcatgtgtatttttgttactacttatgaagatgaaagctagtctggcttggccataagtgggtgtgggtcttggctgtcttctggttcaggctgctgcacttttgcaaactgaaagagcatgtgtatttttgttactacttatgaagatggaagctagtctggcttggccataggtgaatgtgggccttggatgtcttctggttcaggccactgtggtacacccctcagggtctctgtctgacagccacctggcctctgttggaacattctctttgacaatgcctaagacagcatgttgtattcttgagcaaccctgacagttaaacaatttgtcctgatagttgagctaaaaatcagaccttaattatagccatacatactatacctagaaaaacagcatgcctgaatgtctagtgattttcttttgcatcagttgatggtagtatgtcttagcagtctttgcctgaaactgaaataaaatctaaaattctacttttctccattggaactattagatcaagcaccatgtcttgaccagactccacagtttaaggcagatataaagtgctaaaagatgtggactctgtcctggagggaaactttgaagtttgcttaaattcatagtttcggttattttacattagtgtttctcaatctgggtaga

SEQ ID NO: 95830 - DNA, 2819 bp, Homo sapiens
cctcccaaagtgctgggattatagcatgaaccactgtgccccgccttttttttttttttttaaacccatgttactgttgccgattctttcattagcctgctttcttgcttgtctattatctgactctctcagatgaatttaactacttgctattttattaactcatttaatgttcacccacaaaggaggtcatagaggagacagggaactagttggggctaatacagtttgtgaaatctggggattattttacatatttttttgtgaactctttacactcatcagagctaggagaataaatgttgtaataattcattctatgatctgtagagtgctctgaggttttgtcgtcataaagcctcaacaatttccatttttcaaaagattggcccatttttgaatgacttttgttttattaaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggtatgtagtgtacagtgataaacatcttgtttggttatgtgggtttttttgtgttctttttgtttgtttgttttgagatggagtgttgctatgtcgcccaggctggagtgcagtggcgcgatcttggctcactgcaagctctgcctcctaggttcacgccattctcctgcctcagcctcccgagtagctggaactacaggcgcccgccaccacacccggctaattttttgtatttttagtagagacagggtttcaccgtgttagccaggatggtctcgatctcctgacctcgtgatgtgcctgcctcggcctcccaaagtgctgggattacagttgtgagccaccgcgcccggccaaggttacgtggtttttaacctgttaagttgtgctgcttttggagattcagcagagattttctgtaagaattcttttttactcttctgtgcaggagttgggctgctttcttggctcctctgtagaaggccgaatgcattctttgaaagtgaaaacaggagaaactaagtgttataggtactttgttttctttgggaaaaaaaaaaagataatggaagtgaggatcgcttgagcccagggatttgaggctgcagtgagctgtgattgtgccgctgctgcactttagactgggtgagaaagtgagatcctatctccaaaatgaaaaataaatgaataagaatgatgccaaagcattcgaaatagactagtcattaatattggaagtatagaagctattgagtagttttttgggtcatttctttttgcatctcttggcggatctttgcatttctaaatagaaaacagtgttggtttgcaggaggacagtttaaaaggaggtttcccagtctaccctgatatcatcagatatataaccttttttcctgataaccttaaagctgctgtctctgtctctgcttggcttgatacttggtttgaatttactttcatacctaaagatgtcagccttctctgcagtcttctagtcccagggttctccatttatgatttggagacagaaatgttctgtctttggtggtctgtggacagggtcctcagtgggattaatatgtgtgcagtaaaacttccagttcatggggatcagatgataagtgttctcaggcaactagaagggcattgactcaagaaagttctgcttaaaagtacttctcccaattagagtggcctggccgggcgtggtggcccatgcctgtaatcccagcactttgggaagccgaggtgtgcagatgacttgcggtcaggagtttaagaccaacctggccaacatggtgaaaccccatctctactaaatatacacacacaaaaaaattagctgggtgtggtggcatgtgcctgtggtcccagctactcaggaagctgaggcagtagaatcacttgaatccaggaggtggaggttgcagggaaccaagattgcaccactgcactccagcctgggtgacagagtgagactccatctaaaaaaaaaaaagagagagagagtggcctgtaagaagagggccctacagaaagtaatcaagaaatactcaagattcagaagatgtaatcagcgtaatttgaaggtttatcctctacgaggaaaagaattttgttactcgtgattcaaaatgtcaaagtccaggagagggtagaaaggagaaaagagaaagtggagaggtagaaagtatatccaactgcagaaaaagagatggggaagggttttttgctctagcactggagaagaagacggaatcgctacctaactttcgatagagatgttcatattgtggtgacagatgaaacacgaggcaggtaacttctgacactctaacaaacacttgatgtcttcagaatgtatttatggttcatggaagagtgttcttttttttttttacttaatttcagttgattctcattatttgtagtactcatctttaaagttaccagtgaatattgaaccattgtgcctaggggaaatacagggtaaggttccttcaagcctcgggttacaacatttttgttagccgatcaatatgtagccttgttttttgtgtgtttctgttgaaagacaccctttaaaaatatatattgttcacgtggtaacattg

SEQ ID NO: 95831 - DNA, 2857 bp, Homo sapiens
tttatagatgcttgtttaattttgtgaatattctgttactacttattttgatgctcagaaagtgtatgagatttgatctagtgtacagttgagggttttaagtacattcatgttgtggagtcatcaccatcttcagaactttctcatcatcacaaattgaaactctgtaaccattaaacaatcattcctctttttttttttttttgaggcagagtctcgctctgtcgcccaggctgcagtgcagtggtgtgatcttggctcactgcagcctccgcctcccatgttcaagcaattctcctgcctcggtctcccaagtagctgggattacaggtgcacaccaccatgcctgggtaatttttatatttttagtagagatggggtttctccatgttgccccggctggtctcgaactcctgacctcaaatgagctacctgcctcattagtctcagattttatcttttttatagagaatttattttcattctcttttttttggttagcattgtggagcatcggaggatgaggacacttaagatctgctctcttagtaaatttcaagcatgcaatatagtattcttaactatagtcacatgctgtacatgagatctccagaaacttaattttgttgcataactgaagctttatactctttgaccaacatctccccgtgtccccctccaccaaacattctctcatttttaatgataatgcatctagctgtgaatccccatgagttctgacacatgggtttgttgttgttgttgttgttgttgttgttttcaggtttctgtaatttaggtttttatttctcctttcacccaggagtttgttggagtttttttgttttgtttttgagacagggtcactctgtcacccaggctggagtgcagtggcatgatcatggctcactgcagcctcaacctcctgggctcaagtgatcctcccacctcagcctcccgattagctgggactacaggcacgtaccaccacactcaggtaattttttaatttttgtagagacggggtttcatcatgttgcccaggctggtcttgaacctctgggctcaagtgatccacccactttggcctcctaaagtgctgggattacaggtataagccacccccggcccacccatgagtttttggtttattaaatttacaaataaaaccagtaatctactgtattttagatcacagaggacagaatttcctttagtgtatcgacacgtgcattcatggtgtgctttatccttagcctcagtagttagtgatttgcctactagctggggtgagcacccaaggaagtagggcttttaccatggctgagtgtggatgagtggtattccatggggcataagactggcagcgacagccatggccttgggacaggtttgttaaactctgtttttgttaaaaacaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacaggtaaatacatatgtgtgatggatgagtgtatgtgcttgtttgtatagtatacaactttcagagacttaactcttccttttttaaaagggttgttaatgttacaacaacagttggacatttgaaagaaagtcagactttccacctcctctatgatcagcacagagcaatttccatgtctgatctcactccacagaacctgagagagggctggtggtcacattacctgcctcccatcttatctagctcccagaactcctttgtacctggctctgcctcagccgtgaagtgaaaacattccattagattcacactcagtctttgcctacatatttacagttgcaaaattataggctttgtgctacttaaaaatttttcttcctattccccttcacaattggtctggggtagttttagagtgagatacgtaaagcaagtggtatttctaactggtcgcttccctgtgcttcccagttgatcccttcagcactcatgatgctgggtggggatggttttctcttgagtctttgagtactgaactctgagaaatggtaagagtaaatgtgtaaccagttgcagttattttgtgccttggacatctgctcttccagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaaggaagagggatgatgttacagtcacaatcaggaaagtaaacttgatactagcacactcttttattgtccttatttacatatgctgaccatttgttccaaaaatacagtttatggcaagtttttcttttttctgtgccacaagcaaccagcccaggatcactcattgtatttagttggcatgtctatttagtttcctgtaatttatgacagatctttaaacattctttgtctttgacattgacatttttgaagaaaaaggtatagaatgtccatagatttgggtgtgcctgaggtcttattatttgattttttgaagaatacaagcaattatagtcacccgcatatttatcacttccagtcctcttcattcctgctgcaagattcaagttttcattgtatacaattttccttcagcctgataatcttcctttagcatttttttatagtgcaggttgctggccacaaattctctttgttttcatttatctgaaaatgt

SEQ ID NO: 95832 - DNA, 1233 bp, Homo sapiens
ctctgtactgtgaggtagtacacagaggaatctcaccccatgctccactacttagaattaaatacatattccgctgtaagaaagtaatctaattacgtaataattcctatccccttttcttccccgagtagtgatagcctgtaatttgcgtacttcctttctgtccccttctaaagcttttattacatcatacatgtatccataaactaagtatagaattgtttggggtgtgttgcaaatacacataaatcgtatcatattaaatgtcagtctgcactttctcccactcagcatggttttcctggtctggtcacgttgatacatttaggtttacttcattttcacagcttatgtattagtctaaagtaagcataactaccatgactatttatttgttcattttcctctgatggatatttagttgtttccagtgttgcgtatcacacctataatcaagatgaaagcagcagaaaatgctaagatgttttttctccatgtaggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatggtaagttttaccaggaaatgttgttccaatctttttattttttaacttgtttgtttactgtgaaatcactgaaggaatatttttgtgtacccaagtacctagtatttggcacgtgatgttctattaaatgattagttcttagtctaagttgaaagtgggcaagccttgaggaatatccactaaatattcagatacacgtatgtcttgcatatttgagtgcatattatgagtaaattttgaagtttggttttggatctatctaccttttatatttaagtatgattagattttaagctatttctgtgtgcctgggtttttgtttttcttgttttttgtttgtttgttttttgttttttatttttgagacggagtctcgctctgttgcccaggctggagtgcagtggcacgatcttggctcactgcaacctccaccttctgggttcaagcagttctcctgcctcagcctctcgaatagctgggactacaggcacccatcaccatgcctggctaattttcgtgtttttagtagagatggg

SEQ ID NO: 95833 - DNA, 1015 bp, Homo sapiens
atttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacaccttt

SEQ ID NO: 95834 - DNA, 1049 bp, Homo sapiens
ctgggtgccagggggattatcagcgtctgcgcaaggccgatggtggcagcgcggcgttaggaatcaggccccctatccctgagcccaacagcctaccgctacagcacccaacgaaaatgggaacaacatgttgagacgctgcagcaacagcaggcgcttcccaccagctacagtcggagatttggagcgcttgtgtctgaggctcaatcccgtcaggtgccgcgcaactcagcggcgcattctctttggacccgaggcaccaccatactttccattgcttacttccgttaaaccccgagcgctgccatggcaagccggaaatagggatgaagcaatttagccagaagagggcggaagtggctactcagggcgccgccatgacgagccgggccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgtgagtagtgagagcgcctaccccatacgtgctgccgctccccttcttttacccagtgatctagacctagtctaggacctcgggaactaggaccagcctccctccttcttggagatctgaccctcaggattcagcgccttcgctcacgagctccaaccctccgcatgcccaagccccgccctctaagcgtttaggcctcgccccctctcgcgctgcttaggacttcggtccagtcactcttcacccaatctctgcccccagtaccccaggtccggccttcacactgaaatcctaagactacagacttatttagggacctctatgactcctacacccatcctcagagctccaggttcctcccccttgatcaccaaactttaccttttgaaccttccagatctgcctgggaccccagtcctcacctatagggtccacagacttgttcctagaccactctgaccttgcccaggattcccagagcacc

SEQ ID NO: 95835 - DNA, 1042 bp, Homo sapiens
gtggaggaagacgcggtcgtaggtgctgaggatttctcgttcagacgctcctgctcctgacttaccgctgttcactctcgccgaggaacaagtcggtcaggaagccgcgcagcagccttggcttttaaggataccggaaaacacccgtggagccggaggtggccattcaccaaattcgaatcaccctaacaagccgcaatgtaaaatccctggaaaaggtgtgtgatgacttaatcagaggcgcaaaggaaaagaatctcaaagtgaaaggaccagttcgaatgcctgccaagactttgagaatcactacaagaaaaactacttgtggtgaagattctaagacctgggatcatttccagatgagaattcacaagcgactcattgacttgcacagtccttctgagattgttaagcagattacttccatcagtattgagccaggagttgaggtggaagttaccattgcagatgcttaagtcaactattttaataaattgattaccagttgttaaaaaaaaaacaattctgtgcctgatgacattgcagaaattagttccataaagatttgaaagatgcagggctactgatttccataacaccattattacctcacctatttggtcagtgcaagaggcaaatgttggtggagaatgaaggtggattaacacaaacatattcatgggtttgcttatcccgcccacagcacttcctccagcaccatatattcatagatttacaaatgcttattcaattgcaatgatgtcttacatacaaattatttgtccatgggcatgttttcatgataaaagatgttaagctatgggccatggctatggagttcctgcttactacatgccacatctcctagcagcaggcagcttcacagaaggtagtggaaagacctgccgcagccttaattatggtggcagtgtgggctccacatctacgactttacaatgtgtagtgaacctttggatacctctcagaatttcccatcaggacctaagcagtgattccatgagctgctagagtatggactgct

SEQ ID NO: 95836 - DNA, 1048 bp, Homo sapiens
cctcccctcattcttcacatgactagctatatcataaatacttaccccaggtcccaaaggtgtctctatgattggtaatggggccacaacccagttcctgctacccaggagactgaggttcaggtttcctgccctagtgaagcatccccatcaagctcagcatggcctgctgattctcctggagatggaggcaattcaggtacaagcctggatttctgaagaaccactcttggtgcttgcagagccacgacaagtaccagccacactcctgcaaccttcacaccttatgagaaaacagcactttatgcttctaatctatctatctatccatccatccatctatctatctatctatctatctatctatctatctatctatctatctatctatctattttttttaaatgagatctgaagaatcaaggccaaaagacccctgggtgtttctctgtaggacctctttttaaggagggaaaaacctgagtaaattaaagttcgcagccctagggcggtggcccaaggcagtggaggcccaccgctggaggtattcattggaaaaagcagtgggagtggagaattctgtctcggagtaagctgtccacaagtctgctcggaggctgtgactcactctgaggaaaaggagtgccctgtattctggaggaggctgctttctccaaacaggagatctgtggccaaggaaggaaatgaagcaatccaagactgatcagcagccgtggggcaggcagagctagacgtccacaccacccccaactctttgtgcttaatatttgccctgtgcccccaaggaataaacagcactacagaactggattctggtgagaagggaatcaggccctatcttgggccctctctggacctttgtttgcccatctcgaaggttaaggggtgaactggacagggaggaaactggcagccaactcatgtcccaactcagcctgtggctgcattttatcttactcacagttagaaaaacaattcaatttaggtgcctttgcacaaggctcttttctccagttcggcatagcca

SEQ ID NO: 95837 - DNA, 5131 bp, Homo sapiens
ggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgtcgcctcgatctcctcgtctcccgctccgccctcccttttccctggtgagtagtggcgccgcctcgtaaaggctctttcttctccccggggccgggcgcggacgccgtggcgctggaggcggacgccgtgggcggcgcggctggcttctctcttcgccgctggccgcctccactccgcccgtctgcccgcccgcgggcctttttggcggtccccgggcggcgcgcgcgggaacggcccttttccgattttcgcgcggagggcgcgcgcgggctggcagcgcaggggctgggctgggcgcgcgcgggccgcggaggacccggagccacgtgcctctccttctcgcgcgtcctactggggatgggggtctggagtagccggcagaggctattgcgggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcaggaaggaaaaattgaatactatgatgtgccaagaagtaggagaaactgggagcaaaaaaataaggaaatttattttgcgtggttttgtgtagctgtatacacattatttgtttaaaccactgttatattcaggctaatataatacgtaaacttggagttcaagacagtgtcccctgtggcttttttaactaagctgccagttaaatgggtctctgccgtgctgattatcataaccagtttataagcttctagatgaggactctgcctcccatagtgacttgactccaatttctcagaatagttgaaaagaaccagttaaaggtagtttttggcccgccccccaaaaaaacttcaggcagccatttaatttcctgtccatttgaaaatcccttttaagtgacccagtttgcatttcttttatcaagaagtcttgctggctgcaaaataaatgttgacaagggattatgttggcataggactgagttacagtgaggataaatgcatttttctcaggaaacaaagttgtcctttttctaaggtgaatggctcttaacaatccattgtaagttcttaaaagtgttcctaaactgtagaaatctgagggagatagcataaatcccagcaggtaagaatgtattcagacccacttgtctggtctagttgtaagcttctctagggaaagatttgtctcttctctgtagaaattctatgactagtaaagtgattcactaatcactgttttccatagccagaatctggcagaatatagcagtttaacactttgaaaacttgaaatatctttagcctggtataatatgagagtaaacagttcattgatatttatggactcctaagtttggtactgttttattcagcagacaggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggaaggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaatatttctgcttccttttaggagttaaatttcaagaaaatatccttagactggtaagcttttggtatcttaactgctaaaatctgaatatttgaccattaagatatattccaactcttaaatgtctatcttgaaaattaagattaacatgacctttttttttaatttcaaaaaattgcttttaaacattttctattctctgaatgtttgttccaagcatgttggggataggtgggaacagacagaatggaggtgaggtacttctatttaggactggcatcgcacagaaggaatatgcttcagtgctcctgttgagtatttttaaattctagtcaaagaaaatagggcttttggcattctcattagttagaaatatatttaggatgtcttcccttttctttagacaaaaccagaatatccaatatgtaaaagtgaactattctggtgaagatggggggttttgtgaagacctttcctgtcccacatgactagacgatgaggcattcacattatttccaggtgaagttttacttgtgtgttaggtggatctctacaatgatgagacctttcttgttttaccttcttcctagactctctggaacttttgatttttttttaaccatgaacctgtatttcacaataaactattggtatagtagtgtcattcataccctaccccatccccaacaactttgcgtagagaatacctcagatttgtttacctcagggaatacttaattgggctatgctatacaggataataaatacacaggctgctacttcagactagtcaattacaatttgatttatggataatcatattacgaaatatctttgaaaatctattgagaagtccccacataatgtctttaaaacccaggaaatttttgggggtgggagtcttgggttgggttttttggagccttttttttttttttttgagacggagtctcactctgttgcccaggctggaatgcagtggcacgatctgggcttactgcaacctccgcctctcgggctcaagcaattctcctgcctcagcctcctgagtagctgggattacaggcgccaccacacccggctagtatttttgtatttttggtagagacggggtttcaccacgttggtcaagctggtcttgaactcctgacctcaggtgctctgtccgtcttggcctcccaaagtgctgggattacaggcttgagccactgcacctggctttttttttttcttaagcgaagtctcgcctgtcacccaggctggagtacggtgacttaattg

SEQ ID NO: 95838 - DNA, 2733 bp, Homo sapiens
gctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacatttatgtcatgcttattccttgaccctccccacccaaatggtgcccccccttccatcactctcctcttacccttctttatttctcttcacagcatttgtcagtactttacattattccatactagaaggtgagtgtcagttctattagaacaggaacttggtcttattccctcctatatttcggtgcccagaatagcacttggcacacagtcttttgagtgagtggatgaccttgtgcacaatcagttattatcattgaacttcggtaaagcattaattgtggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtgtaagtacctatcaaaatatttaaatgtgaatttaaagttgtttacaaaacttgcattaaatgcccaatttacccctttttgctttacagggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgttgatgactttcatgtttgggactaaggcaaggcatggattaaattatggcgctacaagtttaatttagcaacaacaaaagattggtaacttgtaactggcaggacagtacagttttggtatctagactcatttggcctgatggtctgtgactacataggcagtgacttttattctttatactgtgacccactggatgaaatacaggacacacatgtatgtatgtagagagaaagataactggaatagtgtcatgaagccacttaatgcttactatgtgctatgcacccatattttcaaattctctctttttttttttcttaacatttgttgtggcccactgaaatgatttcagttttgagtaatgggttgtgacttgctcttaaacctcactgaagtagtaagttgctgacccaaagtagagttagctaaatatttttattatttatttatttttttgagacagttttgctcttgttgcccaggctggagtgcaatggcatgatcttggctcaccacaacctctacctcccgggttcaagcaattctcctgcttcagcctcccaagtaactgggattacaggcgtgcaccaccaagcccggctgattttgtatttttagtagagacggggtttctccatgttggtcaggctggtctccaactcctgacctcaggtggtccgcctgcctcagcctcccaaagtgctgggattacagacatgatcac

SEQ ID NO: 95839 - DNA, 4921 bp, Homo sapiens
tgcagtggcgcaatctcagctcactgcaacctccgccctgccaggttcaagtgattctcccacctcagcctcccgagtagctgggactacaggcgcccaccaccatgcccggctaatttttttttgtatttttagtagagatggggttttgccatgttgggcaggctggtctcgaactcctgacctcaagtgatctgcctgccacggcctcccaaagtgctgggattacaggcatgagccaccgtgcctggctgaaagacaaagcttttacaactattcttaaattatcaacttttgatagataatatccttgttttctgtatcttgctttgatactgctttcaaggagataatctcattaaagcattttactaaaggccagtatagtgaatgtaatcacttttacacagaattgtgtcagcatgacaaatgtgactactgagacatcattctgttaacattaaaataagtttgtaggtggtaatggaatatgtggcagttacgatcatgagctaggagagtggaacacttgctgtctttttcatagctagtcataggtccttagcgtgtagtgatctttattatcttccaaggtgaagaaaggaaaaggctcgtatgttgagaagcataggaacttgagtcccgcaggtgttcaagtgggctaggctggtgtgggttttcagatgatcattgagtttttctcccaaatttgtataggcactagcacagtaatcctgtgcacttaaatctggcagcagctgtcaggggtgatgggctggtatggggaacccctcagtccccagaggagggtttacacaatattgcagggggctgttgccctggggttttcaagatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgtaagtaataactaaacagcagaaaagtttaactactaatgttgtgtttattttttatttggccacctgtaaaaatctattagaagagattggcaaaataagagattttaaagggaaatttgaggatatgggtttgttgtccaaactgtttttagaaatggacttacatgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtagaaggataccttaatgaaaaataaggggtagatacaagatattttcgtagaggaaatatttaccccaactgcttctgtgtataacttcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactgagtaaattttggttagtatcggacttttttttccttaaaataatcattttctgcccttttcatcgatgtgaaggctgggttagcaagttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcctgtgggatttacagccatgatgcacatctctttgttttatagaggtggaaattaaagttgtcgtctttagttccctgcattgagctgtgccactttgcttgaattggtggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatactcttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagctgtactttagacaacctggtagatcattcagcagattgggtcttgccaagatctagttctgcctgaaaagtcacttctgccctctttgtttcttccagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgc

SEQ ID NO: 95840 - DNA, 1945 bp, Homo sapiens
tggatcacaaggtcaggagtttgagaccagcctggccaacatagtgaaaccccatctctactaaaaatacaaaaaattagctaggcgtggtggtgggtgcctgtaatcccagcacttgggaggctgaggcaggagaatcacatgaaaccaggaggtggaggttgcagtgagccaagattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggtctggggctccttgtccaaacagtctcaggtgtctgtttgccagaataccactggcacttcaataacctgtttccttggtctgcttctcttctaggtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatagggactgtggtggcaacttggcattttcccttttagtagcacagcctgtacactttcatgttagcacacgggtgttttttttgttttgtttttccagttttttcttttgatactttttgtttttttttttgagacggagtctcgctgtgtcaccaggctggagtgcagtggtgtgatctcggctcactgcaacctccacctcctgggttcaagcaattctcctgcctcagcctcctgagtagctgggactacaggcgcccaccaccacatctggctaatttttagtagagacaagct

SEQ ID NO: 95841 - DNA, 1013 bp, Homo sapiens
gagcctctagagctagggaagggaccagaggagcggttatatttctactttagttgtctgccatggggcagggacacatggtgagaaccctggccccccccttttttttcggcatagatattgccttttctttttttgagacagagtttcgctcttgtcacccagttggagtgcaatggcgcgatgtcggctcactgcaatctctgcctcccagggttcaagcgattttcctgcctcaacctcctgagtagctgggattacaggcttgcgccaccacgcccgactaatttttgtatttttagtagagacagagtttcaccacgttggccgggctggtctcaaactcctgaccttaggtgatccacccacctcagcctcccaaagtgctgggattacaggcgtgagccaccacggctcagctgacattgccttttcttaactaaaagttttttgaaaatcaaggttgggcaaattgaagagccagctggtccaacaaggcttgttaacaaaaacaggtctgccaacatttccctttcctgaggcaaccactttcaattcttttggtatttgtctctttatatctaaataatatacttgtgttactatttccctctcgcattttttggctgagtgcgggtgacacttctgggactactgggcctttgtcttgggtaggagttctccaccaggggtgacttttgctgtccccagtccccatttgtgactctcccttgtcccatttatggtagtaatatttggagacatttttggttgtcacaattgggggatggtactgaccagagatgctgctgtaagcgtcctacagtacacagggcaactccacaacagaaaatacctgggctgaaatgtcagtagtgctgaggttgcagaaccctgacatagggtgatctggttgggctctttccttggaggaaccccagaaaagcttcagaaggctaaaagcctaactaatgaacgttctaggactcagagggggaagtggtcaccacata

SEQ ID NO: 95842 - DNA, 1053 bp, Homo sapiens
gggctctaactgctgtgagtcatagaatttggtagaagcgactgccagtttccaggttcaggtcttaggagtctggcagcttccacttcctgtgtcttggaacacttgccctggggaaaagtagcttccataaaagaagcctgactaccctgagactgctgtgttgtgaggtagtccaagcagattcatggagaggaatcaagatctctttccccttctctctccagccaacatccttggcagagctgtgagccaacagccagccccagcctgccagccgtgtgagcaagcagtcttggaaggtgattctacagccccagctgaaacactccaactgatgccatgtgagccgagaagagcagccaaactgagcccttctcaaatccctgatcctccaaatgtaggcaaaataaattgctggttttaagccactaagttttgatatagattgttatgtaataatagatatcagagctctagctaaggcaggtgctgaagggaagatgtttttatcattcatagatatcacaaaatatgtatatttaatgcatttcaaaattttagttctaaccaatacaattctttggagtttacttttcccgttatagaaatggtacattataaatcacctacctgcgagtctcaatctactcttgttatttttctatgttccgttctagtatttgctttaagtgcatatttaatttgtaattaaatatgtaattatgaaatagatataatttagatttctcgtgtcatgtcatttttagatgggattggccaatggaaatcagacagtaattacagtggtatgaaattagtcatagcttgccttaattaattttttgtttatttttttttttgaggcagagtttcgctcttgtcacctgggctgtagtgcagtggcatgatcttggctcactgcaacctccgcctcccaggttcaagcagttctcctgcctcagactcccgagtagctgtgattacaggagtgtaccaccaagcctggctactttttgcatttttagtagagatagggtttcaccatgttgg

SEQ ID NO: 95843 - DNA, 1108 bp, Homo sapiens
tgccttgtggagttccctgattccttagagggtggtggggaaactgaacacttcggctttatatgtgtgctcatatacatatgagcaggcctaaaatatgtgtgcagtttttacacaagggatgtcgtagtctgcccaatgtttggcaccttactttgaacagcacagataagggatcactccattttcatacagagtgctgccttattatgttagatggctgaacagtgaatgaaccatgatttcttcttttttttttttttttcctggaagcatgctagatggctcaccatgatttatttagtacatcttcccctgatggccattaggttgttgggagcctttagtaactgaaacagtactgcaccctggtgcatgtgtattactcgtctgtgttaagtagggatgttgcttagcccagctggaggagaattctagtttttaacactcctgggtgtgaagtcacagtgggctggatgggcctcccagcgcctgcttccagagaagtctctatatgcctcgtgggtggatgtagaacctgggagtgaggcttggcaggaaatctgcagtgagaaatgtcacaacccaaacagtaactcatacacagagcttcgcatgtctcattccacaaggatcagcagctggaccattacctggagctatagacttgatgaaagccccagaaatggctaaggcagaggaagtgcctgggagttgtttggcaatttgacacaatatcttttagatatttttaaagccactgagcaaatcaaatcctcaagtttagggatggattcaaaggccagtcctttcactatcggactggaatgatttttagtcatcttacctctcagcatttactccttttcccagatgcagcagccccacctccttccagggagtcacctgtccaggtcaggtgcctcctcaggggaagcatccctcacccgccagattgccagggcgtgtgactctatctgggccaaccacatcctctctcctggactttgactgctgcgaggagtgaggctagaaccagagaaacctagctgatgctgactcatgctggaggttcctgcggagtgagcatcagagctcatgagctcat

SEQ ID NO: 95844 - DNA, 1078 bp, Homo sapiens
ggatagcacatgtcactgtgtccgtggtgaaggggagagatcttcgtggagggaaggaagtgaagaggacctcccgccggagtgtgtgtggtcagttccctgatgggttgttacagctatggaagtgcgtcccttgtgagtgcaagtgtacgtctgcattttgggagtccccatagctgtgtatttaaaggagcccctgtgtgctgctgtggcgtgtggggtgtttatgggctgagacccctggcccccaccccaggtgcccatctcaccgctggtgccagtcctgcttcgggccttgaggggagaccagtccctccggctctctccagtctacactggccatcgtcacccagagtgaggaggaggcaagtgtcccttcctcagcctcctgcacactatcagtggggcccagccactctcctctccctcagaagcttcaggcaccactgacccagctggccccaccctgtgctcccatctcccccgagcccctttgagggaggagtcagccaggacaggctctggtatcccatccttttctctagagcaaaagcagcaaggatctaggaagagcaattcatgtccactgcaccctcctcattcctagggcttatgcatccatggacctcagcggcctggagagtagcggagaacccagaatgaggcaaatgacgggatacaaagtcaggaggctccgtactgtactcatgataaaagaaataactcagtactcttgctttatgcacaattctgacacatttggttatcaaatttcccagctcaaggccatttagagaagacattgctagaagcatgccaagggctataagaattgggaagataactgggatctcagaatgggggggtggcagaaagtacaaaaggaagtgtcaaaaagcagaaccactggggccatttagtgtagagttctaaatactccctgagggcccataccactggctccacaaccaagcatgtgacttccatttggagcggtgacctggatcatccagaaagacttaactgaagtgccaggccctcttttaaaaagaaagacaaggctgggcacagtggctca

SEQ ID NO: 95845 - DNA, 1049 bp, Homo sapiens
agttgtgaccaggaatcctggccactctgttgtttctgagggaggaaacagacaaagacatacagacccagagaggctaagcggcctgcccgaagtcacacagccagtagggggaaagctgagagtcaaatccacttctcctgacccaagaatcccgtggtgtttctgcaggcggtgccttcctcctgcacctgaccccaccctccccacccaccccaaggatgttcagtgagtggaaggtacacaccttccacccaggtatgacttgaagtcatcctccagggcagggagttgtgtgagcccacacaatttgggctttgtcctgagagctgaggctttaggtttgagtcattgccgtgtgacctcaggaaggtcacctgactccctcacctgtcccatggggcctacggggcctatgctgtccctgcctcagtctgggcagagtctcacgtgatgtaaggggccaggggtgttatgcacacagctcagggtgtgcaagtcctccgctgggccagggcagacacaggcaggcagggccagtgggtgacacaggccgtcactcacccccactgacccctggtggcttttcagagcggttggaggagctgaagagactggacacgcacctggcagacatataccagtgagaccctggcctttctgggggtgggatggggcagggagaggtatggaggggcagtggctcacatccctgcctggcggcgaggtcccggccaaggttgtcagaacatcaagatctgtttcaggctgggcttccctagcaaactgaatgtggggacccctctcacccccttgggactgctcacactctgtgacctctaggcccttcctctgaacctatccagcactcagggacctgccctcgcacgcatgcacacacccagcccggcacccccactggatgcccgcacggtgtccccccacccgacccctgctggggtctaaggagactgtcctggcactcggaggctctgtgcctcccctgggtcacctagctatttttgtaccaggcacatggatgggagcag

SEQ ID NO: 95846 - DNA, 1058 bp, Homo sapiens
caggaggctgaggcaggagaatcgtttgaacccagaaagtggaatttggagtgaatgaagatcacgccactgcactccagcctggacaacaagagcgaaactccatctcaaaaaaaaagagtagatttaactggggaacaatcaagtcatgtagctaagtaacccactacatgtggtaagaaggacataaaatagataatagtagattctttgagaatgaggctacaattcagttatttggttaaaacatggtagtgttttaaaaggaataaaaagagaagacaggaatccatgcctttgttgcaccctattgacctcacttagggtgtcagcctctagccacagtgtgcctggcacagtctgatttccttcctttcattttggtgattgtgtttgggctaccatgaaaactattaatgcaagacagtttttgcccactgtccaaggcagtaaccatgtggtcatcctggggaggaatgggattgggaggttgtgtgagttaaccttagtgagtcaagaaaattgatccaaggtgtggtgtaagggtagaaggccagtgattagtccctaagagagctctcttgagagtgaataggagactggagatatgttcagagtcttgaaagggtgtcaagaatctacgtacagcagtctcgggggctggctacgagggtagcctgatgtagcaagacactgctacagagcttaacgtgaaaaaacaagttataagtcacacttcaaatcaatcactattcagtatgtggagcccatgaagatcactgggaaatcattgtatgtatgtatttttcatgttattgacttctagttgaagtattaaattggtaaatcttactttccttcatgatcttacatacacagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggt

SEQ ID NO: 95847 - DNA, 1050 bp, Homo sapiens
aaatagaaaatgtttatcatagctgaaggtaagaaatatgttcatttttacatggtacaaaaacaaaacaaatcctagagtaaacatttacatattcataatattccatatttataataacgagaacactgagtagtgatgagaatttccataggactaatagcagtgtaaagaatgacacaggcatgcgaaggtcataggggtgtatatgtgtaagtgtcagggatttatgcaggtgtttatgaaagagggttaaatcccacaaaaagataatttgaaatggattcactggtttggttcccttctggcttgtgccgtaagcaggacagtgacatggacccaacgaatggggagcactaccatgcccagaaatccaggtactggcacactcagccaagcagcaccttctactgctagaaatgggggagacgcaaaggtaagttcacaattgagaatcactaacatttgagaaaaccaacactacatgaaagaggcataaaactcaacaaacaagaatgaacactggagcaaagaggaatacttttaagagtatcacagtcaatatcttcagagtgataagagagagtattgctatcctaaaactagaatgggctgttatgaaaaataaccaacagaaaggcagaacaactgcatggacagcgctgaagaatacatctgtgagctgaaaattcagctgtgaaatcctcctagaaaccagtgtaataaaacaatgaagtgaacagtatgaaaacaacatttagagttctgaaggatatatccattactcaataactccaatatccatctaagagagtttctagaaggaaaaaagttcaacacacaaagtggttgtagaagaagaatttcaagaaatgaacaaagaaacagttgttcaggttgaaaaggctctcagatagttaagcaggatgaatgggagaaaaaaatataatagaaaaccaaagataaaaagaaaatcgtacaagcttccagagagggggaagaaaaggattacctataaaggaatgagaatcagactgacgtgagacatta

SEQ ID NO: 95848 - DNA, 1042 bp, Homo sapiens
agtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggtactttgctttaat

SEQ ID NO: 95849 - DNA, 1013 bp, Homo sapiens
agatggtagaaaaaggactgaagctcaatcccttagcatttggccttcatgagaaacagcactttaggactatggctgtaacatgatgctataggctcttcattcatttgttcattcagcaagcatttattacatgcctagtagatgtgtggcccagtctattaataagagttgatttccttagttgattggagagagatctaaattagttatgaagattgtcagtgacactagtatcttactgtatccaggcaggtaggagggaaacattgtttctgtcctgccttcaacataggcctaagacattttgcatcaaatctgagcactacagtgattctaagccccctaaacattttgatctccaagtgaacaaatcatacctttggaaatcaatttagcatttagatgacatttatctcagtatttaagtcaacaattgaaggttaaacacacgcacacacatacacacacacacatacacacaaaattcctaagtatatcagtaaactctttcaatatactctttagaatgtacttttcttgtgagtatgagtagaatttaacaatacttttatggaaaaatagatttcaaattccaagttgagatgcttctttcctattcttttaaatctaaagcaagtaaatatacttttgaggcttccttggggtttccaatgtcagcaggatttatttcccaaacctattcctctcctactttttcccttctcagtaaatgttgtttctcctcttccttctgttggttctatctccaaaatataacccaattctgtctgtttctttccacttcttttccttaccccacccccatgactgctgtgaaacctcctcattggactttctgcttctctattgccttccttctgatctgttttctattttaggaaatataagtgaggtcaggccattgcactgtgtgaaacccattaatgggttttcattgtacctcaaatgaaatccaaatgcaagctctgcaagcactagtctctgcatat

SEQ ID NO: 95850 - DNA, 1016 bp, Homo sapiens
ttttttttttgagacagagtctcactctgtcgcccaggctggagtgcagtggcacgatctcggccccctgcaagttccgcctcccgggttcacaccattctcctgcctcagcctccccagcagctgggactacaggcacctgccgccacgcccggctaattttttgtatttttagtagagacagggtttcaccatgttagccaggatggtctcgatctcctgaccttgtgatctgcccgcctcggcctcccaaagtgttgggattacaggcgtgagccaccgtgtccagcctgtaacacttcttatagcactgagttgaaaccttgctcctcctggttcctccaggaaactgaaatctttttgagccaagtctagcacagtgcctggcatgtacattcaggtggtagagtttgctgcttgaatgggtgaatgggaatttgacagcatttttattcaaattagtatgtgccaggtatcgtgctcgctctgcattatccaagggagtgagcctctgtgcaagtatttgagacacgagggaaataggttctactgtgggaaaaagagcatttcatggacttgctctccaagcagccttctgatttttaatttggctcccagtatcttgatatcaggagtcagtcacaagaactccatctttagtaagttatattttccacaggaaatctaaaagctgttcaacatgttagtttcctgtgaatttgataagccataatccattcctaacactgagccctcctgaaatttggtgtctggtcctgcagatagctaaaagccctgtctgggtggcctaggggactcctctgttttgcctccacaggatccactttgcaaattaaccactggttctcccgttgtaggaactgccaccttcctcagagcctgtctttcttccttccttccttccttcctctttctttttctttctctctctctttctttcttttcttttctttctttctttctttctttctttctttctttctttctttcttcct

SEQ ID NO: 95851 - DNA, 1126 bp, Homo sapiens
aggctgctgagctctttgttggggaagggggagagacccacagaaggggtgagggatgtggggtgagaggacccagggaggagaggcccagcctggccccagccccctaggggtctttgtcctccccaggcagcagctgtactgggtcccctttgtcattctgtccctacccccgtgatctctcccctggatactctctgcctacctcagaccgccatcctctgctcccttcctgagcctctgctggcctcaccacaggccttcagtagcactgtcttctctctctctctctctctctgtgtgtgtgtgtgtgcgtgcaaatttgcatgatggctctttctgtgtgggcaggatgtggggccttctcgagtcatttctctcacggtgcttcagaccccaggttcagacagaggcctctgtcctgcagctccaggccagggagttccactcatggttcctgcctgcagcaacatctgtaattcggcagcttctcgggctgcagagggacaggacaggtcacctcctaagtccttggaccggccagaagccttcataccttttccataggagggaaaacatttccagggtaaaaggagggagcgtttgcttgctgagtctggaagctcaaaaagggaaacagagacaggcaccctccggatgaaggttcagggctgactccttgaggaggctgagagctgagcctgaccaggagggctatttgtttgtttttgttaattttggcttctctaaatggacagcaaaacaacaaaattaaactgagcaggacacggtatttcctgagcacccaccaagggccaggcccagcactcagacccattccaactttacaacaaacctgtgaagtatagctttattgggtcttggttccttattttacagaaaaggaaccaggtggagtttttcacccagagccacatggcttgtcagctgtagagttaggatgggattctgctctgcattcttcactatgaccctgaagtgggcaaaggagggtggtcagtgcagggcacccaaggccatcaccttcctactcagggcaggctcataccccagcctctgtgcccggtctccccgttcttcagccagggtacaaggctgcaatgcc

SEQ ID NO: 95852 - DNA, 1078 bp, Homo sapiens
ctgacatcttcctgcagatggagagaaagaaagacatctcagaagtctatggggacagcctacagctccccacagggttgctccaggtaacgctggaaggtgaaagctgagcaggctccagtccccatcctaggtatggaacagatcaaaccaccacaggcctatgtctgaccttgttcccaccccatgctcctctcccacctgtgtccttctctttgcaggagaagggacagacagaggttctcagtgatgagctcaggctctggaagggcacttgaagtttggctttagttcttcctttcccatataggggagctcagcttccagggtcctgggcctgctgtgacccaggttgttactcctgatataactgcttcctgggctctcatgatctcagctgagcctggctttctgctgatgatatttgtttgttgcttgccaggcaccagggtagataaaaagatcaccaagacccgcacctttttccttaggagggtctgagtcttcaggagacggagacatatggaatgtgtcggggttggaaggagcaggactggagggtcggggtgaggggggcagagggaaacagggccgtcagggtggcctgaggccagatcatacagggtctccaatgcagccaaggagagtggctttttgtgaatgtgcagtgcaacttttttttttttttgagacagagtctcgctctgttgcccaggctggagtgcaatggtgcgatctcagctcactgcaacctccgcctcctgggttcaagagattctcctttcccagcctcccaagtagctgggattacaggcatgcaccaccatgcccagctaattttgtattttttagtagagacagggtttcaccatgttggtcaggctggtctcaaactcctgacctcaagtgatccagctgcctcggcctcccaaagcattgggatcacaggcgtgagccaacgtgcctggccagtgcagtgcaatttttaaagagaagagtgccaagctcagggcttggaggacagcctagggattttgttttaagaagatgagctgggcgcggtggctcatgcctgtaa

SEQ ID NO: 95853 - DNA, 1136 bp, Homo sapiens
tccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccgtctacaaaaaaaaaaaaaaaaaaaggccctaagcaactccaccctgcctctaagtgggcccccttggaaggcatggaaccagagcaccatttagtcaataattgctgctatgtgctaatggtgccctggtggc

SEQ ID NO: 95854 - DNA, 1066 bp, Homo sapiens
cagctctaaatgcaggtgatgatgatgacgatgatgatgatgatgatgatgatgatgatgatgatgatgatgatgatacaaagaggagcaggagaagaggacagctaacatgtattgagcagtctccttctgccggacattcttctaggctgtacatgcactgtcttatttaatcctcaaaataacactataagataggcactataattatctatcctcgttttgcagatgacaaaatgaaggcacagagaaatgatatagcttgctcaaggtcatacagaagtggtcgacctgggatttgaacccatgtcatctgatggcagagccttcacaagactggcatgtgttgcttgctagtgattccatatctacctgtctgtaatttctgtctaattccattttctgtaggaattcaaatcagtaaacagaaacttttttgcatcttttcaaatgtgttaagacagcaaagtgtacattttctctggattttctcttctgtatgttaaatacatccattctatcaagtgttccataagaggagatcattctagtgcccttaccatcttggtgctccttattgaatatccctgagttggtaataattctcactgaaggtgaaagctagaagtaaacacagtactcccagtatgattcaatctgaatggagtaaaataagagaatgtagtgcattatggttccctgtgtgggggtagagcagatggcaagaagactaggcctggagaaaagcccactgtaaaaggatggggtgatactgaatcagaaaagaagacgaaacaatgagtttaaggaggataagaactgagaacttaaacagatctgctggcttagggagagtcattgggaagaaatgcaggagctatggaaatagtaggtaatgagccagcaggagggactacgtgttgtcctctctggttacaaaaggaaagggaaaaggacagtggctggtgggaggtggaacagacagaaggatcaagtaagaggttgtttacatgctaggaaagtgaggatggtgcataaggcagggaaaggattgtcaatagagagg

SEQ ID NO: 95855 - DNA, 1060 bp, Homo sapiens
aatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagccca

SEQ ID NO: 95856 - DNA, 1041 bp, Homo sapiens
gcaagagtagtactattgctggatttatatgggtttgatataattttataatccaaaagaaagattggaaagggatgacaagttggttaattcattcttaactgaaagatagtggatagcatagcacataaaagcactggactctggagtaaaactgcctgtatttcagtctcggctatgtgatcttggtcaagttaccttacctctttgtgtattagctttcacatgtaaaatgggaatggcagtaataacacttccttataaggtataatattgtacattttgtgaggattaaatgagttaatacaaatataacactatattattatattgatgttgttagatgttattattgaaattgctaaattatttgatagttttacccaaagttgagattagtcttgatcacttataaataatttttatcttcatgattaggcttttcagaattctttagctcatcattaatgactgttattctcatagcattggaggcgttgtactggtaaacctggcagggtctgaaaaacctgctggaagagacacagtaggtaagtactggactctggattctctctgttagagtaaataagaaagttacatgtgcgtgctcatgtgcacagatgaacgcacaaagggtaggcactagcagggtgggttttttttgaacttttcctttggaaataacataaaaaaatgcgtaaatagtttagtgaattctcatagccttcacccagatttttcaaatgttaacaacttacataaatattatacagttataaaaatcagaaattaacgttgattatgatactgttatctataaagccttttcaaattttgccactttttccactaatgttctttttctgatctaggatcatttattgcatttaattgtcgtgtttccttagtttcctttaaatgcagaagtgttcctcagtcttcttgtcttttatgaccttgacacttttgtagggtaccacctagttggtttgtagaatgttcctcaatttgcatttgtctgacattttctttggttaa

SEQ ID NO: 95857 - DNA, 2332 bp, Homo sapiens
ttaaattcttttctcctcataggactttttaccttaatccttgctgcagtatttccaagtaacagtggagatagatttaccctttctaaactattagctgtaattttaaggtaagcatatagtgtgatagctagtttgctctgcttaaaaatacaatattacaatttctgatagtggcaccagggtagtttgtattgtaagagcaaagaaagatgtggataaaagaaggctttaagtggacatgatgctacttagccctgtcacatcctgcactaggtttctaaaccttcctgggtagggtaaccagagggaaaaccccaaggctgctttggttcccattcatgtgtctgcagactcatcaagtattggactgacgttcacacttaatgtagcagcttaatcctcataatctcccaagtttctatttctttttcttaaggcaatttcccctctttgttttgatttttatttctcctttttctacttctcttagaaagctaacattcagttttctctaattgtctaagcctcaggtgatgtttcagttattttctgtataattcatttggcagttttgcactactgcataatatgagtgttgctgataactatacttaaatattttaatttaactttatgtatgtttgttttgtcttccatactggtttgtaaacccttgaaggccatagccttgttttatatttgtgtcatcaaagacctagcatagggctttgcccatagacagtattgaaaaaagatgtgttggtttaataaaacttattttatgaaacaaaatcagagaaggtagcaggatgatttgatggagagtagtgtttcttggttatcaaagctgagattgaataagagctctgctgtttgccctggggcagttttcttaaactctgaaagggtttcctagttgagaaaatgatattatctattttaccttgcagccttgttttaaagtttagtggtaatagctatgaagtgtctggtattgggcaatcatagaaaactggtagctcttaatattaaatgtttttcttttttagttataagggtaaattaaccacggttgctccaatgggcagctggttgatccaactaatttaccatttagactttatggccactagggatttattcttttacatgatttactaatgttttaagccgagcaaatttttgcattagggaaatatgtttgtattggagaagtaaatgaggttttatttaactttatttaaaatatgtgctaatttataacttttcttcatgttatcttaataaagacttgataaagaaggaaatggatataaaatattgaacttgtaagtattttgacagagtacattacttcttctcattaaagtaggtagacgaacagaggttggcaaactatgttgggtcagctgctggttttgtaaataagattgtattagaacacagccactctcatctatttacaaattgtctatggccattttagcactgcagaggcagagctgaattgcaataccatgtggcccagaagcctaaaatatttactatctgtacctttaaaaaaaagtgttacttagaaattttttgagtaagtatatgttcttaagaattatgtattaaacattgtttaatattttgttttgaattggcattttactaagagattcaatttctgaggctataaaaagaattttacataacaacaatcttgaagggaatctaagcaaagaaatctcatttcatcaattgagagacaagagtgtggcctcaagccaaacaacttggaatccaatcccatctccatcattactagttttgagatcttgaacaagttccttacatttctgtgccaattttctcgtctgtatattggggataataataggatttctctcataggattattatgaggattaaatgagtagaagttgtaaagtgcttggaacaatgtctgatacacaacaggaggtgctcactatatttagccattatcataatcatcatcatttaaatggaaacaaaatccctggtttctaataaattgtggatactcaataaataatagctgaatctgaatatgaacagtgattattacagaaaattgggatgatttaattgaagggtttgcatatttagtgtaaggactgcacttgagttctgatgacatctttccataagggaatacatattttctttcatcttcctctcccactgccacactggtctttctcatcagggtgagagaattaggctaatttttttttttaattagcaatatctcatctacttgaaaacgtgttacaatttataagattcatagaaatagaca

SEQ ID NO: 95858 - DNA, 1002 bp, Homo sapiens
agctaagatgacaggcacctgccaacactgctagctaatttttttgtatttttagtagagacagggttttaccatgttggtcaggctagtcttgaactcctgacctcaaatgatccaccagccttggcctgttacttgcctttttaactaacccatccctcttttccctacttatctgaaatgttatagtagtgttccgaaaagggcataagctttggttttagactaacttgggttttaatcctgactgtcaggattaaaaatctctcagcctcaaatttttcatcaataaaatgaagataatacctacctcacaatggtgaatatgtggcattagctgctattattattagtaacagttttagtcttacaggttgattctggatttttgcttctatttatctgagttacgtctgactagtcctacagtataatgtaagtttcattgaattttgtatcttgttatctgtatttagtttgcagatgctgaaggttactttgctgcttgcacaacagatacaactatgaatagttctttggtaagtgcttcttttcttgtcaggaatagagaggtggggttgagccatggtaggaaaaactgaaacaggtttgatggcagcaaagctgtattacaacatagatatggctcaatattgggtgcccatcattaggattgtaatttggtactttttttctccttagggttacctggggcctagaggtaagcaatttagctgcctctgaagagagaggggaagggaaaactggttcaggagtgaaaataataaaggacaatcctttgttactaaccaactttttcacttcatgcacattattattatcatttagaaacaaatatttttgacactgagactatataggcaaattattcgtttgttccacaaattttttacagtgacaaatctgtgttaaacacgttctaggctctgaagatacagctttgttttagtgtgtgagtgtgtgcgtatttgcgaggggaca

SEQ ID NO: 95859 - DNA, 1047 bp, Homo sapiens
cacgatccttccacaggatgctaaagtaggaaaactagagaatgtattagatgaattagccatgtgacctggaggaagacatttactctttctatgcctcagtttttttgttgttttgtcttgtgtttttgagacggagtcttcgtctgtcacccaggctggagtgcagtggcacaatctcggctcactgcaacctccgcctactggcttcaagcgattctcctgcctcagcctcccgaatagctgggactacaggcgcatgccaccatgctctgctaatttttgtatttttagtagagatggggtttcaccatattggtcaggctggtcttgtactcctgacctcaggcgatccactggcctcggcctcccaaagtgctgggattacaggtgtgagccactgtgcccagtctatgcctcagttttatcatctatataataaaggctacaatctctgtttcacctatcacacagcactgttaggaccatcaacttgtataatgttctctgaaacaattttgaaaaccttgtagctctctataagttattattagaattagtattcaatatatataaacatttttctactaaaagaaatctacagctattttacccctcccaaaaaaacttcttcctttccagtccctctggtattctccaccattttcctttagacaattaaatgctatcacttttaagattaaaagaaataaaaaggccgggcacggtggctcacacctgtaatcccagcactgaggtctggagtggatcacctgaggtctggagttcaagaccagcctggccaacatggtgaaaccccgtctctactaaaaacacaaaaattagctgggcatggtgatgcacgcctgtaatcccagctacttgggaggctgaggcaggagaatcgcttgaactcaggtggcggaggttgccgtgagccaagaacatgctattgcactccagcctgggtgacagcaaaactcctgtctcaaaaaaaaaaaaaaaaaattctgctacttttgctaccattcaaaaaagtcataagta

SEQ ID NO: 95860 - DNA, 1055 bp, Homo sapiens
ccaggcaaattgagatgattgctcacccgagggccaccgataaagcaaatggaccgtggagagctgctgtttgtattgattcctgtaaccaaaaggccacggcgggcagaagtgattacaatctcttctgccataggaaatagatttctatgtcttcccctggtgtcctggggctcaatgctgcctttacccaccttggaagagttaccagagtccagaaacaattcatgacaataaatcataattcaggtttaaaagcaccagaaaacacatcccactggtgaaattctgtctcacccaaatattagcaccatgctggaaatttacagcaaaatttagagtatatcgtactgaagacaagccaggaagaaaaagaaaaagaaaaaatatataatataaatagaattcctgccaacaagcagagattaagtaaatcataaattctaacctgaaattaaaactattgataaaaagtgttcacgagagatgaagactttcaagattctatgtgcttccccggctaaaaaatgtcctagaatcttaatcacagctctctgaaacatccatttaataaaatttataaatatacccaacctcaaatccgatctatcagaataagcaatataatattaaaggattgtcattttatccatcaaaactaaattacttgtgttccacagggaagatataacatccatttataatcagctaccaatgcttttgaaaatacatattttcttttacaatgagatacattaatgttttgagtttggggaaccccagagacaatgaccatcagaaagtaggtccaagcccaggcgatatagggagaccccatctcaacaaaaaattcaataattagccaggcatggtggtgcatgcctgtagtcccagctactcaggaggctgaggtggggcccaggaggtcaaggctgcagtggcctgtaatggtgtcactacgctctagcctgggtgacagagtgagacccagcccctccccaccctcacttcccccaaaaaagaaaaaggaaaagaaaattccttctccaggaatt

SEQ ID NO: 95861 - DNA, 1005 bp, Homo sapiens
ttgtgatccacccgccttggcctcccaaagtgctgggattacaggcgtgagccactgcgcctggcctggactcttacatataataagcttgacttatcgtacaacttataattgatgctttcacgtcatgggaagatcaaattaatgcagagagcgactacgtttctggtgggagagcagcaggggtcttgagaggaacagcagtgttgactgtttcgctacctactctgggtgctgattacatctttctttcgtgcaggcaaatccacttggagctattttgggctcactgtgggcatcattctttgtatactctgctcctttcccccatagtttctctattgatgggggattactaaagaatgaagaaaagaacaaaatgaaagtggcttttgaaaaattttaaatgactgtcactatgtaacatattcattatttcatgtctccactggacattttggagatgtgagccttgcaatacctacatgaatgcttctatgattatgattattgttttgctcttcgcctaacaacttgccaagtattgtcaacctcagtgtgtgagatggggtccactcaaacatcagggccgaagtcaggtagttcagttaagtgaatttgataccaggaactagttacaaaggagttggaagggctggaaagccaaactggagaagaaggggaaccccagagtaacaatagcaggaagcctctaccgtctacctctagaactggggaggagctgagttaacagagtcctggagccattgctggggaagaagaaccccaactgcagaggaaaagtggccattgtgaagaaggtgatggtggagaagtcgtctgaatcaaaggggagaggatatgttggctcctttatctttttatctttcattgtcctaattccttctgggcatggttaaatgagcccaggaaatgcagttggcaggaatcagcttcctgtgacatagacagagtaagagaaggacaaaaataatgaatctgaga

SEQ ID NO: 95862 - DNA, 1724 bp, Homo sapiens
gcaggggagctagaaaagagaagcgctcctggtaggtttgacaagatcgctgtgacaacattctgcccagggtgtgggtggggaaagggaagaatcggactctgaaaatgggaacctacagtggggctttcatttgaccacccaccttctcctttcgactcctggtcatttccatctccctctgcgttttaaccggtgaaccaagtcacattttaattcgagggagaaagatgtcatgtgttacttctgtagcctcaaaaaagtcccccagtgagcaagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcatttctctgaaccaataattttttttatttctcccttcttagtctaattggtgagtatttttatgtctaggttcagttttaaaattagatttggcctgagtcagtaggataggacttttcaaatgtgttttgttaaagtgacgaatattgctacataattaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtgtatttttaagttattacattggtttctccaataaggagaggttattaactgcacattgatgatttgaatggaactgattaggagtccccttgccacctcactctcttttaccatttgtcacaatctgaaattccccctttaga

SEQ ID NO: 95863 - DNA, 1031 bp, Homo sapiens
tttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattccagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagatagg

SEQ ID NO: 95864 - DNA, 1004 bp, Homo sapiens
gtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttatctttatagctaa

SEQ ID NO: 95865 - DNA, 1018 bp, Homo sapiens
catttgtgtttttcagtttttttctttccagttgttcatcaagcatatgtggatttggtgggattacagttttactgagaatcaaaggaggatttatataatttaaaaaatatatatttgaaactttcccacagatgttgtttttctggctttttgcatttgaggtcttgtctctgagtggaagttgaggtttcgttgtgtgaaatgaattttgtcactggtttcttatgacttttgtgaattagtttgacaatttaaataggctaggtcatgttttactttgtagtactttgtaatgggagaagtgtaaggtaaaagtttttctcatttgaggaaaatgaattctttgacatgtctaacttattttaaaggtattgctattaaggagtcagcaaaagtgggtgatcaagctcaaaggagggtgatgaaaggtgttgatgacctagacttcttcattggtgatgaagcaatagaaaaacctacatatgcaacaaaggtatgtttttatgatttgtataaataacattttcaaaaaatagtttgttcgatgcttgtgccctctggaattcactctataatagaccttattaatatcctcaaacctcttctcagtagaaatttctttttccctatggcatccttccctgttgctttaacttttttttttcttttttttaataacccctaagaggaaagttttagccctttcaaatgagcagtatttatttttccacacccactggatctcagggccctcaataaaattacctttacttccacattgctacttctgcaaactttttttccccatctttattcaaacttacaccatttttctcttttttgaagtttatgccatctgtaagtgctgttctctttctccctctttttctttttccctttttcttttctacccttttccctccctcttttaattgaggtgtaagtatgtaagtgttaattatacagttcgaagaatttttatgactgtaatcataacaggtaaagaaacagaaca

SEQ ID NO: 95866 - DNA, 1037 bp, Homo sapiens
aggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctgaggtgggcaggctgagttgttttaggtagagaaaccaatatatgaaaaggctttacagtatgagagggactagaagtgcatgaccaatatgcctgaagcatggagaacgaggtggaaagaagtgaggaggctgtataggtaggcaggaaagagcactgaatatgttgttagaccatgttaaagaatttgaaccctatcctattggcaacattaatgagtatacctagaggaataatttttgcacttaaagtgcaaatattggaatctgcctgtttgaacttgaatcctgtctgtgctaatttctaactttgtgatatcattcagtgacttaacctttctgaattttgatttcttcgtctgtaaaatggagatattattagtacttgaagatttttttcttttctttctttttttttttttttaagacaaagcctcactttgttacccaggatggagttcagtggcatgaacatgactcactgcagccttgaatatcccaggctcaagtgatcctcctacctcagcctcccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaatg

SEQ ID NO: 95867 - DNA, 1016 bp, Homo sapiens
aacctgtggcacttttttgcttaaaaaacaatagtctgattattatatcattggtatttcttcataacaaaaatacaatataatctaactttttattaaacatctttttattaaagcagtgcatgttcataacttaaaaaatcaaatgactttataagatttaaaacaacaaaataacactttcctttcttacctctcccaacctttggttcatattccccggaggcaaacattttcaattttaacaaagtttgccctgctagtaatcttttaacatgtttcttttatttaacattttttttttatttcttctgtctttaagaatattatacattatttaccaacttcctaataggaaaaatgagaatttccctttttaccttttctctccctcaacacaaaatacctatcctttcccactcctcgcattgtagttacatcacaatttttggttaaatcaatattctgtgtctttcggtgattgtgatggactataaagttgaaagaaccatactatggacactcatacacccacaatctagattcgatgattaaccttaacatttggctataattgcttcatgacgtctatccatctttcacttcattttagtttttaaatcacttcaaagtgagttgcaaatgggagtcatttgacccctaaatactttagcacgtatttcatcaactagagctatcatttgtgtatggttattcttttcatataaaatttacatatcataaaatcaccggtctgcaccattcagtggattttgaccagggtttggcaaactttctaagggagcagatagcaaatatttttggctttgcaggggttatagtccctgaggaaacttaatgagaactttttatacaatggtccctgtcacagctactcagctgtgctgttgtagcatgttagcagccatagacaatacttaaattcataggtatgtctgtgttccaataaattttttttttttaccaaaacaggtggtgggctgtatttgacctgc

SEQ ID NO: 95868 - DNA, 1696 bp, Homo sapiens
tatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactgcattccagcctgggtgacagaaagaaactctgtctcaaagaaaaaaagaaaaagaaggtaatcttttagtaatagttgtttatagccatatatgtattgaataactggaggtagggtggttgtgtactttctgccttacattgcagtttgtaacaggccagcccacgtggacatagtttaagttctggcaagttagttctatacaattttttttttttttttttttgagatggagtcttgctctgtcgctcagtctggagtacagtggcatgatctcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttc

SEQ ID NO: 95869 - DNA, 2604 bp, Homo sapiens
aacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgatagggcacatagaagaaaaacatgaaggctatctaaagtattttattaatttttttctgccatgtaagtattatatcagtgcttcatgcaaactatcaaaatactttagcatcgtctttcaaacttattatttgccacataaccaaaaaatttcagtgggtttcacgtgttttgaaaagcagaactgccatggcaaaagtaacttacttgtctctgtttccatggtttttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttcggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtctttaaaggaatatcatttctttgtcattctcacttccaaggtttggagaagacctcaaatagtgtaatcaaatgtcttcggattccagtattttttctctttgtgtattttgattattactggtaatatttgcatctatcttggatggtgcctgtgatgtgtaaaaatactggaaaaggaagtttttttaaaaaaataaaacaaatattggttggcagttgggagtttataaattacaaatatgatgttataatctataatatatttttcagtgtttttgatgaaaacttttacttaggtcatataaccaaatatgcaacaaaatagagtaatttatatttttagccttttttctttgctcttttatttactcagaccgtaatcagttttgtttcagatagatattaaggatctatattaatttgtgtggttatcacaattattacttattcttcagttctgtattttatttattctccttacctacagcacaagattcattattactgagacagaaaatgttgaatgacattagtgaacattttcaggaaataacattgaaatagtagaagtcagctctccagtctctcaaatactgtttatatttaaagtcagaaaatatgtgtaggagatgagtatgtttatttgtactacacatatgataatatcctaacaaatttttcttccagcttaatttcctaattttattttctgaagagttttttttttttattggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtggcttatgggggggtcatgaaaagagg

SEQ ID NO: 95870 - DNA, 1282 bp, Homo sapiens
ccttcaattaaccattaaaatatataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttactgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagt

SEQ ID NO: 95871 - DNA, 1023 bp, Homo sapiens
tcagtgtaacctcgaattcctagggtcaagcaatcctttttcctcagccctctcaagtagctggaactacaggtgtgtgccaccatgcctagctagtttttaaattttttgtagagacagggtctcgctatgttgcccaggctggtgtcaaactctgggtctcaagcaatggtcctgccttggcctcccaaagcactgggattataggtgtgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctctacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaaca

SEQ ID NO: 95872 - DNA, 1079 bp, Homo sapiens
ttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtg

SEQ ID NO: 95873 - DNA, 1754 bp, Homo sapiens
ttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaa

SEQ ID NO: 95874 - DNA, 1081 bp, Homo sapiens
atgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactt

SEQ ID NO: 95875 - DNA, 1114 bp, Homo sapiens
catcctgtatactttaaatcatttctaaatgacttataataccttatacaacctaaatgctatgaaagtagttatcacactgtattatttttaattgttttttttttaatgttttcaatgggggagttggttgaatccacagacagggaattcaggtacagggagggccaactctagttctgcacccacagaggataggaacataaaaatgcggactccctaaggcctccttcccctccacgttctttcttcagtcttcctctagggggagctcaagttagctttagcacagtgtgaagccagtgcagcgtctcgcttccacttctccagggggcgctgcaaagattttggtcgccaaagatatcacggtgcgcgcgtctggaagcatttccgctctggagcattttcgttccgccgggtgccagcgttcctgtgacgcgtttcctgttggccgagctgcgcacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggtgagatgcgttgactcgcggtggctcagaagacccacgcgcgagccctggcgcgttcgggcggccgggggcccagctgctctgtgtgacggaggcagcttcccctgcagcgtgtgtgattggggagagtgaaaaggcagcttccactcgggacccgcgctgctgcccactcgtcgcgtggctccagcgctgctcctgacctttctgagcaatcagtgtcttcttacaacgttagagcgggaggactccccgttcacttctaggcttacgactaaccctgccttttgcatttccaccttagcttttggttccctcaccacctgcaagtcgcacctcacctcatccctcatttccggttatgctgcatgaaacgtctcatttccacccacttttcacatctatttaattcccgtatttctttccccaaaagcccgtctggctgtttccacagagcttctttgatactattgccttcctcta

SEQ ID NO: 95876 - DNA, 1058 bp, Homo sapiens
ttatttcactagaggtttattgtagctgttacggactcagtggtgacagccacatttagacttctaccatatatcatttttaggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcaggtaagagatgtagtgcttgtctcattgtcttgtatgaaacataaactgacaactaatggttgttctttgtcctttgttttgttagaataccccaggatttatgtataaaaacctgcagtgtctggttattgatgaagctgatcgtatcttggatgtggggtttgaagaggaattaaagcaaattattaaacttttgccaagtaagtaggtagcatctgcatttggtttgcaaagtatctgttggaggtagataagagttgttcctatagaaaaactgtactaatgccagaactttaccatagccaagtgaggtagttgtgccaattaacccgaaaggtaatttggaatacaagcatcaaatgtattataacttgatataatagttttgctgttttagaagttataaggcacgttaagcagtcttcacataggtcctgtcctccacctcttgcccattcttacctcatctaacatcccccaagaagccgcagattttttgccttacttgtacataccttggttatagtacttgcaacattatgaactggttataactaagaccatggtttccttcattatataatttatttttaaaagctttgtcaaagtataattatatctacccatttataatgtacaatttgatgttctttgatttgtttaccactgtgacatcatcgctgcaatcaagaaaatgaacatgtccatcacagtcaaaggtttcctcctgccccttttcaatttctccctcccacccctccttacacgtatacct

SEQ ID NO: 95877 - DNA, 1050 bp, Homo sapiens
atatgtatctgtttcagcacgtagacagactatgctcttttctgccacccaaactcgaaaagttgaagacctggcaaggatttctctgaaaaaggagccattgtatgttggcgttgatgatgataaagcgaatgcaacagtggatggtcttgaacaggtactttttatcaataactgaaaactgtagggatcttacttggtgtttttatgtaattgttggaaggatcattcagaaagcaaatgggttaatgaacttttaaaatgctgtaggtgaggcatgacagtttacacactgtgtttatcagtgctcttgatgaaattacacaagttaggaaatggaaaatgtccacttggttcatttgtatctgtctgcttaaacgctttctagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatgtaagtgatgatgatgagctcattgaaaacagggtatgcttattaaatcctatagattgtaggattggaggtattgccctctcctggaaacattgttctgagtagtttgatcaccactagatgatggatcctgtgtgggggagcgctgctgggtgtggaggggtatgaggactttcgaagagtgcaagacaccatcctccttgaggggcttgcggaacagttggggaaataggacataggccaagggatgagctcgaaatagggtaacagttccacaatttgggggttctactgctagtcttcctcaagattccagctctaatggatgtttttatttaattctagggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggt

SEQ ID NO: 95878 - DNA, 1381 bp, Homo sapiens
agccttcaaaagacaaagaaatttgactgtcaaggagagacagagacagttgtgtgttccaggcagaaacacaggttaaaaaaatcaaaacttcagtgtttgctgaggctgcactgtgcagggtacttaggtgaatggggtgttttgaagctaaagagaggatgggacctttcaaggagttttaatcatcttagaacccctgaaggattttatgcaagaaagtggcaagttcagcaaaagaaaataaaacttaggtgttgcttaagataaaaggcaggagtacttccagttgcttcagttgtgatttataatttgtgcctttcagaagaagaaactgagcagctgaaatgaggcctgtgcttcagtgccataggggtaacttctgagggaactagaggaccaaattttgggtcaccatccccattgtcagcattgagtaaatgtcagctgaaatgaatgtatgtcgagtcctgtggaaggaagagcagctccttcacttaggcattcctaaatcaattccgaagagaaatgatagtcatttgttttgacacaggaggtgtttttttaatgtgctcctaccaacttcctgattaaactcataaatccttattcactgtcatgaatttcatcgtgtggaagaaataattaatatgactattacacaccgaagtttaaaatcatacctgctaatttaagtccacagtcacgtggccactcctaattttctggaaatttattgcataggcttatgttcccacattttcattgttgagaatggggttgtggaggaacagtagtgttcatgccggtttttttctctgtgtagatgttagattggagttcattatcttttttgcttgatttccttaatgtttgcctccagacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgcgaagatttttgtggc

SEQ ID NO: 95879 - DNA, 1089 bp, Homo sapiens
tagttatattggtgttgatgtcagtaggtcatcaggaagcttcaccatcctggcggcagcatgccaagagactgggttggccaggagatgtctcccatagggatatgggaagggctttgagaccatcttggcctcacatgggtgctaatgtagtcaccactctctctatactctctgctttccctccaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctgccccaatgttcatgtgagtcacagcatgcagaggggctgtgcatccccctcattgaaggcacatttgatgaggctacgctgcagatgggtcatggtct

SEQ ID NO: 95880 - DNA, 1032 bp, Homo sapiens
cagtttttaaatcagggtttctcagcctcagcacagttaacatttcgggctagataattctttgctgtgggggtgtcctgtgcaatgtaggatgtttagcagcattgctggcctctacccagtgattccagtagcacccacttctcgcagttgtgacaatcaaaactgtctccagacactgccgggtgggggatggggggcaaaatagctcctagttgagaatcaccaacctgtccattgtgaaattgtagtgagaaaaaaaaatggaaacagttaatactcagtgatagaaaaattgctgaataaattgtagagcctccatgtaatatgcaaataaattaaccaacctcaaaaattatatattgaagcttcctctactgtaaggaaatccatgaaactgttaacaactgttgccttttggatgttgccagtagcccttgggcagaacatgtcttttcatcaccatttcccacaatgtttcaacagatggaaaagaaaaagcaagagaacaaaatgagaagagaccagttgaacgaccagtacttggagctgttagaaaagcagaggctatactttaagactgtgaaagagttcaaggaggtaagaggaaggctgggtagcacattaaggctaacgtgagatatatgttcacctcaaaagtagccactaaaaaacagcagttttttggttttcctctggtctgtgaagggaaataacaagacagagtgtgatctggcagtgaagtgtggcgtctaggtagctgaagattgcgtttttctgtggcccatcttgaggtctaattaaatgttttaagacatcacatcactttagttttcctaacacttagtaagcacattaactcacaaaatgactccatcagtccgtatcaagggccacttggaaacagcatttgttgtggattcagatatagaatcttctttcctgccaatcttagggtggggagggacctcaagaagctgtgtgggaagagagaactttgaagtgtcacaggcttggattcgaatcctacat

SEQ ID NO: 95881 - DNA, 1025 bp, Homo sapiens
aatttctcctcattctcactttcccatttctttttcctgtgggtaaatatcttagactttcaagcctaggacactgttaaaacattcagggaaagttgaatatccaaatggtttttgttgcatgtgagtttagaatcaatgattagcttggaattggggtacttactataagaaagaagatgttttattgttggtgtttgactgtttaataaaactataatcatccaagaagtattataattgcacttattgcaaaacggtctaccttttaatttctttttcctggggcttctcacaggagtcttgaggcggtgtttgtattcagtatctacactaagctgcttacttctttgtgtggtttttcaggaatggccatttgccctcctggaaaatgttatcacattcacctcatcatcttgttcagagatctctctcacactcactcctggtcctgaggatccttctccaccccctcctcccttatagagttgcagaacttttcctacctgacctctctcagcacctttaatccctttccaatcaatcccctgttaactccagaacatcagaaataggaaatgattaaattggagtgggccaagtgatggaaaatgtgttgggagactcttcattataagtgctgctgaatggctagacttttttaaccatttgcttataatacttcgatcacagtgaatcaattcattattcttgataactccagaatggtcttatgaagatattactatggccatgttattcccctatttaagactttttgatgatacctgttgcctatatgatattgacataaccacagttatgtccctgtacttttttacacatgctgttccctcagcccagaatgcaggttctgttgatagggattttggtcattgtgtcagaatctcttctgtacgccaggttttgaacaggcctctgtaaatgccctggcttggtgtgactggctgcccagtactgctttgcccacattgaacagggcttgattacatgaaccaaggtca

SEQ ID NO: 95882 - DNA, 1043 bp, Homo sapiens
atgtacatttacaggactccacacaggactaagaattattacctaccaataaaagagagcagtttgaaagctcatgtttccttggaacatatactactataacagatatggtagaggtacctatagagatttcaagatatttttctgtgcattgcgagcattttctctctgtatggttgtctgaatcacgggtctagtaaaagagcagaatgagaaagaacttttccctctcggtgttacataaacgatggctggccagttggtgagcccaccccattgactgtcccagcccatgggtgggttaccaagtgaaccaggctccttagattaaagtagcagttctcaacattttataatactttcaggacccagttaaagactcttaaaaataactgaggactcaatagcttgtgtattttaattcatttacagtagcttacgtattcattgacagtaacatgtattaattcatacccaatagcttatgtatttacttacaaattataatgagcacattaatattaacatcagatcagtgatatcacatgtcatgtaacatctggaagatgtcactgtataatcacgagaatgagagtgaaaaggcaaataacatattattatgaaaaggtatttggcctctgagaccttctgacagggttttgagggagcatgtggctcaaaattgagacttagatagctatcaacagaaataatctttccacatatcaagatggctgctggttttcctgcaagaagaattcttgtaagtgaagtctgaaggtcataattttaaaacaaagctgtatgtgtgccacatacactaatacgagagcatggaagctgggtgggggaatgcagtttttattttcttaggactttggccataaaagcagtttatgagcaagaaagcttgctaacagtcagagacatcacccaatccatgccaaagctgcagaacagaattgaatgagtttactcagcccccacacactggaggaagtctggaaggtgagtgatacgtggatccactggagcctgcctgc

SEQ ID NO: 95883 - DNA, 1053 bp, Homo sapiens
ctaggtgcaagggagtatggaaaatagtctcttttccagcctcagcagtactagaagatgcaatagatattaagccagtccacagaatctgccataaggtcctttacagaattcgtgtggatagccaaaatttaaccttggtctgctacactttggacctataggtttatttctaaagggtggacatactgcccagcagtgactttttggtttccccagttatatgacaatctgttgcaaggtcagatgatacttttggcttcttgatttttgcattttttcacttatgtttagtttgtttgttcagtgaatattggaaaaaccagatataaaggtagaatctttgccctcaggagaatgatacagataagtaacagttgcatgtattcaccatctgggaagtgagaggagcatgaacagatgcagggatggataggccaggctgagcacatgtgcatgggggatgcttcacaggggaggagctttagagctgaggagtggagggtgagtagggaagcaggggcgagaggggaacagcttagtttgtgcagagctctctgttcaggtagtaagtgtaataggaacacagaaggtgctgctggtggtgaggtgaaacacttgttaggctgagccatggaagagaggctttataaggctcctgaggaggttctgttttcttctgagggaagaggcctgccattgataaatgtgcatcaggccaatgcagaagttggacaaggaatgggcaggaagagtgtggggagtgaagctggaggaccaagaccaggtgagcacacaacccagaagtgaggcacagagtagccttaaacttgttctttattttcatttatttatttttgagacagagtcttgctctgtcacccaggctggagtccagtgctatgatctcggctcactgcaacctctgcctcctgggttcaagtgattctggtgcttcagcctcccaagtagctgggactacaggcgtgtgccactatgcccagctgctttttgtgtttttagtagagacagggtttcaccatgttggccagg

SEQ ID NO: 95884 - DNA, 1074 bp, Homo sapiens
aaaaaaataaaataaaataaatacatatatcatatatatatatatctgatatatatatatgtatcagaacctagataaagggtgatgaaagtacaggtatgagacattttgcagagtgcttaagtgtctcagttctggagtcatcctgtttttatcgcttactgcctttttcaccatcagcaagttttttaacctctttgtgcctaagttcgtctatagaaagataacaaggataactacactcagatgtggggatcaaatggacagcacagatacagcagaatgtgcctggcacatacctactattcaataagtgataactattacaattgctaccactattaatgacagaaggataaattgattttatattcctttttaagagcacatcatggaaagcatggtagattttttattaatctcagactacattttttaaggaattatgttaccaagccagtatctttacaggattaaaataatacaaaggaagagaccctgggagcatccttcaagatctgttagtacaacttcattttatagatacagaaactgaggcccattgaggggaactgcctttctcaaggtcatgcagctgattagtggcagagatagggctagacatcagcattcttgaccctgttgctttaaagggtgacttagcaatagctctttatagttggcctgtaaacccctgatatttaggttgcattacttagcttcagattgtagaatgagtcttgtgagagggctagctgaaatggctggtgggtggctagagtggcagcctggggcaaggtagtgtcagggacaagccttgaaatgagaaaccaggttacctagggctaggccgcgtagtgtcccagggatcttggacaaattattcagtgtctgcttcctcaatagtaaagtaaggttgatggtatgtgccctgtctctacttcacagtgtggtttataaagtgtaaaagaaaggtgagatatatatgaagatttatactttaacatgtaaggaataattcacaaaagccaacattgtcattgtttggcggaataaaaggtccttttagctgtt

SEQ ID NO: 95885 - DNA, 1078 bp, Homo sapiens
gtgctgggattacaggtgtgagcccccacgccggccctaagtcctaagtgtaaagttttttttagaaaacaccataaaaccttgttcctgtttgtaaggagtcataatccatttgagaagactgtcaaagtaaaccatgggttagagaaaaaggaagtattgtgctctaaccttccttttccctggattccttcagcatgtgatgagtagtatatactacttgggcatgtgtctccctcagctatgaagattaacagcccgttgaggaccgcggacccatttgtgactccaacaacactgtccacatacttctgtgtgacacttgctgaattttcagagaatctattgtggtgatgtagccaatgtcatctactccttggcaatgagcttgtggcatcaggggatatacctggtgttcctttattcagcatatcttttaccagccaaagttttaccttttattttaggtggaaacaagagaagatgaagaacaaaatgtcaagttgactgaaattctggagctcttggttgcagctgggtatttcagggcaagaattaaaggcttatcaccctttgacaaggtaaggggaaatctttctaaccattacactatcttttgtcagaatgacatggttaatcatggcaaagaaaggaggaaaagatgatgttttaacttcttccatgtctgtgtttccatttcttcctaattcagattcattatggaagtgttcaaacttcttttcaaagacagaaatgatgtatcagtgaatacgtcagttccttttctgtgcacaaagctttaggaaatgcaaagaagcaaaataaatagttccttctttcaaggaatttacagtttgggtggggattataaaacttatggaaaataaaataatcagagttaataatgagctatcccaagtcagcgtgctcacagacggttgccagatattctgcggatagtaaatgctctgatttaggatgagagagagatcgctatgcaatgaaatcttttaattcagcagaaccttgaatgatgatgcacaaatcatagtaataggtgttgaggacacagagaaaa

SEQ ID NO: 95886 - DNA, 1048 bp, Homo sapiens
gtccttcgtttaaactttcactgactgctaagaggccacactcaccaggtcaagcaataacttatcatcatttagttcagaagctagtaaatataaatatggatagtctgtgttattaggatgtcactagaccagttaattcattaaattcattcttttttttttttttgagacagagtctcactctgtcaccgaggctggagtgcaatggcgtgagctcggttcattgcaacctctgcctcccaggttcaagcaattcttatgcctcaggcttcccagtagctgggattgcagatgtgagccactgccctgcccgaattcattctttttaaccctttacaaagatagctagacttggcctgccttccagcttacaacaactatagtggacggaaattgaaagtttattgggctttgtgtaagagctcattgttgtttgtctttgtcagaaatttagcttcaacaactggatgtattaaccagcctggtggatttttattgcttcaagagagggtctttcattcccagcagatcagacagtggcccttttccatttgatttcagtgttaatctgctaagtgaatttggagtcatacattcccatttagtgtcttgtgccaaaattacttcacaagttatattgcaaaagtaaacttctccatgctaggggtgagtggatggaagcctgggccctgcatctgtggtggggtggccagtgggtgtccattagataggtgttgaggcagtgatgatcctatttttttttggttttttttgtcttcttctcatgttttcataataaatgattgaacaaatgaagtgttcctgttttacaccccagaagttttaagaaagtacttatattatctcattttctttttctgctgacttgaactacaactactctttagcttctcttttcttagagtgttttcacttgtagacgtttctcaaccatcccagattttttgcagaagggagagaaggtgtgaattatttatattacttaagaaaatttttatgtccactaggaactagtgaatgctga

SEQ ID NO: 95887 - DNA, 1006 bp, Homo sapiens
agttgtcattgcttgttttttggtttttgttttttttgttgttgttgttgttaattgtagagacaggtttttgccatgtttcccaggctggtcttgaactcctgggctcaagcaatctgcctgcctcagcctcccaaagtgctgggattacaggtgtgagccaccacacccaaactacactgtttttcccccctttaatagcacctatttctacctgatattatcttattaattacatgtttaatttctgtcagtaattatcttgtttggtgtgttgactgcagtatctgcagcatcaggaacagtttctggcacagagaaactcttctcaaattgactgcttattggaatcacctgtgaagctttgaaaatcccattacctacccccgaccaaaagaaagaattgtttagttattaaatcactttacaaaaaaatgtaaatattattttctccaggagatagagaatgtagcagatattctcaaacatgtttatttactactgtgtagttggccccttgttgaatcctttttaatgtagctaatagagtgtggttgtacaaactatgaaagttattgaaattctttgataaaactatcatttttgggggaaaacgtattggaagaactcatccaagtgtgtgtgtgtacacgctgtgtttttctaaccttcagtccagaagtagaaggggtttaaatctgcttgcactgcctgtgcctccattatgttactgtagaaatgtgacatgctaaatataggatggtgcattataaaattgtaccgcttgagaatagaccagcatgccattaagaatttttaggaagaactcatttaacctaagagctctttgtttatggattttgaattttatatgccactgtgatctataaagaaacaaatccataatgaagtcactattcactactgtgttgtatataaaacaatatgttccaaggcaaaaaattcaatattcatgcctctccctagcccaattaaatcaggattg

SEQ ID NO: 95888 - DNA, 1565 bp, Homo sapiens
gcttcgttgcaatttcttttttggatttctctatacgtgcagcatggtcagtttggtgatacgtgttctcccaaacctcccccgccttccccagtagctggttatagagccaagatgtggcctttgggacatagataatgcccttttaatgacacttgaaattaattcctttagtgtaatcctctagcaaagagatgagaaaactgaatttgtaaagcttaattttacccagagattttggtgtagaaaagggccatacatttgtgaatagatgcttaagtaggtgatgaaaataaaatatcatttgagcaaactgtcctataccagaaagtctcaggcaccaaaatagcttggcaggttgtaagataatgttcacttcaaggctttatcctcaacaaattaaaactagaacagttgacataatagaaagggatactgtgtccttggtactcttgtttctgaactgcattattataaaatgtgtctgtcagtaaatcatagagagaatgtggtaccctgttaaatagctgtcaactcttctattttcaagttcctgtacgattctcaagtaattctaaacctgttggagaagtaatattggtttccttttttgcaaaagtgtgttcctttagtgatacttgtgttctgaggcttccagttacatttttagcaaagaaagcatttcttaaataatgggtaaagccttataattgggaatgtatgtagactgttctttttgttttgttttgttttttgttttggaggggttacagttggtaggatctattgattaatgtcttttgtgtatctggtattgggtaaatactggagacagttttaatcccacctagcttcatacattgtactaagagactgaatgtacttgagtagaagcaattaattcccttctcaacagaggcatctcttatttagaaaaatgaacagatgatattatttggttacaacttttaagatgacttcttaacactgatctcagaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccagtaagtattaatccttcaatttttggtgcttgtttgctagataaataaatgataaccgctttcagaattgagattatgaaatgaggttagccagtttaatctacagagtagtttattttcattgtaattatcttaagtgtcattgcagttcctctgtgggtattaaagacatgtctgttattctagatatacatctccagatttcctctatgttcgttcttggttaccatgtatattttttgctggaggcataacaatgggaaacattggtcgacaactggcaatggtaagctgatgctcacttttctgaataagatgtggaacaaatgacaagttttctctaaaaggcagtcctttaagggaaagcaatttgtgaagacaacattctttgattgcttttt

SEQ ID NO: 95889 - DNA, 2510 bp, Homo sapiens
gattgatctaaattctaaatcatatactgccactacttgcttgtaatgcagaaatctcatctttctcttgcttttggctgtggctttttcacttccagaatgtgaattatttttttccctgtcacatttgtcatttaatcatagtaattatgtaactcttggattatttgaggaataaatgggcacatagtaataaaatgttcatttttagagcttttcagtttatttggaagttgctattcaaaagaagtcttaatctgttaaccttttaaccttttaatttttgcagtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttctcatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggttaagagtctgtttttcttctttgtggtaagtcttagaatatggtactgtggattaatctaatgaaattaacatatgtggttgaagttaccaagaaacgatgaaaagaaactaaatatagttgacccttgaacaacaggagttaggggcaccactccccaacatagttgaaaatccatgtataacttttgactcctccaaaacttaactactaatagcctactcttgatgggaagccttaccaataagaaacagttgatgaacacatattgtgtatggtatatgtattatatactgttttcttacaatagtgtaagctaaggaaaagaaaatgtgtttactcttcattcagtggaagtggaccatcctaaaagtcttcactcatgctatcttcatgctgagtagtaggctgaggaggaggaggaggaggggttggtcttgctgttgcgggggtggaagaagatgtgcattatta

SEQ ID NO: 95890 - DNA, 1024 bp, Homo sapiens
aggaggaaaaggttgatggctttttgctatttggagccaagaaggagagagacttggcttttagaattggactcagaaggaggaaagtaacacacttatgtacccggccctgaggaaggcaggcatgtctcaaattttatcgtatttattctaagggcttccaagaactgatttctcagaaaagtcaacagcaggtttttctggggctagataatggctccacggaacagctagagctgcatacgtttcttgccacgaggagctcttaccaagacaaggtggtttttaatgccaccttggtttttaatgcattttcttggcgaaagaatgccagactccatgtgtgagaacttccaccagtgagtcgagcccaggtgccaggctctgtaggacagtttaaaggtgcccagccatacctgactacagcaccttaaatgcaggctgcatcatgggactcccaggtatggaccaggaggaacagtggagagtgttggatgcagggcctggagggaacggagcaagcaagctggctggaaaagacttggaggagggctttgacctgggcccacctcatgctgtcaggctcagggagcagggagtgcattccagtctgagggaacaatctgaaaaggcacagagataagaaacaatgctcctagacctcagttttctcacctgaaaaatgaagactatagtacctacctgcgggctcatggcaaggctgagagatcatatatgtaaagctcagcatagagtaggtgttcagtctgtgtttggagactaaactgaccaatgcagtgtcaacaaggcccacggggtgcttggggatctgaggactgcaatgtgcctgcagggggacctcgtgggtcagagcagcgggcttcaaggcggagagggcaggctggagctggcttgtagaaggccttatgtgctggctgagggctctactgagccgagggacatcatcaaggggggtgattctgaactgagggatggagctgcagccacagctgcccattctgca

SEQ ID NO: 95891 - DNA, 1231 bp, Homo sapiens
gagaagagggtgcctggctttgctttttcactgccagcttaacagctctggaagataggagcccaaaacagagacactgaaaaggccaaagccaatatcagccacgagagttagcaggaccagtaaagtcaccacgatgacagtttcctacctgtctggagggtggcacctctctcccaaggctcacaatggccattcccccaggacaggtgggggacgcaggtgtccagcagatgggcgacagatcttggccagccccaccaggctttctgagcacagttgcttatggagcattcacttcgggccaggttctgtggatactgtctcctgtaattagtagaatctcaactttattaagtgagaaactgagcctaggagagttacagcagagctgcctggggctctggaggctgcttgtttcctaccatgctacctccctgacacataatcctgtcgattccttacagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataactttagtgatctgagttcttgagatcatttactctgtctgacctcagccttgcttcctttttctaaagacctctggtagtgcttcagctgcatacctggtagagtataaggtgggcagtcctgccctgcaccctggcctaaggtgtgctggccctttgtggggaggaggaggatggtagaagtgacctttctctcttccttcccagttcagccacgccgaggaagatgaggcaggctggctgagaccacagtctgcaagtacttctgacggggacgttcctgccccaggacctgtgtgaggcagggtttacagtgcttgaggtttgtctgaggcccagctggtccctgattccagagtgcatgaaccagagtggaagcccccatcaagaatggagtgtgaacctgacaggaggcgttccccaagtcccaggggaagccacagacagctgtgtgggcaacagt

SEQ ID NO: 95892 - DNA, 1093 bp, Homo sapiens
gggtgcgagcgccccccgtgcccgccccctgttgcaaacctgggtccggaggaggctgggcggggagcaacctcggggggcctgcctgcctcacatagctgctcccgaggcgcggactccggctgcttctgctcgcggccttgcaagcacccgaggctcccaaacttcatttggaaagatttttcttctctttggtgtcaccagtgacttactggtcagtttaccataagggtccccctttgtgagaaatgaggcgcgtctggggtggagggacagaatcgacttgcaaagtgaggcttatgtaacagaggatgcgtctcttgggaagttagacctttctgggggtggaggttaggaagaccgtctccctccccaaagctgcgtttggggtgctgggctgggggtggacttgctgagtcgcgcggacacctcagggaaaggctctggcgagggaagaagcccgtgtctccgaagatttggcttctccttagcgtagtgcacgatgtttatgttggctaagaacctacacattcctacccgctccctcgggcctgctgctccccaaagggaagtcagtgggtggcggtaccgctgcccagcgggcgaacttcctttccgcgcaactcgcccgctgcagagtctatccgctggactgtctccaggattagagaggcccgttgacttcgtgtacaaacgctcagccacaacactgacctagtagacaccgttctgcccattgtatagatgaggtaaccgagactcagaagtaaggtgccctccgtggctggccaaggaacagaatcaagattcaaacccagggctttctggctccaaatcccactggctcctcctgcctttacctaacgggagaaaccccacccacaggacacccccaaaaccgcttctatagccaggacctaggcacctgggcgaagccgggcatggggcgcagggaattcctcccctttgttctgggggatgtctggaatcccggccaggcagcatggtgggacagaccaggtgcggtccctcccctctaggagcttacagcccatgtagggagagagacttggaaacagggcatgggggagcg

SEQ ID NO: 95893 - DNA, 1992 bp, Homo sapiens
atgctccaattaccacaaaagcaatttttatgtctcttcgcattttttatggtacacatatctttgttacattttgcattgaaacacgcacggtcccatagtatcataatcttcagtgatttataagagaaacagtctattttgtacatgggaatgtttgtcatgttgccagtctgttttaaaaatttggcaagaggtttttaaaatccaaggaggcaccactattttgtagtttttaaaaatattaattgagtaggtccatgtttattaagttagaaaatcacgagttcctcaaaagtagtaatagacgaggatgtgatttttcttactgcccattttctaacatcttagcttcagagctgtaggtattgaattgagtcaaacttgtgtttttttcttatgttctaattaaatatcttttaaaatgtccctagtaacattgttactttaaatttataacacccaatttctaatttaggctaggcataaaaccagcattgattgaacgtacttgctaaaaatactttctgggtcggatgtacttagaatgcagcctcaggaaatttcatttgaactattctgtgaccagtgtacacttcattattgttgaaggacttttaaaaaaagtatagatctctcatactcgatttaatcagtttgagcatagatgcctaactttaaaaaaaaagtataataaagtgggatagtaatacaatttacgtgagatggtaataaaaacttttcagcttttttttttaacttgtatgacttcgttaggttgttattaaactgtgatttgtatttttaaaatagttttgtctgttaaacataattgaggtgtacagtacagtatccattgttatctgtttagtatttatttatgacttacaaactctaaaagcgggatcagtgatcatggtttttagtaagttgtctttaaggagcaaagtaagagactagcagaaaattgcaaggaggtttgttattgagagtacttctgccccccgcttgagagttaatatggccacttttaaacaagaaaagttttccagaaacgtggaaatcttgtttggtgtatgtttaggggcaaatgttttaaagttttgcctaaattcttagttagaatgcaaaattgatcaactccctaggaatggttattgtggctaaatatgaattgttgctcctatgtaaaatttagttattggtagaagtttactaactgagttgaattttgttgttttcctgggttattgcatgttatgaagttttttatgtactataatccagatttgttaaatttgccagtttactagaataagctgtgaagccttgaagtttggcttagcattctgaaaatcctttttattgtttgccaggaaagcactgtaggaaggaggtgttatctcttcatttaatatttaatgagtagtatagatgatgagataggatataatgtagaaataccgtagaatcttctttattgatatgaaagtaccattgtctaggaacagcataatttcttatcttttgcatgaatggggaaaaagaggaggggaaatttattagactctttcatttcattagagatatcttccctcacattcattcttcatttcattattcttaagtagaaactttggaagagagatgcaagtatttgaattaattagtaagaacaaaatgaaaattacatcgtatagactatcatgaggaaaatatcaatttgggttggttattgtgtttgtattttttaacaaggaggttatatagagtagtagaaagaaaaaaggacccagaggggaagagtgttaatatttattgtctgttaagtgtcagatcctgtataaggggcttttcatgttgtcccactcaccaagtatgctttatgaggtaggtattattaatcccctgtcctctccctgccaaatagaagctaagggaaatgaaataacttgtctaggctcatacttctagtaagtggaattctctaaa

SEQ ID NO: 95894 - DNA, 1039 bp, Homo sapiens
tctcattcgtgcttaaaaagaaaatagtcttgttttttcctttgtcctcgtttccataatttaaacatctctgtctccaattcatgtgcctcctctttaaacctttttcaaaattcacctgtttctggaagaatgctgcttaatccactcacaaggatcagttaatgaatcctggtaataagtaccctaaggttaatatatgcttgtttagatatagtttaatatcttcttaagctttttttttttcttaagtttttatgttacctactctgtttccttaattttcttaggttaaaaaaattaaaataggaatagcgtcttttgtattgtcttatgaatttagttcatttttcaacaatgctacttttaaaagttgctaatttttaaaaaggataaatactgtaacaacgtttacccttgatcaccaccataatagctattttttgtttctttccaggtaattgttcatatttaaaaaataaagttgtgtggtagagagaattttgagaggaatataatgggaacattgtatggtggaggctgtgcaatgtaggggaaagatcacagactttggagtcaaatctggtgtggaatctagcgtcaaaaacctcgggcaaactgtctgatttctgagtcaggagtcaaatctggtgtggaatctagcgtcaaaagccttgggcaaagtgtctcatttctgagtcaggtggtcttgaattgtggggattaagatactatatgtaaggcatctagcgctgtgctttaaatacaagagatgatcagtcagtgatagttggtattattttttcatttttctattcccatcttcatgaatattatttatttattttagctacccaaagccaccaaggtcaatgaatataatttaagtgattagttaaacattcaggtgatataccataactgatttagacatttacattttgttaagcggttttttgtttatttcctcagtttaaaaccctaggactgggataatggtcaagtgtcatgaatatttctgtgccagatctctctctta

SEQ ID NO: 95895 - DNA, 1047 bp, Homo sapiens
gtggtataaaggtaaataagacatgattcttgtccttgagctcaaattctagggtggtaacacatgtcaacaaacaattaacaattcatagtgacagtgtaataagatctggggaaaagaagtggcatttgaatatggtcttggaggatcatttggaattgatctgggtagagagaacagcatatagaaaaagtcaaagtatgaaagaatgtgtggtgtgtttggagaaatgtaagttgtcttgttggatatgtctgtctctgtctgggtgggtgtggttgtctgttcctgtgtgtgaatctgtgtgtgtgtgtgtgtgtgcgcgcgcgcatgtgcgttgattgcagtgggaaatgaagtcttgtgagggtccttgtgtttgggcaatgagtgggatcattttaagacctttaaaatagagcttcccaactggtgtgccatgaatggtttaccagtgtttcggagagcaagatacccttgtttaatgggacctgggcatatcagatccccctccccaccctgccccaggatggtttcttttggctttgaatagcatttgtggcttatcccaacgtgctaagaaattattattttctttgttgccaagttgggaaaaggattgggaaaaccactgttttagagactgtaagtattagaaagtttatggttcctactcacccttggcatccactatggaatcagaaataaatatcaaatcctaaagtaagcttaaggtaaacttaagaattcttaagtcaccttcctctttctctctctttttccctccctttacccgctgcctcccccatttcactggtgtatgcgcatgtgcgcgcgtgtgtgtgtgtgtgtgtgtgtgtgtgtgtgtgtctgtgtgtgtgtgtgtgtgtgtgtgtgaaatatctctttggtgcccttgcgttactggtgccctaaacatgcatttagtctgcctcttgggaaatcagcattaacattcaggaacaatttagaggtatttaaataagggatgataagattagatgcaggttttgaaaggtaactcct

SEQ ID NO: 95896 - DNA, 1686 bp, Homo sapiens
ctgtttagtggtttatattagttactgtcattttaaaatttcattttgttggtcaaattgtcccaaatttggcctttaagttggctcctctatctccttgacctgtccccctccttggtgtatttccttactttctggcctaacaagatgttccagatgatcttaatactctcctatcccagctctgaaatcatttatttttccaaggaatcctgattttattttacttttttaagtagagatgctatttaggaactgagatccgagtgttcagtgtgttcatttctgctggcatgtcatcacttttagggggatagagctaggaaatacatatatgtatacacacatctgaatctgtttctatgcctatgtacaggtattttataagttcacactgatacaaccaattccaatctaacatctcaggattcgtctagccttttccctttctgtatttgtaaatctcttctccagcagtgataaattggttcctattatctcctcagtgtatttacttatttgctcaatccccttgtatgtgccagtcttccgaccccgcattagttgtctcctttctccttgcttgccgcctctgaggcctgtggcatggggtcctcagagcttgctgtcaggtccatgtaggaaagagaacttctcatttaatctttttcccctcatttaatcaggacagaaatttgttagaaaggtgctattcccagttttaaaaggagaacagagctgaaattcaaaaaggtctgtgtctttaggcatgttactgtgtaaatagctgagtaaatattttgcattcagattcgtctgatactgaagcatcttttctctcctgtactgcatagcctctgagtatctgtggaatccaaagtggcaggatttaaggttgtatagatggtagctgaagcaatgggtgggactgtcactgcttatgaagtatatataaagttaggaagaggcacactgacagagctcctaactaccatcactgaaagattaagggctctccgaaatcaagaagccagtgaagaagactgaaagaaaggttgtgagagaggagtgtggttgtgtgttagatgatggtgaagtaaggaatttcatgaagctgccatgttgctgagagaaaaagagaagaccaagaggctttgaatttgactgttggaaagttattgataatctcagctagttggttttccagtgtgttcaggcgagctgcctgtatcagaattatggagatactaatgaaaaatatgaactccccaggtctcatctcagaccttatagattcttaaaagggggagtggggagccaggaagtggtagcctgggaaaatctgctgaaatgctaaggttcttctgaggtgtactagtttgaggtttgttgctttagcagaagagttatagtggaagagtgtaataaactaaattgaggaaaccaagtgtacaatgaatatagatgagacagctcttcgagaagtttgccatagaggtaaaagatctcaggtcatggaagaataggggacagcatcaagaaaaatacctttgcgtttcaagggttacatacaccttaacatttgttgggattaagagaaggaaactgtaatggttattttaaagttgggtaagcaaaactaattagcaacacctactatcaaaaaaatgccctgagtgaactttg

SEQ ID NO: 95897 - DNA, 1027 bp, Homo sapiens
tgtgtttttgttatacagttgtgtaaagagcttctctttgctcatttttatacaaacacgaattctaagtatattcttgtatatagacgagtcactagcaatacaattaaaaattacgtccaaaattggaggtgactttagagggaaatccaatccagggctaatttaatgtattctttgagcaccagctaggtactaggcactgtgcttggctgtggggatacagaattgaataagacatgctctttatcatcaagattattgttctttcttcagaggaacttgaaatctagtgtatagctagaaatggtacagataagtcatagataactatgttagtctacagtaaaataagtacagataagtcaatgtttaattaatacagcagtgtatattaccataattctcagacttgtcattttaaaattgtatttaaattgtattttcgtatttgaattggcaatatggctacatggttcaagtttcaaaataatataaaaaggcatataatgagaagtcttgataccactccttctctttcctgttctgtataggtaactacttttattttttgtatattctatggtatttatgcaaatagaaacacatataaagattactgttttccccctaccttttttatgtagaaggtatttactatattaatgctttgtaccataatttttaaatttaaaatataccttggagatcatttgacttcagcatataaaaagctgtccctttcttcttctttttaaaaaatatagtagtatgttctattgtatagatatactattaagctaactaattctaattatttaaactttaagttttagacccttttacttgtgtaacccatttcctttcacctctttctgtatgaactagtgctccctgaagcattttacattaatgacctgcctgacttttctgtatctaaagggtctaactttttttttttttttttttgagacggagtctcgctctgtcgctcaggctggagtgcagtggcgcagtctctgctcac

SEQ ID NO: 95898 - DNA, 1089 bp, Homo sapiens
gagtgctgattttcaggacctgaagggtggaaaatatactgttgatatatcgttatgattgctttatcgaatgtattgtttgatggctactcctcggcttctctctgatccagtaataaaccttataaaacccaggagataaccaaaatgtagctctatacaatcatctttcatagttgttatggcaggtgaagttgttagggacatttgaatgttatttttcggcttcagatcattggaaactaggatgacttaatgttcctctattggtctgtagagattgtagtagcaaagttcaaactactgatactaatttttgtcacagctatttttaacctccataagtgaaatgctgaaaagttataaagcaggaacagtgattatttcaatgatgactgcttcttagtattggaaatattttattgacaaactatccaatccaaagttatcaaacaaattagtagaacatttgaaaaataaaaaacacttcagttaatgataacccttgttaagaatcaatagaaataagacatgtgagtaatggcaaatttttcgttttaaagttggccatttaaaagggaaatactagacatggtaatttggttattatactttaggttgggagtatgaagaattacctttgtatctggctataagtctgccacctctcagcaaatttgaaataattgagcttacagattctcacctttctaagaagtttgcctaatttaggcacttttttcaccccagaattcactcttcttggaactgaaagaatatggtggggtttataattccaaaacatttcccctggaaacacaggaaacggaaaagaaggaaaagacgttaaagctgactaggtgggttagcttcaagtgctggttctcttttcctgtgtcttcacttcataaaatcaggagttgatcatgcttttaatgtaattattttctggtcaagaaaaataccatatagaaaactttagactcctccagtgatgtagtttgcaaaataaaaatgcgttctttgaccattatgaaagtaattttatacagatttttcttcattttcttaagttacatatagaagata

SEQ ID NO: 95899 - DNA, 1022 bp, Homo sapiens
ttttttttaaacttcttggtttccccaacaccttaagttttttaaaaaagggaagggcctgccaaaattaaataatttttcctcctgttgtcattctacagtgctttaaaatacttgcatcaatgagtaatatccaacttcctgaggcagcataatcttcccgccccttttggctactccaaagtttacatattttgaattggaatatgacttccttaaaaatttatgtattaaatcttctggatggagcagttaaaaaaaaaacctctttttcaaagcagtggtaactttagtttgatgatgaactatatataacttatacctacaattcttattctggtgtttcaaaatttataactgttttccacctaagttttaattgagaaatatataataactttgccttttaaactacagcttatattttacgaaccttttatttagtgaatttttttttttttaacttagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaatgtaagtattttgtgtcttttaaaaaataatctctggctataagtctgaatttagacatatatgtaaactaggattattaaattatagtacagtttgaaaagtcttattcaagtaaaaaagtctttttggtgcaggattgtattagatgcatgctctcattcaaactgggtctttttaaaaagtgttgctcactggatgttgttgagaaaccaacagtgtgcattttgattagtagagcagatccatagtatgtgtgtggttttcataaatgtgcttgagggtgcctgaaaagaatttgttcttctaaataatttatacatattcatggtaattttacttgtactgtctgtgagtaaaatttttgccaaacaaaaataaatgacagccctgatcttatct

SEQ ID NO: 95900 - DNA, 1074 bp, Homo sapiens
cagatttaggatttagtgtgcttttctaaaaagctaaacttttgatttcttttgtattctatcatctgttaatatatagttggaatataggttgccaaacagagataacataaagtgaagagaattctacttcgtacaaatttctatttaatagaaactctcatgtattagacagttgatgtaagaaaataagccttttttcctattattcacgtgttagaattcttttttggaaaaggcataaatttaataacttttgtcttagcttaaatttagctactatttagttttcattttaactatagttttgaatgtatttcaaaatattgtaaaaaggtttggtatgtttctcagctagcataattttctgttgagcactttagttaacagtagtatgctgtatttttcagtgtagtaatcaatgtgctgtctagttactcttttagaaagacatatatattaatgtacttttatatgtttatattttaaaaatatatattacatatatttagctggcagtttcaatagacctggatatattacctagaatggtaagtaagcttaccattctgtggtgctagaaactttctctaccattatctcaggtcatcaaaaaacttaagaggaacaatatttatgaaaaattgctggttatgtggtatatttattcctctgggtatttgaacccaagccattcaaaccaaaagagttgctttgtacttttaggtagattatttatcttttaatccatgtgaatagatctccagttatgtactttacaacctgtggagtggtatgtggcagcctgcaaactaattgggggtttgaaagttttggtgtttgttttcttgtgtccacttagtaccattaagtctcagaaatcctttgtgggcagctgccaggttcaccagcatttctctgttcaccaagaaggagaactactcagtttcctttggagactaccaggcattggagtcattgcttttcatgaaagatttttgcaccacaggtaaaatattcatgttgccaaagcctgctttgtttcatctggtagttatctcatcaaagccgttt

SEQ ID NO: 95901 - DNA, 1004 bp, Homo sapiens
ctattttcactgtggctttggtataaccatttatttactgtggccaacctatggagtgtattgtccctctcatgccgtgaattcattgtcactaaatgaattcatgatatgagaattcatctcaccaaatatgtttgcattaacaactcactaaatatgtttgcattaaatactttaaaatgcatagtgtccgtactacatggattgatgtcttcaatctatgaggatttttacccctaatttttgacttgacttttactttggtgcagctgattaacgttagcctgtatgatgaacaaggaagggctgggaggaccagcctattttagttactgtgactgcgtaagaaattaccctaaaacttagtggcataaaataaccatgtattgtcctcagggattccgtgagtcagagattcacacacacacacaaaaggcttaattttgctccattatgtatcagtcctcggctggaagactcaaaggctggaggctagaatcattcgaaggcttattcactcacatggctgttacctgaaaccttagctgaggctgaggcacctatatatgacctcttgatatcctggacttcttcatagcacagtggctggtttctttctttcttttttttttttgagacggagtttcgctgttgttgcccaggctggagtacaatggcacgatctcggctcaccgcaacctccgtctcccaggttcgagcgattctcctgcctcagcctccctagtagctgggattacaggcatgtgccaccatgcctggttaattttgtgtttttagtagagacagggtttcttcatgttggtcaggctggtcttgaactcccgacctcaggtgatccacctgccttggcctcccaaagtgctaggattacaggcatgagccactgtgcccggtcacagtggctggtttctaagggtgagcatctttagagagagagccacactgtagctatattgcctttccagtctggcctgggaagccat

SEQ ID NO: 95902 - DNA, 1031 bp, Homo sapiens
cagcagattactttgatcttatggagattagttttaagctttttaagataggtctgtttcacctttgttcttactcctaggacagagtttgtctagggtctcaactaagtgactaaggtgttcatcaagatatctctcctccgagcctggaccacaccttctcagaactgcacaacctctgaaatctctgtttagttaacagctattttctcctagaaattctaaccctgtgtacgcacatcctatgaagcaagtaaggaccaaagggcaatttcatgtgtatttttatagcttttttcctttcactttctcagttctaataacctatccccaaaaccctggcaccatagcaaccccaaacattaattttagttttcttatcctagcaggactaccactgtctgcttgggctttgtttctccacagtatggtttggcaggtgcccccaaggagaaagccagcgtgagacttgattcatctgcccttttctcccaaagatcatagccctgtgttggttggtatctgttgcttgtaaatgttacatacatgttttatttggtctatatttggtccggtttttatagatgcttgtaacaggagaatattgcaataccagctactctatatgatcagaaccccaaatcctcattattttaaaatatgaaaacgtatctcattatataatcagtgaattttgatttgaaacatttaacatgttacttgctgtattttctgattcattgtttacttgacccagatagttgagccaaataggacttagatctcagttaataatagtaaatatattcatcttataaaatcgaaatggcccttgctttccaaagatggaaccctaaacagctgggctaatggatttgatattttagaagatttcatctgcaacatttgagatgcaccttcacacaagttgatctgggcatagccgttgtcagagaagcttctgtccttggctgataaattattaatgcttaattatttaacttttttgtttgtttacatatctagcatct

SEQ ID NO: 95903 - DNA, 1727 bp, Homo sapiens
cttctctagtgaatttattgataggtatagaagtttcctccagtattagcttttgtttgctacttatgttaagatgccagagtagttgatattgttattgcttgttttgtcaaattgctttcccaacagatatctttctaccatgttagcagcaataagtatttcttgtctttattttttatcattggattttattttgggggttgtttgcccatggcatgtcattataatttcccattttctttttttattttaactgaacatgttgatcatttgtctgtttttactcataagttatattttttattggagggggattatctaatcatgccttttgtaccacagtttaacagctttggaacttggggaagttgtatttactctttaatgcctacatgatagaattagtatgaggttaaaatgagatagttttctaaagttctctgagtactttggcaatgaaaatattagcaatcctttatcagtttgctataaataattgttaccatcttcgttccccttttatggcattataatacaaaattatattttaagtaatatttagccaaatatgtcactttccagtcacaatttaaatataagaataaaaggcataacaaaatgatatagatatatgcatgagttaatgtggcaataatataaactaaaaaaatatcgtgatagcctgaaagtgaaaagtattttcaatcaaatgtttctttgtattttcatatttattatatgctctttaaaccagtttgcctaaggtcaggttgttttctaaaagtgctgtgtcacatgtgaagtcttttttctcaaccaagtcattggtatgaaaacagttaccaagttaacccatttatgcctagtgctccattattggcttgctaagcttatgggagttatttatatcctactgctcaaggtcattgccaaggcctgatttttcacacaaaaaacgtttgctacctctggcataaatgggttaatagatgaggacaaaagtcaaccaggttaaaaaatgtgaagaatgtaacctatcaaagttgatttcattcaatttttttttttttttacagaaacatgatcaggggcaagtcttgttggatgtcgtcttcaagcatctagatttgactgagcaggactattttggtttacagttggctgatgattccacagataacccagtaagtgtaagattttgtctttcattttcatttagtttttcctctcagtttagtgtagaaagtcctttctgatttacagtgttcactgatttgatgagttttttttttacttgacttaaatagaggtaattcttttgcttttgttcctcttttcttgacattttaatctttcagaagttattagctttaaggttttcataattatgtcaggtaatgtcactttcattaattatgtgtctcagacaactaaaaagtaaatccaatttatgcctgttgactgaaagagaggaaattgggcataaaggttaaaataccttcagatgtatataaattagtctgcactaaagtaaaattagttttttattgtatttatagagagctatttctaataaaaattcttaatttattcaatgtcaaatttccaaatttcatcagagaccctcacaaataagatagagattaaatttcagagctgtacaattatttggcattaaatttcttggatttttacttattcttcagtaattgcaattgtggttc

SEQ ID NO: 95904 - DNA, 1052 bp, Homo sapiens
atgtttccactgtaatatcttaattcaagctcttatttgcctgttgtgtaatcctctttggtagcctgctaaatgcaattttttgcttcttgtctcgtttaactctgttgtattttgagagggaatggcaaagagacctggggtgcacagaagtgtttaagaaagaagcaggagcatatgcagagatcaagagtgaagaaacaggaatgctgaatttgaagaactggaaaaaagttttagtattaaacctttatttaataaaaggagaaggggtaaaagatgagatttgagcattacatgatatcatgaaaagccttttaatccatgataaaaatcaaacttacctatgaatttatttatatgactaaacacaagacttgtattttacacatatccctgtggttatagtgtagccagcaactaatagacagttgggagattgttggaataaagaaattgctaagaaagtagtggttggctgtggggaatgaagaaaagaagatgagtgctagagataattcagttaggagataaagtcaacaggactggttggtttgattcagatacagtgagttcatgaggaaaaggggtaaatcaaggttactacttcaaattctgcttttggcaacttggtaaatagaaaaaacatgcaaatagtattgttggttttcttttttcatttcaaattgtttatttctagcatatagaaatacagttaagtttgtgtattgattttgtattctgtacccttcctgaactcacttaattctagtagctttttgtaaattctatagaattttgtacctagattatcatgtagatatatggtaaattacattgattttcaatttttaaaccaactttgtgtttctgggataaaccccaagataactaactgattgtatattaaccttgtatcttgagaccttgctaatacacattactgttagtagttgttttcattgattccttaggattttctgtgtaaataatcatgtcttttgtaaatagggacagttttacttcctccttacaagtctttatcctttttg

SEQ ID NO: 95905 - DNA, 1030 bp, Homo sapiens
agcacctagcacagggcttgacataatatgagttaaaaatactgtcaaaagcagtggcacacacctgtaatcccctgtctcaaaataagaaagtaagcaaagtaaataagtaaataaataaataaataatttactgaaggactaaacctgctgaatgactcaatagctgggggtagggttttcagccctgtttaataaacttctttcctcaatcatctaccatttatccaccttcccatccatctatctattaatctagtgatttttgttcttcatatcttctaggaaaagtcataaattatatccactttaatgactgtctacaatcaaaatttcagatcaattaatctattgaaagcttgtcttcctcattcagttctccttcaaaatattctggtaaaagaaatacaaacacatttacatacacagatgtgtcaagctgacatagcttagaagtacaaagataagcactgagaaatttaattgctctcatcaatgatatcagtgagatagggttaaggttcttggtttaaaccaggaagatggaacagtgctataacaagcactactgaatggtaaaaatagcattcattgtaaaaatccatcaagttgcaaaacaaactaggaaaaaacataatatataaacaagttctacacatcaataagaaaaaactgacactaatagaaaaacaggcaatgaataagaatgcaagttcacaatcaaggaactacaaatggcatttaagtatatgacaagatagtcaatcttgatcataattagagaaatacaaaagtaatctacattgggttattatttttcaacagtaatattgggcaaagactaaaacgtttgatgacacacacgtgagaagaacaggcactctcatacatagcttctgaaagtataaattgtaccatctcaatggaggataacttggcaaaatttatcaaattataaaatgcatatgccaagactcagcattatttttattatttttagtgagacatatttcacgcaccacaaaattta

SEQ ID NO: 95906 - DNA, 1038 bp, Homo sapiens
attgtctgtaatgcaatgatttttttcctacctgggccttttctgaaatgcagcttttagcattaatctccaaatggaacagatttgcaagaatcaatatagtagttcctcaaggaaaaaagaaatcagttttatttatttatttttcagaggtggctggatccaaacaaaccaataaggaagcagctaaagagtgagcatacatatttacttaatgttttgcaagtttactttataaagataaaggattaatatagtctgattaattagaactacttttattaattctaggaggatctccttacagtttgaactttagagtcaaattttttgtaagtgaccccaacaagttacaagaagaatatacaaggtgggtttatggatatatttttcttgaaaatattgtcaaaactctaatatgaaattttgaaattaattaggcaaaaagaaattactgtggtgtaattctgagctttccagtcagtacacagaataagttatggctattccaagataacgttttcctccttttttggatggctgggagagtgtaaggggatttagaacctcagggctgcccagtccagccccagcttcctgaaccatgtaaatattaaaaatttctacttgtgaacactgcttaagtgtggctataattaattgaggtcatcaaatgtgctgaaattgtatccaaaggatgctgtgtggtgagaaatttgggttttttttttcccatgtgaaagcatattctagtatctttttttattggggagaacatagaatttataaaatatataaccattatttgcgggtcagtaggtaccttttgtcccctatgtgtttttaatctttggttccaaaaaaatataatggagtttataaaggatgttgcagagagtgcactagcatgttgaggcctttacatgcccacttgactctccattttaagtctcagcttatgttactatctaattttatggtcatttcgacttgacagagtatatacacatgaatgatccagatgaacattttgataat

SEQ ID NO: 95907 - DNA, 1261 bp, Homo sapiens
taactttgaatttttttttttttctttttttgagatagagtctcactctgtcgcctaggctggagtgcagtggcgcgatctcggctcattgcaagctctgcctcccaggttcacgccattctcctgccttggcctcccgagtagctgggactacaggtgcctgccatcacgcctggctaatttttttttttttgtatttttagtagagatggggtttcaccgtgttagccaggaaggatggtctcgatctcctgaccttgtgatctgcccgcctcggcctcccagataactttgaattattaaaccaaaacaggcctgatagaaatatactgtcttggattgagtaaatagattatatttataatattatgcactaagcctcacaagaagttatatatgaagccaggatgtttgtattctttttttttgtaatgaatatctgattctctgaaaacctctttggtaatttgaatattgtcatggagctcttcagtgacttaatcagccaaactagaatttctaatgacttttgactcttggaatatgtactttttttagtttagtgaaataaaaaatcttaagatttcctggttaaacatttaaaaccaaaaagtttggtcttctgccacccctatacaacacaggtgactttgcccaagtattgacaaatctttgagtgggttacccactagcagagaccaaaggacaatgctatcttgtaagcaatgacagcaggcttgttaaagaaaacctaagtttttgttggtttcacaggaaattgaatacttgacaattctaacaatagtagacaaaagtattcttcccctgccccgccaatcaaagagagacttccttaattcacatggaagtgtataggtgcttttctgtaacaggcagcttcctgccatctgatgataaaatgatcaaaacgctggcctgtccttgtagctggctttctatctcagaccagcgaaaatcatcgctggtctctagtgcattgcttacaatgctcttccatgtttgtgatactcaggttttctatgcttcccacttctttctgcatataccaaccctcaagagtatttctccctctgtcatgtaactatttgaaatcttgagggcttctataatggaagctagtggaaacaagacattcgaaatacaaatttcatacatcaaagagttttaaagatttagattcatgagcttatgaaatcttatttttaaactactttacatgttttaatatgtaaattataaa

SEQ ID NO: 95908 - DNA, 2487 bp, Homo sapiens
attgaaattgttacaattctattaaatgctatcctttttgtttgtttgtttttaaggtaccagtattttttgcaaattaaacaagacattcttactggaaggtgggctctttaaatttcttaaaaaattttttgtaatggactttaaaaatactttttaaatctgtgttaagtaattcatggtcattgcaaacaaattatttaagaaggttacatgtagtgtgaattcctttcatcagataagtttatttcttaacagttaaaatcaaatcacatgaaacttcaagtgtgattgtttaacaaattatagcacttttgaaattgctatgtttaaccttcggttgtgtatttttgttttgttttattagattaccctgtccttctaatactgctgcccttttagcttcatttgctgttcagtgtaagtatcagcccatttttaggtcaaatagcatataactgtggtttgtgttgctagtacattggcttcaatgtgggagttctttagaaatgttgctatatagaaaatagtgactgcagtggaaatgtaatgaaatctccagttagttagcaattactatgatttttgaaaaaatttcctctgaaattgagaccaagaagaatgttaaatggattgctgtggcttgcttaagtggttatattagaaacataagtattttacatccagaaatagaattaatggcatcgctgatttgactataataatttaaaaatttgtttattaaaatgtgaatgttttcctttcattattagctgaacttggagactacgatcagtcagagaacttgtcaggctacctctcagattattctttcattcctaatcaacctcaagattttgaaaaagaaattgcaaaattacatcagcaacacatgtaagagttttttagttttttatttgataaacttcttaatggcattctttctagagaaatgtttgaaattctaatatgatggctgtatttaatatagaacaattactgttacctaaaataatattatcataaagaaatataggtgatctatgctaaaaaacgatttcatagaatatatgaagctcattttcatttctattcagagccattaagctatctgtaaacagatatttatttgctattgtgtaatagtctaaataattttagaatataaacagtatagtcacaatatagagatcagtctgcttagtaattctttctcagtttttaggtataaaggacttgattctccttggtagtgagccaagaggagaacaggaactctatataatactgaattaatttttaaaaaatatttctttaagaacagtacaggttgaacatccttaacccaagagtttgaaattcagagagctctaaaatttaaaactttttgagcactgacattacaccacagtgggaaattctgcacctgatcccatgtaatgggtttcagtcaacattcggtgaaaactttgtttcatacacagaattattttaaatattatataatattaccttcaggctatgtgtataaagtgtatatgaaacataaatttcatgtttagacttggtttctataccaagatattgcattaagtatatgcaaatatttcaaaacttgaaaaaatctgaaatctgaaacacttacgatcccaagcatttcagataagagatacttaaccttatcaatattcattcattaacaatattcattcaactttgatttttttgtgtgagtataattttatatattattttttcaaaagagatttgttgccttgaatagaaagtaatattgtttattggttcagaattcagttgtgcttcaatatacaattcagaatactcagggaaaaactaaggcagtgttgcgtattggctaagagtctgaactaaagagccagactgcctggtttgaaattctgtaagattacttactatcttataaccttggccaaactgttttatgcctcttcttctctgtttccttacgtaaactggggataataaaagtatctatctctggagttactgtaggtcttaaatgagtttatatacataaggttctcaaaaccatacatagcacattgtaggcactgaagaaatgttagctgttgttattattaagaaaacttactttcttttactaataactcatgtatctaaaacaggataacaaaccatggccattgaaacggagtctcgctctgttgcccaggctggagtgcagtggcgcgatctcagctcactgcaagctccgcctcccgggttcatgccattctcctgcctcagcctcccggtagccaggactacaggtgcccgccaccatgcctggctaattttttgtatttttaatagagatggggtttcaccgtgttagccaggatggtcttgatctcctgacctcgtgatccgcctgccttggcctcccaaagtgctgggattacaggcgtgagccaccacgcccagcccctattgcctatttttata

SEQ ID NO: 95909 - DNA, 1019 bp, Homo sapiens
tagatttaacagatattacccaggcagattgctatacaagcctccaacactcaggttccatactgtgaatcaacctctgtctgtgcaccacactctgagaagcactgccctggaggttggcttagaatctgcaagtttcagagatatcctgtgtgatttaaatgcagatatggtatatgaaccaaattttgagaaatactgcttttaagttatatctaaaagtgaggggttttgttacagtcacccatataaatagtgaggagctttaaaaacttggtgtattcttgtatttctagaaaataagacagtattctggaaaataataatttgggttactgaaaatgtgccctccagataagttagaggagtagtcctgcatggtgtttcatagatttaattagactgctcagttttttcagataaatagcctttttctaatttagccatatttatttgattgattgattgatctcatttttaacttaatgatgtctttatagaggcttatctcctgcagaagcagaatttaattacctaaacacagcacgtaccttagaactctatggagttgaattccactatgcaagggtaagtgaagaaaacttactttgatgttgttgagttaggctccgttactcaatataacattttttaagattagataacaaatggaataagttatgattgctgctgacacagctgcactgaaaatttcctctgaatttaagtattttcacaataacttaagattcaattcccgaatgtgaaggatggttaatgtggattcttcaaggtagtgttttatatgtaaagataatttttacagaccgtaagatatagtacctttagaatatttattttaaaatataattgttaggctataggaaaagtggcttttgtatacttttataataatgatcattaaaaatgttctcacatcactgaggcctgtattagtgcacttactttgttttcatcatttaaaagcactattacgagtttttatttataaagcacaa

SEQ ID NO: 95910 - DNA, 1050 bp, Homo sapiens
ctcattatgttgtaaatattgctttattgggttccttttcaccaaactctgaattcctccatgttttattcatgtttgtgatgttagcatcacagttacttagtaaatggattgtaatacttttaggaatggtaaaatgaatactaaggaaaaggtctctgatttctgaattcttggttcctattccaaagagtcagttctagtcataaattgtgggaaatcctgagatccattttactttagattaaagaattttaataagacatttcagtttggtttaaaatttgttctttatttttatttggtaataagtaccatttgggtttctaattagtattcggttctttgcaacctttgaaaatgcaatgtttagttttaaaaatagaatcctatttttaaaatatatctctaacaaagcccataaatttagatttatcatgtttttattcattttttttgaaggatcagagtaacaatgaaattatgattggagtgatgtcaggaggaattctgatttataagaacagggtacgaatgaatacctttccatggtaagaacatctattgatacttttatgtttaccactgtattactaaatataataatttatattaaaggcagtggctgttgaactattttaatgttgtcattttacttgtgagataaactttatactttatcccacttagttagcacctaccagaagacaccaaaatggtttatttcaaaattactttttaaaaattattacttatgagtttttcttttatggaatttttgaaagatgatcagagctttccagtctttttagcagagatttgcccccagggcaaattgttttaccagcatctaaccaatatgggttttatcagagtttaaccaaagtaggagaatggaaatacccaatttagacccctcctgctttcttgtctcacctaaggaggggttgacctgagaagcaccgaagatcgcagccaagaggcacagaccactaaaccactaagacctaattacaggatgaaagaatgattcctccctgtcccacacct

SEQ ID NO: 95911 - DNA, 1050 bp, Homo sapiens
tttttattataaccattctagtgagtataaagtagtatctcattgtagtttttatttgcattcccctgctggctaatgataatgagtgtcttttcaagtacttattattgtttcatatattttggattattcaaactggatttttaaaaatcaatctgagccagatgcagtggcacacacctatagtcccagctactcaggaggctgaggcaggaggatcacttgagcctaggagtttgaggccaggctgggcaacatagcgaaaccatgtctgtaataggatacattttaagatggcaaaggcaaaccttaaactgaaatgtaaagtcattgtaaaacctctgatgtcaagtgaaaaatgcgtagtatgtctaatgatttattaactacagaaaggaattgttccagttaaaaaaaaatcaatctttatactgtttacaagagacatacctaaaatgttatacaaaatgacagaaacattgaaaaagataaaccaggcatatagaagccaaaaaaacggttatggctatattactgctatataaaatagatactgtttgaaagatttttaatttatacattggtatttttctgaaaaaactttgtagcaaatacaagtcacacacaatacatttataagaaaataaaagttatacaaaatatatattatgccacagagagcattcagtgaaaagatttttattcattgattgataccttcctgggaatttttgaaattaaagtgatttgaaactggcctagatttcctttctcttgatcatttagaaatgaacagtgttttttgttgtttaacttctgaaatatcagtgtgtcttcataagattttttgaattgaggcacctggcttttttccataaatacagtcaatagttactcaattttttttttttttttttttttttttttgcttctggaaataatgccctctctctatgacagaatatttttcccatgtcgagtgaaagctcagtatccaaaagtaaaatacaaagttttcaaatcagaaacctaaacatgtctcttcttccc

SEQ ID NO: 95912 - DNA, 1019 bp, Homo sapiens
gctgaggcacaagaatcacttgaacccatgaggtggaggttgcagtgagccaagatcgtgccactgcactccagcatggatgacagagtgagactgtgtctcaaaaaaaaaaaaaaaaaaaaagactgagttaggtccagatttttcaggcttttgcatatacttcattgcctttttattggataagcaaaaaagatcctagataaaagatcccataggttctatctatatcattaacaagttcatgtttacaaggctagaataatttatctgtcaaaagtaaattaaatggagcattagatcctgacattttcctggtattctctgcattttgtcatttattacagcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactggtaagtattgcttctgtgttaaggctttattgttggattttgtttcctttctttaaaataaagatgtagtttatggaaccatacaacctttgttacacaaacttaactgagtcaaaaatccctatggattgcagcctctatatcagtatcattaaaaagttctataggttcttgtgatatgctacaggcttgagaaaccagttctgtgttctgtatttgctgtcattattttctggagtaaattaactacatttacttatttacaataaagacagatgacataatttctattgtgtctttattagatatttgcttgaaaacttttctttgttctaagacacccaaggtatcttatgcctaaaactatataattattgttttttaatttagaatttagcatatttttgggttgtcaaaccctttattgtaaagtgtttaaaacagtcacgaggcaaaatcagatttagtcattgaacagtaaccccaggttccatttcct

SEQ ID NO: 95913 - DNA, 1010 bp, Homo sapiens
atttgtatatggttacatttgatataccgcaaatttatgttaattcacagttaagtaatgagaatgtctcaaataaatgctctgagaacttttattaacaaacttcatctgaacacattggtgtacttcagaagaagatcagtttctctctatcaacaatttccctctagacaaatcagcttgaaaacaaatctcctagtgccaaaaccccaccatttttctgccttagttccttcctctaaacaaaaatctggagctgttctgtgtctggacatggagggagttgaacacatctttcttcattaatgggagaaatgtaactaagcttcattcatccaggtagaattggaatgttgtccagtctttttattctctgcttccttttctctgctagaaatgtcttgtctcttaggaagttacactataatcatgttatgtgttgtcattttatcttatagttctcttaagactttattgttgtgcatatttatatatttcagtgggagaactgaagtccaatcagttcagtatggcaaagaaaaggcaaataaagacagggtatttgcaaggtaagccaaatctgtttcattgtttgaatttttttaaaaagatggattgagtttactaaaaagtttttctaaatattttttctaaagtttttctaaatatttcaaatttttgattacagaattatcacaattctttaacagtaaataatgttgagggaatgataaactagcttgtctagtttattgattcattttttatattaatagtgtgccaggcattgcagttctgaataggctgatcaaatattatgttattaatataatattctgttcgaggttgctccacttttttaaacatttttgagaaatatagtgacttatttcatgttatcaagccatttccatatttatttaaattataatgttaagagataagttgttttattttttgtttttgtttaccatttattgtctttatttctttagggtctgtcatagcca

SEQ ID NO: 95914 - DNA, 1947 bp, Homo sapiens
agataagcttttctgggattgtttttctaatatgttaggatctaattgtaatgaacagatatatgtctaccaaaattctctaatggttttagtaattattaagttattttattaaagtaccagataacctagagttctttttttttctttgggttttagttggcaatatgagtagatagaaaaggctcctccttaaacttctcatataataattttttagcaatcattaaatgttttttcttttttctgattatcacctctttgtgttcgcctcagcagcacatatactgattatcacctcttcaaattgctttcacattttgcagttgtcatataatatatctaagaaaagagaaaaacaatgttctcatacaacagaaaaataaggtgccctagacagaaaagaagcttaccacatcgcaaacacactgatgctgtgtggtatttttttctctgaaatttccacactcaacaggaaacatagacagcaagcttgagtgggtgggtccctgaggttaaaactgttaataaaataaaatacatgaagtttggttttaagttcaaagtgtccagccatgtttagtccattaacagcaataaagtgttctgacgcttcagactaggtgagtgtgctggaattttttttcttcaaatgactttttccagcttttagaaaatgaaagtagttgatctattgattacagttagtgaactttcatacagcttacatttcgtagtttaatatttgaggaaataatagtttattacattatgaattagcattaatagagccataaatgttaatctttattttaaaaatcaaagttttatgcatgaggtaatatactttattttcattctgttgtgactgataagaaaatttgcactgcaatatgagggagttgaactaaacggtgtcatgagttgtcttcaaatcaaaaaatcctataatttaaacctgtgataatgggaaatgttcacacctaaattactttgaattcacttacggaaaatgaaatctgagtcaatgtatcttttttaaaactaataacattccatgtcttataaaatgcctacaagatttttgattaaggaaatgtcattaggccaaactaaaaaagttttagctatgaattgctgaaatgacaggacacttctgtggtgtagattcataagtaacttaaatttttcgtggtttagtaaaattaataggctaaaatattgccctgaaaatttggatattcataaatcataaaattcaggaggtagggagagacctatgggtcatattatgctaataaatttatacatttagatacagaaacataagaggtctgtctaataggaagccacatctagaattcagagtccttatcattattttaatgcttcctactgtacacataataacaatttgttcagttctctttggtcagtgttattgtgcgtgttagtccgacatttctttttacacgtttaacatattggaaaggaaattctagcaggcagtgaaacttcaaacttcatgagatcattatgtatcagaattctaatgttattaagttttaatgtaatcagatgagttaatattgcatttgctttgtgccttccttggtaattgtttttttttttttagccatacagaagtgtatacatagtacatgatgagagaaaaatatcccaatgagctaaaaaagcaagtccaatactacctgcaattctttatcaatataagaaaatctgaaaataaatccaaagtcacacaacaaaggcctatgattcttattaactataaccaaaaatagtcttcatttttaaattttactcaaataggtatttctacctaaatttttatgatctgatttttgtaggaagacaacaggatgtttcattttttgtaaattgtgctggaatggaaaatacatatagtttttatatgcttcagtt

SEQ ID NO: 95915 - DNA, 1879 bp, Homo sapiens
cttttccttataatttggcttaaatcccaacctcagcatttatacttgggctcttttcctatctgtatcttcctgcttgatttgattgtttaaaaagaggttaaaagaggttattctcaaatacctgtagtcttgcaagtagcacgggatggagatttgtgtagattatagagctcatgctgcatctaaagacagcagctgccacttggctttatacagtgtttgacaactggtactgcaggcccattctttccggagcttccagatttttcatcttgaaaatctagatttgtatgcaattttaaaaatgtaattgtttaactcaattatttttataaaaacaatgaatggtccaaatgtatgttggccaaaattggcccataatccatgaatttataactgctcttttaggacaataatgtctaatcataattgcgcaataaaaaccacctctggaggtgtttcttgtaaccccagaagtagagattcaacagttttagcaaaatgtaccatagaatcagtgctgtccctctcatgtaactgagtattgccactgttaggcccatactgagtatgccactgttaggcataactgagtattgccaccgataggcccatacaggtttggctcacttagatataccactgctgatcaggcttgagtttctcctgtatattttggtgctgtatttaaactgatagctggaccaagaataaggaaggtttccctgactccattttcatatgttctccaccttactccctttcccacaggcttttagttttaaattttttttctcagcttttaaatttagcttttaaatgtttcctggttatgacaactgtatgcaaagcagaaagagtttctaattatattgcctaagtggttacacttaggtccaagtaaggggtgagacctgttatatatgtcgagtccaattacttctggtatttgtaaagttttagagattcttatcaactgccttttaaaaatgttgcatctcttaagttctgctaagggatgtccatctctgtgtgctctaatcctatgtagtaggccgtggttgagttacatatctctattctaatccatggaaacatttccctagacaagcaatacttgaatctatgggcccttagaagcttgtattcttggcagttgaaagtaacataagaactaccacatttgggagctggaagccctggccattaaggcagacctcaatgaagctttggctgaaaaagagggatgtatgctctgatgcagtctttgtagacttggcagaatttagagcatttgtgccctgaagtatttctatgcagacatctaggctaagtgggcattgctgttcacttgcttcttttgcagttatattttataccatgttataaaatttcagaaagactctaatctctcctaggagaaacttctctttaagaccatacaatcacatcattcattattaatcccagctgacttccttggcactgatcatactttctttcagtttcacaacacttatttactaggtgtctagcagccaacctctcaataagcttacacctcctctacaagggagaacagatgtatccaagggtcactctggcagtaaatctctgtatcagttatcttgttatgcttgatcacaaatgagcctaacttaaagagacataacaaaagttctttctttcttacattgtatgtacattatgtgtcatctgtggctgtgctctaccttatcttcattctgggtcccagactggtagcattccctgtttgggacatggctagtctcatgggcaagggaaaaaagaagcataatgaaatcataagctgtttcatttttttctttttttttttttttttttttttgagatg

SEQ ID NO: 95916 - DNA, 1008 bp, Homo sapiens
tatgtgtgtatatatacacacaaacagtttatttagacttgtcagatcagaatgaaatggaaatgaaaaattgtaacatatctgacaaaaggcatattaactataagagagttccctttagtgataatggatacagtaagagattcatagctatcctctttaacacatagaccacctctttttttctgccaactacactatgcacaaaataatgtgaggaaaagctctgtctgctatagcccattattacattttccccagtaccattggctcccaattcactatacttcaggtatctcaaagacatttacaaaaacttggaactaattggtatacaaaagcatcatactgctagtgcacagagggaatatatgaatgtctgtcatctacttcactacataagtagacaaaaaagcaacttgagagaatgagcataactctaaatttgaacgttccagattttaaagctttgggttgaattatctcatcttcacaacaactctaagaaataatcagaacttttcattttcagatgtcttttcagaacttcagatgtctaattaatcattcatttcagaagcagcagagtaacttctagaccagtgttttttccactaatgacagtgccttattggattttattgactttgtgttgataaagaatttcagtagttgtgcttttatttcttcatgcctttaccacaagcagttcccttttttgtaagatccaaccccatcatttccttctcaacctggcctatcattcctcaaaattcactctcatatgttttcattgctatgttcccagaacatgtccatatttctatttcttttgtctcttttaccttaatcgctgtttgtcttctcactttgtgctatagtgcaagactataaaaatgaccatgcaagatgaaattgtgcaggatcttgatgattaataggaaaaattatggttgttcccatgacctttaaatttattgtcaaaacattaagaatttcctttactgt

SEQ ID NO: 95917 - DNA, 1048 bp, Homo sapiens
ctagttcgacctaatggtgagtactctatgtagtaccagataatttatagtaatttattactgttcattactgagcacagcagccagatttctgacataaaacataagtcacctaagtttcctgctcaaagcacagtggctttcattgacacgtggagcagaattcaagttctttgcccccccaccccttgctcccactcagccttgcttactttcctctattctacactagctttcttgcagttactcagatcttccaatctaatcgacttattagggtttttatccttgctgttccctgtgctgacatactctttttgattttgttatgacttatacctatacttcattcaggtctctgctcagatatcatcttcagaagggctttctctcctgactaccatagctaaaatggtctcccatttcccctaaatggtaatagttgtagtactagtactcaataaatactagttgaatgaatgagtaaatttgaactctgttccacttttagaaaatgccataacaagctatagttaaagtgtttttaaaatactgcctttgttttcagtatatgatgtctacttgcctaatcatgtcatctcccaatctggacagctgacttgttaattcatagtcatagaattccaggtttggagaaaacttgaatgccgtaagctctagctctttggctaattgcacgaatttcctccacaacaacctcaagaacattctaccaatatagatagagcactttgtggctcctgaaacaggtcattccatctttggatagctcaaactataaattgaactaaaagtccatctttcttcagtcctgctcctaagtctgtcactctgtgctatgcattataagtttaaccccctttccttcagttttttgacaatagctaattttaccagaaacccacctccctttctccagtttaagagtcctagagtcttcagccagtgttcatatggcattgtttagagttccctcaacactttatcagtctgctctaagaaaaaagttttatatgtctaatatccc

SEQ ID NO: 95918 - DNA, 1050 bp, Homo sapiens
tagccagattacttactattaaaaagggaaaaaagtgacaaagaaaaaatgtcggctgggcgcagtggctcacacctgtaatcccagcactttgggagacggaggcaggtggatcacctgaggtcaggagttcgagaccagcctgaccaatatggtgaaaccccgtctctactaaaaatacaaaattagccaggcttggtggcacatgcctgtaatcccagctacttgggaggctgaggcaggagaatcgcttgaacccaggaggcagaggttgcagtgagccaagatcgtgctattgcactctagcctgggcaacaagagcaaaactccatcgcaaaaaaaaaaaacactagtcagcagatcgagatgaaatttattaaatttttcttgtaacttttatatgtttgaaatttattaaaaaaacatttttaaaaattggagaacatgaatccatatgtatataattttatttattatttatttatatcaatatcaggttaaatgtcaccaatattggccagaacccacaggcagttcatcttatggatgctaccaagttacctgccactctgaagaaggaaacactgcctatatcttcaggaagatgaccctatttaaccaagaggtaagaaggcaggatatctgttcattagaactgttgtgttcagggtaaagactgaaagctgaaaatgtttttagtttgagtattggttgctaggaaatactataagaattattgaattatttatctgctttaatggggtactttggaattttattaagagtattatcctattctattataaaattaatgtttttctttagtttctatgactaaatatgaatggtcagtgaaaaagtagtctggtaaataatactactgttactactttgcttattcagaacaactgtttagatatgtttcattataaaaaaaacttttactccaagtagtatcagtacagtatttgggtgtgtctgtggaaatggaaaaaacaattgaaagctattaaattattttccttttttaaaagagtagaggagagcaac

SEQ ID NO: 95919 - DNA, 1049 bp, Homo sapiens
acggagacagtaagagtattgcgtttagatacatcttggttcaaatcttgactctgccagttacagcattcagtgtttcagaaaataatttccttcaactgaaaaatgaaataacatctatactttaaaggatcagtcttatgctaaaaagactccatgagaggacctgtaaatcaccccatcagctacttggcaccatatactcaataaatggttgctatagtcattcaacactataattataactatggttattgccatttacactgaagagagcttcctgaagagtaaaagtaaaaggtattcaagacttgaggtagtatctgctatcattaatccatccatgtatgtatgtatttatgggagcgaactcattttcccaattatgtttggctcaaactttagaaactaactcatgtcttagttctaatgtactcagggtgtgtaaagaaaagccactatggtatataaaactgtcatggataatctacaggtggagtataatagagactatgctaaagatagacattattttatataaacatacgtagcctatctttcattatctatttgagaaaatgaagaaatatcatattggcttgacctgttacattagaccatgagctacacagtatatgtccccaaaccctaaattcattctgatggactctagcccataaaattttgaaattttaaaattcttgtcattttagctttattcaatgccagattccttttctataaatcagcacaacttctggcttcttcccttttcgtcagtaagactctgtctctctggtttcctttaatcatgctcttggggttggaggggagttctcatttccaaaggcttgaccattgatgggatagtcctgggcactcatagcttgggctatttgctcttctctagcagttattcttttagtccctttcaaaaccaaagatggtggcagggggatagctagctgcaggcagagaaagtagggtgcactgtctctagcagcctgacagaactggcagcatgacgctctctacatacatcttccaat

SEQ ID NO: 95920 - DNA, 1148 bp, Homo sapiens
tctggcattgaataaagctaaaatgacaagaattttaaaatttcaaaattttatgggctagagtccatcagaatgaatttagggtttggggacatatactgtgtagctcatggtctaatgtaacaggtcaagccaatatgatatttcttcattttctcaaatagataatgaaagataggctacgtatgtttatataaaataatgtctatctttagcatagtctctattatactccacctgtagattatccatgacagttttatataccatagtggcttttctttacacaccctgagtacattagaactaagacatgagttagtttctaaagtttgagccaaacataattgggaaaatgagttcgctcccataaatacatacatacatggatggattaatgatagcagatactacctcaagtcttgaataccttttacttttactcttcaggaagctctcttcagtgtaaatggcaataaccatagttataattatagtgttgaatgactatagcaaccatttattgagtatatggtgccaagtagctgatggggtgatttacaggtcctctcatggagtctttttagcataagactgatcctttaaagtatagatgttatttcatttttcagttgaaggaaattattttctgaaacactgaatgctgtaactggcagagtcaagatttgaaccaagatgtatctaaacgcaatactcttactgtctccgttataccaaccttggctctccaaaaagaattaatcccactgatttgactttgtgtttttattaactccaatttttaatatacatttatcttgagattttatttttctgatttccataatttcatctgcattgtgtgaggattaggtcagctttgttcacaaaaaatgttttttactttaccatttttgctcacccaagaattcattagttttttttaagcatttctctgggtcttaatttgtttctacctatgtacttgattatcatctttaaaatactttacacatatagaaattgagttataaaaagagtagtaatgtaattagccatacttaaatggatacaactatttctgtaaaatagtttctttcctttttgttgaaattttgcattttaatgagtttatacataacttttgg

SEQ ID NO: 95921 - DNA, 1029 bp, Homo sapiens
cactccagcctgggcgtgagcgagattccgtctcaaaaaaaaaaaagatatatttgagtttaaaatattgttgtcttttgtgcattcgttgatggtttattattgtcattctatcattttgcattttaaggagttgctccagtaagcttctattccttgttcagattttaaaaacttaaatttaactcctttaaaatagtatttttccaactaacgtggtagatggaagatacagaacaagtaattgagtcagtgcattttttttctgttttcaaaatattctgtatttggcttactacttttataattaaaatattaaaatgatattgttcttctgtgttataattcagttttatgcacaaaagccacaagtagtttaacagaatagtatcggtaagatcttgcctatatttgtcttttttagtgctggaatcggaagaactggggttcttattactatggaaacagccatgtgtctcattgaatgcaatcagccagtttatccactagatattgtaagaacaatgagagatcagcgagccatgatgatccaaacacctgtgagtactgtactttatatacaagtgtatattcttaacatgatgatttttgttgccaatgcatattctaaatcatatttttatccttttttatcttttcaattccttgccatggtcaaataacctctagcacaggggtaagcaaactactgcccactagtcaaatctggcctgccacttgtttttgtaaataaaattttagtggaacacagccatgctcatttatctatgcctgctttgatattatagctgcagagtttagaagttgcaacagtaccatatggactgctatttctaaaatatatttaatatctggccttttacagaaaaagttttgctaacatgcaagttgcctggcatattaaatcttgagtgcttaaacaggcacagaggaacttgctttgtattatttagtcaagctgaatgctgagaatgatagtatccctgaactggagagtcttgatagacc

SEQ ID NO: 95922 - DNA, 1164 bp, Homo sapiens
ctggtttattttttggatagattcttagaagtgggattgctgggtgaagaggtaaattaggttaattttcttatatgctgccaaattcccctttatagaggctgcagtattttaacatccctaccagcaacatataagtgagttttgccaacaaaatatattgccaaactgtattttttaaccagtctagactgttagtgaaaaatggtatctttatgcagttttgttttgcattttttaagtaagcaagccaagtgagatgtttgtcttttttggggggagaggggacggttttctgacttttctgatcagttctgttttttatattttatttttcagagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctggtcttttgcagtggtttgcgtacttactatactgattaccagattttatttttaaaattttagcaatatcgttcttaatattagccaatacactgcctatggatgcagcacatttttccctgcacaccccctgtagagacctgcctgctgctcagaagaagaaagatggaatttgctgttcccaggaaatgctgcacattgtccatttaccagcatcttatagaaaatataaatatgaatctacaaattctcttggatttaataatgtaacttatatttatcataaggttggcttattccaaatcatgtgatttcacatacttgatgtaaaggaatgcatgcattgt

SEQ ID NO: 95923 - DNA, 1675 bp, Homo sapiens
catctaacatgcagattaatgttaaacatattgataatctaagctaaagttagagcaaataattgtgatttattcatgtccataactaaaatattattctttagcactcatttcagttaatatcaagctttgttcacactgatatattgattgggattcttcaaacgaagaatgaaacattattgacttatttctaagtgtaataactcaataactaaattgagaattttcttgtttttttgtgtacaattaaattattccattttatatatacttattaagttataagcatgttaataaggagacttttgactgtccagcctaatggaggatctgattcccattaaggatgtgggaattcccgtattttcctcttcaggtttttttgtttttaagtctacagagagatagaaccttaacattgcccagtttgataaaagtgaaaatttgctcacctatacaaatgttattttacacaattattttatgtggattggggttttaaaagattcatttcctagcagtttctgaatatttctgtaagatcttgataaagtttagagtcaaatggcagatattttggaaagccatttagtatgaggggaagagtacacattttaaatctttggtataatctaaacgatgtcatttcagacattcaaaactcataataataaatttcaggaaatcaagctcctaaacattaatagccaagataccaaataaattatcatattaaaatatttaagtttatttaaagagagaagtaaacataaacttatgtcaaagagaaattctcttaatctatttcctgacttcacagtcaaaacagtataagatagtgaagtaacttataatcttatttggtcattctgttctataaacagacaaatataatttaggctgctatatgacatgataaattaaaaactgagaaagtaaaattatgtcggggtctacacattaaatgactgttttggcagtttttcacctgaatttaaaaataaaatttgtctgttctatctgtatggacagaatatgacaaccatagaccaaaagatatcattgtatagatgtaaagagacaaaagtcatggttggcatgttctttaatttagggccttgtttatacttgtgagtttaataatttcttggcaatgagcactgctgcctttttaaatcatcaatgcctgtctttaaatgccaatcattagaagtttagaattacatttaaatttctcatatatgaatttttcatctgggaactacccactgtcgtcatttttatgtgcagaaaagatcctttttgaaaaccatatttattgggatcttatttaaatttaaattatcctttacaacttcttaaaatgaatatgctaatagataagactttatccattacatctaagaactttttaacctgtatatcaatctaaataggtttctagaaataatcctagctttcatacaccatgtagttctagactccgtccatatcagtgtaacattgtgtgataaaatgccaaatgtcttgtatctaagctacgctcccactcttccagccacccctacctcccaccttgacacccttaagaaagcaatgctgacttttattctgacaagtggaaatcaatagtggttaatcaagtggattttgtaaatgctaagaagtgttt

SEQ ID NO: 95924 - DNA, 1041 bp, Homo sapiens
cttcacttagcccatttttatcggcattaggaaatagggttcagcaatggttattgatttagcagtctggtcttatatgatctgctttctaattatctatctagtattcctatattatactggaacttcaataaattataacctatgtgaatatcataaattcttgtgaatttttgtctatttccagtagagaagcatactcagccaatgttttcacttaataactatgacaaccttaaaggatgtcacttaagttagaaaataagcaggcttaagaagtgattctaattaggacccccactcagtttgctagtcatgcctgcctgacagaacataagcttttgtaaagtatttagactgataacacatgcagtatgaaaacattatagactgcagttagaagactaattttttaaaagcactcaaaacatagaactaagatttagaatatatgtccatttataatgaaataatttgtgttcataatgtgaacatgtaagataagtaaataaagcattacttgttttataatatcaggaagagagaaggaaacattagtttataacaatgtgctatttaatatctgtattttgaacatttaaaatactctgatggtaaggttgccaaagtaattttgaattcataaaaattgtttataccacaataatgtgggatatgtttacaggctcttttattttgtggtagttactttatagttcagatgaatttgcatttcagtcacttatagtaaataaagtatattaaatatttgttggaataaaaatctcaatgtaataggacatagataaattatgcaacagcctgctttgatgaaagctggtgcattatgtgagctgccacagttaatactttgtattaacattgcttacttcccccatttgcttcacctatctgactacaattgctggaatcattctttttgtggtgcttcctccaagtgaaataactatgttattaaaacctactggattaattttatcaaatatcagacttactgatctcttggcagagatttattgg

SEQ ID NO: 95925 - DNA, 2587 bp, Homo sapiens
tgcaaccattatatagacttcattgatactcagcaattactacagtgtgtcttacaatgttataaaaaacaaacagcaatctctgtttctgccagaagttagatatttttttatagtcctgatgaatttgttgtgagtagacaccacatagttatttctgtttgcatataaatttgctgctatttatttgtatgtttttctactgtagtatgctattgatttctgaagttataatcataatttttattttagtaatccaagctaaatgggcaaccagaagtaatatctgctagggtgcaatccatcagcattggttcagtgcatatacataagtaaaccagtttaaaaaaattttactaagcaaaaggtagtagcaatattgctagttaaagattaccattttaggggaaagttcaaaggtttaacttcctgaaaccttttaaacttttcagtgcaagaatgaaaatgtttgaaagccttgttaagctcataaaagtttcatttaaacactgtagagtttcctacctttgttgtgtaaaggatatagaaaatatttttctatggacagaaggttgaaactgttaacttctttaatttcattgtttaaaggagataaaatgttatttgtgtgtctttcatgctgtaaagaaaatgaatgtatctttcaaatgtcattagaattatggcttgattctaaggatactctatttgttttaaagtctacacgggattgaaaagaaagggaagagtattacacttcattgtacaaaatgtaattttagaagaaaaacattttcattataaacaagagcaatcattgaagcattttcagatataatgtacattctttttcattttgctttgcctctagaatagaaacttttcagaaaatttgcacatactgtttgtaagtataaaataattgaattctagacttttggagtgtggaagggtgtttgtgtgtgaaggtaataaatgtgttgctgcatgtgtttaccatagagaacgttgccaggctttgtcaaatgaggacattgttgtgagggtgtgacttttgtgaagccagaaaactgtgcctaagattcattacagtgagtatgtgcagaggcccctgacccagtaaatgctttttgcctttttattcccaatgtcttggacagttgagacaacttggcccaactctgaattgtagcagtgatgtcttatatgcttacgagtttatattaattcagctgaacaagaactacatcttaaaccacctttgtaggtatgattaatacgtgcaacagctgctttaaaaggtggtatttattattcatcactcatgaaacttgactcagtgaggacttcattatttttatttctctttccacgtctccaactttttaaaaatcactaatttaactctttgttaagtactcaagtacaaagtgatctcttctttcatgaactttgctataactgttgaaaggattggtgtcaggctctctcaaccctgggagtttccaaaatttagcaaatattacttgtgataagcttaaatgccacatcgctaagtacaattattaccaggaatccgtcaagggggagatagccccgctcacacccttagacccaaacaggtgctggttcatgctttctccacaaattggcagttgggtacttccccactgtcatcacagttgagctcattttaacatatattcaaagaagctttttagtttctactcctgaattgtagtgttcaagttatttgccttcctgggtaagaaaattttaacccaagtctgggattctctggcacctgtcttttcccatcttttaatgagttggcaagattaggtcaaatttcaatgctaaatttgattttttgaattttaaatagttgcactttatttcatgctgaccaccaacttaatttatacattttaaaataaaattatcctagaagtgttgtaaacgtgggaaaattttaattagtgttggaggtcattagattggacccaggtttaaatataatgatctcttcacagcttatttgatgtttaagagcaacttgtgtgatcttagctttgcaggttttctgtaatttatgtagcacaataaaggataaccagttgactgtgttactggactctgagttctcacagctagtttcatctaagcttggtttattatcatttctgctttggatttttttgtgcatcacatgaatacttagaaatccatttgttttcagtgtagtacctagggtgaagtagatgctgcacaagtaagtttaagggaataaaagtcccgacactttatatacatgttgaggggcacgatttaagagactgaaacagtttacattaaactgtttttattttctgccagtagactctatctgcttaaaaaaataaaaattgttcaacccagtgttctccagcatcaggacattacagttgtaatctatgttgtaatcttttcaaataagaaaagctactccttattctctacagtgtaggcttaattttagaaccgataatttactatatctgcattattgatatttttaagtagtagttttaaaaataattatttctat

SEQ ID NO: 95926 - DNA, 1065 bp, Homo sapiens
aagctcgggaagaccttaaactcaccaagtgagagtataaggaattggagagtttgtttaaatggatgttctgattaacttaataatttggaatgtattagatatgtacattatacattttaaaatattagaatatgataaaattaatcaaagactcaggatttcttgaagtgttttgaagtcatcattacgtgtatttgttatctttgtctataagaatgtatatttttagggtttttgattctggacaacttgaaagcatctaaattttcttcctgtaagtgcttcttgagggtttatcagacattccaacatgagatattttgtgaggatagttttcatactcatttcttatttgataggaatcttaagagttttgtttactatttcattaaaatatcattggatatgtggtgaaaagcctgagattgctgtgtaagagactggaaagaaatttcttattacctaatgtttgaagtatgaagtttcagggttgttgatggacaagctgatagtaggagagtagaatttgtaaaaaaaaaaaaaagaggtttttaaaaacgcagtgcagtatggaggagaaacaacactagcttttaaagtggtggaacaaatggctagttactgatctggaatggtttcctaaactttgtatgcttagctgggtgtatgtgatgcttgatcaaatttataaactagctggtctctcatggggacaattgtagtgaaacagctggagatatagattggactttttgtgaaacaagaacagttgtcagccaggtgcagtggcttatgcctgtaatcccagcactttgggaggctgaggcagacagaacccttaggccaggagttcgagaccagcctggccaacatggtgaaacccatctgtactaaaaatacaaaaattaaccgggcgtggtggcatgcgcctgtagtcccagctactcaggaggctgaggcaggagaatcacttgaacctgggaggtggagattgcagtgagctgagatcgcgccactgcactccagtctgggtgacagcaagactccgtctcaaaaaaaaag

SEQ ID NO: 95927 - DNA, 1019 bp, Homo sapiens
gtacatagtgctattttgatgcatgtatataatgtgtaaatgatcaaatcatggtacatgagatatccatcacctcaaacatttaggagtaaatctttagatcttagatttggcaccactttctgtttttttgtttgtttgtttgtttgtttgtttttgatacggagtctcactctattgctcaggctggagtgcaatgacgtgatctcagcttactgcgatctctgcctcctggcttcaagccagtctcctgcctcagcctccggagtagctgggattacaggcgcctgccacacacctggctaattttttgtatttttagtagagacgggatttcaccatgtttgccaggctagtcttgaactcctgacctcaattgttccgcctgccttggactcccaaattgttgggattacaggcgtgagccactgcgcccggcctggcaccactttcttacatatgatataaaaagcatgagcaactaaagaaaaagtaaataaattggacttcatcaaaatgaaaaatttttcatttagccttcaaaggagaccatcaaataagttacaagactgtcacacagaataagagaaagtatttgcaaattatatatctgataaggaacttgtatctaggctatataaagaacacccaatttaaaaatgggcaaaggatctctatagacatttctccaaataggttatataaatgaccagcaagcacatgaaaagaagctcaacatcataagtcatcacagaaatgcaaaataaaaccacagtgagatacagcttcacaccaactaagaaggctgaaataaagtcagataatattaagtgttggtaaggatatggacaaatcagaactctcagaccctgctggtaggaatgtaaaatggcgcagctgctttggataatagtggggcagttattcatatagtaccacctgacccaacagttacatttctaggtatatctccaagagaatggaaaacatattgcacaaaagcttgtaacggatgttca

SEQ ID NO: 95928 - DNA, 1080 bp, Homo sapiens
taattaatttatttagagacagagtttcgctgtcattgcccaggctggagtgcagtggtgtgatcttggctcactgcagcctctgcctcccgggttcaagtgattctcctgcctcagcctcctgagtagctgggattacaggcgtccgccaccacacccagctaatttttagtagagacagggtttcactatgttggtcaggctggtctcaaactcctgacctcaggtgatccacccgcctcggcctcccaaagtgctgggattaaaggcatgagccaccacgcccagccccagcctccaattatcagtaaaagctctgatcccctaatgctcaggctgatttgagtaataataaaactccagtctcccacacaaccagctccgcttgaattactctttctccattgcaattcccctgtcttgataaattggttctgtctaggcagtgggcaaggtgaacccattgggtggtaacaataccttgatgaacttaatcattgcaaagaggaggtgaagtgagggctggatctgaaagaggtggtgacctgaaataaatttgttaggtggggataaagaacatgagtagcaggtactggtgtagatacagatgactaatgaatttgtagtgggccagagctttgtgggtctgttttcactttcctgtttccagtttgttcattttcaatagctacaaggtgagaaaaacattttatttttaatttatgaaaataaacaagacattgaacctgtaatcaagatctcacatccatattctacacactctgaccatcctggaccttcttactgttgcctaaacatgatagacccattacaagtctatgctggctttacactaattagaattatgggtacaagatagtacagaggaagcaggatttattctctgtgggattattggaaggcaacactgatatactgattcttgagaaaccagaatcaagagttcattagaagggcgcagtgtggtaactcacatctgttatcccagcaccttgggaggttggggtaggaggattgcttgaggccaggagtttgagaccagcctgtccaatgtagcca

SEQ ID NO: 95929 - DNA, 1027 bp, Homo sapiens
atttgtttttggccttaagtgatttattagaaaactgtaatgtcttatgcattatctgccacatgctaatacttttggtattgcaagtcctcctttcttcaagagatcttgtataactaaaaccttcttttgttcaggcttgttgatcttataaaccacttattgatttacttattatcttgccatttcagaaaaaagccaaaggacaagagttgtttgatcagattatgtaccacctggacctgattgaaagcgactattttggtctgagatttatggattcagcacaagtagcagtgagtaactgttttttggaagttttagcataaggagaagaaacaggaaatttcagatgatatactaattgctataaggcttcctattcttgatgtgttattgtgatataaagctttgacaccgctccctccccccacctccttgctttagcatcacctgaagtacttgttttaaaaaatgtgagttctggtcctaatttcctaacctgaattacaagaacaaaagttttcaggatggggctccagaatctttgtttttaataactgttgtctggattgttgggcacacaagaatttgagaaacactgtgtactggaaagaatgctagaatgggagtttcatgggctcttgggtaaacaatagtagtttttaatttgcaaatgaagttgagtagactaggatatctctaagttccctttcagatctgtgattctgtatctataaatagtggtacttcgacatgcatttctgacaagagaacagcatacataatggagtagaaagttggaggctattcaaataactgattactatattaggattttactggaggatgtttgaaagaaagtggcagatgaaaacattgggaggtggtttagtggttatatcattcaaactgaatgcccaaagtattaaataataaattggcaatatttactctcaaataattgggattaggtagtcttcaagcagggaggttttattttccttcaggaagttttttgtagaga

SEQ ID NO: 95930 - DNA, 1118 bp, Homo sapiens
gggtgagggtatgtatatgttagtgttttatggacactccctacctgattctttgtttggtttacttatggctgttatgtttgtggttacatattatttatattttaagatacaagtagataattgttcttccatgcctagttcgataggatgctaagaaatgtggctttctacatcctttgatatatctttatcaattaaactttaaaagtgggaaatagaagggaagttgtctcctttttaaggtacagtgaagaaagagaatcttactagtaatctatatctgtgtgctttcacttttatcttctagtgtaatataaactcaactcctaaagaccctgattcaaggaaaacactatcagtgcctgtctctgaggcctgaattttccaggcctcggtcttggaatgtggaggagatgaaagaaaacagacttgagaatatgcaaacatgaacccagacctttcccagaagaacatcacccagaactcccacagctcctaaatctcactttaacatgtgtttgatgctttatctgagttttgggtcatcttaagggagtgcaggtattagaaactattatatataagtagaaaagagatgaaaatgcctgcctggaagataactatgatcctttttctcactagggtgattttatgtttatttatgtacttacattttagagatggggtcttgttctgtcgcccaggctggagtacagtatcatagttcccttgaagccccaaactactggactcaagcagccctctcgcctcagcctcccaaataactgggggactgtaggcatatgccaccatgctcagctaattaaaaaaaaatttttttttttggagaccggtcttactatgttgcccaggttggtctcaaactcctggcctcaaacgatgcccctgccttagcctcctgagtagctatgattataagcaagagctactgtgacaagttagactagaaaggtatatttgtgagactagtcctaaatagttttaaacagggagaaatttaagttataactgtctaagaaagactttagattgttctttttttttttttttgagatggagtctcgctcactctgtcacccagactggagtgcagt

SEQ ID NO: 95931 - DNA, 1055 bp, Homo sapiens
aaacacagtggaagcatgtctaggcataatatatcagccttttgagatatttattaaaaacttgttcttatacactattttaatatgtctaaagtgacacataccttaatttaagtgcctaagattttaattaatataatttttaattacaaacacttttactttttaataaacacgaatattttaacttaccaaaagatttagagatcacattaataatgtggctcatgtatagagaaatctgaatggttagttttgaatggttaactgattaacattcagttatcataacagttaaccagtggttaactgaatggttacattactactgaatggttctataaaatgaaaaacatatttactttgtcttttcatttgactggcttttctctttcatctcatacacctgacagattacccaggtttgcaacagtctcataatctgatcctgtataacctttaaaataaaattctgaagccaaaaccatatgatttttagattgtattactatttttgatcctttttaaactttagaatttcaagctccttggtttaattaatagaagtgaattagctggaaaaagtccatttctgataggaaaacatgttaagggaagcatttcttctgtctttttttagttttcttttatattttagaaaaattttcaaatttttaaactatgtacatagaaatttatagatattttatatttcgaagagtttataatgcttcaagataatgaagcttcattataaacagcttaactcatttaatgcatcctgctcacatagaggttggttttatatctcaaatccttcctgccagacaaagattaaggtttcagagggcttaatactggactattggtttaatactgaatggttggttgcagtttgtccatagaagacctaaataagcagaactgactaatatttaaagaatgaaatttgtaggcaggtttcaatctgagtttagtataattatgtgtaagaggatggccactcaaagtatttagcacatcctctaaatataaatagatctgtatcttaaata

SEQ ID NO: 95932 - DNA, 2212 bp, Homo sapiens
caatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattcatgtttttgtgcactgtttctgtttcttggaactgtgattcctacatgctgacctcaacagagttagaccagatccactgttggtacaaacctgaggaagtgagcagaagcagccgcactgtttttaggttgatttccatgtttttgtggtgtaaatttgggagtaggggcattttcaaaggttgaaaacctcattggtcatccccagcatatcctggaaggcacggtggtcattccaaggacagcatggtgcagtatcaccacagctttggacatcggatctgggctctactgcttaatacctcaggttttttgtctgaaatggcacatgaagtgtgtgtcacagcgtgtggtagagtatgcaggtgttgacttctccttctcttggcgcccaccagtccccagccttctctgggtttgcactgcaccatccagcgaggaacagtgccacctgggttggtttcaggacttctgctgggcagagtcatactgcaccatatgggtgttggcaaagctgagaaaagttggaagtcttctctttccctctcccctctgttttctgcctgggagagaggcccagttgggccctggaaactaaggagcttttctctgctttttggagatgtatggagaggggctggaacccagatgcaatcacctgtaccaggagctcttctaagaggaagtttttggcaataagtaatgaaagccaccaataagtagcgaaaacaactcactggagagataaggactgacaggaagatggaggatgggcagcagtggaggtggagggagtgtggatggtgtctccacaggtgctgcctttagagggcaccctggccaggctgtggttccccagaaggaaggggaatggatactgggctaccaaaa

SEQ ID NO: 95933 - DNA, 1049 bp, Homo sapiens
tcccaaacctggaaatggaaacaggcttcaaacactcgtctcacgccgtgtttgagatcaccgcctcatcagtatgcatcatagatggaggtggtttcagtatgtgggtgtgtgtgatgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattgcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttc

SEQ ID NO: 95934 - DNA, 1108 bp, Homo sapiens
cgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagat

SEQ ID NO: 95935 - DNA, 2408 bp, Homo sapiens
ctgacgcctgtaatccgagcacttggaaggctgaggtgggcattgcttgagctcaggagttcaagacccgcctgggcaatatggggagaccctgtctgaatttaaaaaaaaaaaaagctgctgctgcatggcagtgacagtacgatgattctgtccttggcttgagcagttgtgtgatacgagcagttgtatgagagatgtttgctttgtataattagaattttttaaggttaatttttcttatttgccccagagctattgtttctgttgacatatggtttataaaaatcagtttgactttgtgctttaaaatgtaactacatatcctgcttagtcaaattatttcattgaatccttaaatgctgtgttcacagtgtcaggttaacaaaagaaaaaaatcattaaatggctctttcttcactattctttttactctttactcctcacccccaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaatagactttctcgggatttcagcctttttattttatccttttgtcatacatgtgaaatgcaagtactgaaggaatggccagttattcattattcttgtcaggcgttcttcaatatctgacaaactatttcaattaatacttgagttgaggcaaataaaatggtaagtattaaccgtcctttaaacttcatctttcctccatctcttcttaaaatttaaaaagttgatggtaatgacactcttgaatttttgaaacaagctttttgttttcatcctagtttgccatccatttgataccagttctagtcaagagtgggtaagtttgagccgatcacagtggctcacgcctgtaattccagcactttgagaggctgaggtgggcagatcacct

SEQ ID NO: 95936 - DNA, 1092 bp, Homo sapiens
attcttagaatatcatttctttatagttatttttatttttgattacacattatgtttgcatatttattcttttttctttgatccacatatttatttagtgaaacagcttttggtttccagcagtttatcttttttactctctatccttattttattatttctttccttctttcctttgttttgctttattgctattttccaaccttagctcatttgtttcattatatcttgcttcttgataaaggtacctaaagctatatattttcccgtgagtacttactttagctgtgtctcaaaatttgggcatatggcatttttatggtcgttcaggtctaagtattttataattgtccctggtgatttcctctttaatccaggtgtaatttactagtatgttacatatttccagacatacagaatatttgcagttatccttttgccgctgatttatgattttattatgtggtaatcagaaaacataaattatgtgatgctggttccttcaaatgcatcaagacatcctttgaggcccaggatgaagtcaatttttgttgagtgcatcacgcgtgcttagaaaaaatttgcattctctgcttgtgcaacattttatatgcctatgtaaattggagtttattaattgtgtctatcatatctttcttggtctgcttgacctgttcagtgaagtatatgttaaaactgactactacaattgtttaccaaagcaatctttctaacacaaaaattcaaccacatcattcccgttgctttcaagaaaaaaaaaattagaaataaaaaacatgtgcagctcagactgcagtaaggccctctttgcccaggcctgacatgagacctccatcaggtcatctgtcctccaccagcgccgcctccctgacccacaccccatggtcacagtgaattccttgccgtgcatgaactggagtaccacgctccctctcactctctgtgtttaggcaccgtgactcctgcttctggaattttctcctgaaactaacctagcttctcgtaagtgcccacttgcccttcaagattcagctcaggtttttccaacctcatccgtcgccgtgaccccac

SEQ ID NO: 95937 - DNA, 1051 bp, Homo sapiens
gcagggacacactgagcggccaggctccctttgagttagagcatctgaagttctgctcccacatcctctgttcccaaggatgtgaatgtggtccccagggcttgcatcctggctagaggagcacaagacaccccctttgcatggtgacctccctgcggaagagatgagtaatgaagctcagcagcctgcccaagcaccaaggaaaaaggcgtccatcatcttaatggtacctttgagctgtctggctgacctgcggcctcttcctcataggcacccctcccgaaagcatttgatgtgagctattcctggcatgtcctgtggtacaaaagtgcggttcatcttttcaaggagacgtgaggaggttgaaagtcaaagccattggaacaaaccttggctttggaggagagtcaagtgcttattatgcaagtccttgctctccctcggctgaaggcagcacaatgagcaaaacagaattttggggggatttggcaataaggacaaaaaggaaacaagatctacgcagtacataccgtctccacagggagattgtggctcttgggcactagcccacctagagcaagtcagtctccacatcacctaggataacccaggtagggagggaacacgttgggtcactctgccctggaaaggtttaggggaagagttggggttctgcatggcctggccttggaagagagatgtgtatccctgctcccatgcccatggccaccatcttcatgcatgcagtggctgatactgctgtgaagacaggcttggactggggctggagaaatctctactcttgttttactgagagcttgaacctctttgggtctctttttacattataggacaacaggcctcatatatactagtttccttctccaccagaaaggggccagaagcaaaggctgataacagtgtctcttggcagaaaagttattttagcatcccaggagggcttgctgaaccatgaccctttgtcctttggagaaggaaggcagggtgttgcccatcagtgaggatgtgggtactggggccacccagggcc

SEQ ID NO: 95938 - DNA, 1066 bp, Homo sapiens
tcaacagggcaattttttaaaaatttaatttaattaatttatttttttgagacagagtctcgctccatcacccaggctggagtgcagtggcgccatcatggctcactgcaacctccatctcccaaggggtttgagagattctccagcctcagtctcccaagtagccgggattacaggcgcgcgctactatccctggctaattttttgtatttttagtagagacggggtttcaccatgttggccaggctggtcttgaactcctgacctcaggtgatccccgtgcctcggcctcccaaagtgctaggattacaagcgtgagccaccgcgcccggcccaacagggcaaatttaactgaacttacagtacaaccacccgaagctctgggaggatggcagagtgctctgaccttagactagttacttaactttttaaagcatcagacttcccacctgtaaaaacacgagaagagaaccttccttacagagctgtgaaagtccaataatacaaagaaaatataacatcacctggcacttggtagagtgttctacaaacgttaggaagaataaaaccagaaattccccccaagaccctcttcgggtgaggcccaggggccctggagagggtggcaggcccgggggtgtggggaggacactttagccagctgcccccaattctcctccaagcctggcggcccagttccgggctgtggtgtggcttgagggcccagggctcctcactgagcttgcttaagcaagttctttcacacacagccccatatacactttggctagaaaattcaatgaggagttttttcttccttctttctctgttgttgttgggttctgattacttccatctggcttcagcggctcgagtggagtctctaaaacacacaacacaacaaaacaaaaacccaccctgcaagccacatgcaccaaacctagaaggctgcttcgtttctcgccagcgtgtgctcagatggcgacgagggctagcggcggcgggggacgcctcaggacccccggcacctgcgctcgctgcccgcgggaagagggtccgcgtggac

SEQ ID NO: 95939 - DNA, 1693 bp, Homo sapiens
cccggcacaaggcagccagccgagggtcgccgcgccagccaaggtgggatgggggcccacagccaccgcccggcgcccgagaggccacctgcgtgctagaggcaaacttttgtctctctcggtaaagttgcattggccttcttttgcttgcttttcgtgacgaagcgcctcccacctcggccaagcgcgggccgactgggatgctgcgccgtctcggggggtccctcggccgggtaccggcgcctaggccttgggatcggggccctgggcttcgggggactagaggctagtaggcgcgaccccgcctggggctctggacgagcagggcggggacgtaaggagagtcctggggcttggagctcgtggccagaggtcgatgttgcaccctctccctacctgggggagagcaccactcttctcggggtgcacagcgagccggcctccgcgcgccggcgggggtctgttttttcagggggtggagggtgggatcggaggctgggatgctccgaagctgccgtaggtgggcatgggagcgtgtctgcgggcgtactgagcgcggaggggctgcagccagccacttgagaacttcgaactccacttctccgcgctgcgcgtcccggagccctgcctttctttcttccttcctcaatccttcctccccctcgcccggcccggccgccccctccccctctgctgggctctcctcctcggccccccctctttgcctctcttctcctcctctcctgccctcggccctgagatccgcttgacttcccaaagggatccgcacgtaatcctttgccgggtcctccggttcccccttccacctcactttcatccctgcccccctactcatcgtctctccccacccccgacaatctctcaacaagtatatttgctgaggaatttgaaaaatccactactgcaacttgatctgtatgtgatggatggggagaggcgcggagagagttgggcgccaatcctattaagggtttagagaggggagtcttttccccggacggggcgggggcggggagctgggagggagcgtgtgcttgcgtgtgtgagtgtgagcgcgcccgccgcgctggagagctgggagtccacccagctcggcgccttttcagcccggcggtaactgctgtcatttcctaggaaacccgacttttaccgcgcggggagctggggatggagcccgtgcgcctcaccctgggtgatcggtcgctgaggctctcggggacctcgagcccccccgagggtgcctctttccactaccttctcttttgtgtaattgttctgtggctcctagagttgatcccagctggaaaagtagacctgtccctactgtctggtcccgcgccctgggagtcttgtaggcgtccctctgtcccccagcccgggcatcccgctcggtgcgcgacctctggcacgggctttgcagctcggtggccgcagcggtgtcccgggccccctctccgccgctcttgccgggcgtgtgaaggtttaatcccgacagcttcagataaagggagcagttgtaaaacgctcataggctgtttgcagacgaggctctgggggatgtaggagaatttgaaagtaaacgtttccctcgcaagcagcataaaatagtgtttaaacaaatattgtattggcatgctcagggggctcggtgccaaaaagtaaagtaaataaa

SEQ ID NO: 95940 - DNA, 2341 bp, Homo sapiens
cctgccagctttctctccgcccatttccttaccttgctgggagttcccttggctgggtttccctgtgtctggggacaggccctccctggggcctgggaacggctttgcagttgcttgtttagggggaagctcacggtgtggctacctgggcctgactccacagggacggggggcaccttggctatgcctggctgctttgagtttggaggctctttatttaggcttttcccagcttctggtctgtcctggggcagtcattctagaatgtggaatccagatccatcaggggccttctcttctttttgactatgcttcttgtgcctctttcttcatcgttcttgcttttgttttcctagacttgctgcttctctcttgagggttacaggaaattgtggagatgtttttccctgggattcgaattccactcaagcccagccatatggaaagttgtcgcttgtctgatgagttttaaagttaattatatttggtaagatttagggtggttttattttctcctctgcttcgagaaatatgccagtttcacgaaattgtttcgtgattttaggggatttaagctaatacagggaagatcctgcatttgaaagagcccagctgcccaggaggtatccctcaggtgaaccagccttcagttgggctagcatctgagtgagagactgtggtcagaacggtctatttgcaaagcctcttggagagaattagaattataggtagaaagaattagaatgatagtagaaagagcctcccaagccaccgaggaacaaggtaagactgctagagatggttttatcctctgtgggaatcgatttgactgaatttgcagtgggttcagattccttcagcagagacttccgggctgctcccaaactcattctgctctggccttgaaggggactcttgactcgtggcttccttgaagcttgtgtggagttagcgaggcccttgtggccaggcagccttggagtggagtgccacttcactctcccagggatgctctggtccactggtggagagagcaccgaatgcagagtcaatcctttgagttgcttggtcagaagagggggccgcagggcttctggtcagtggctcattgcctggctgcgggggtcttgggggctgtgtactgtagctggcttgtttgcactgcagactgaaaaatacacaaatacttcacgctttttgtactcccacaagtgccctgtacacagtgcagcccctggggctggattagcaaaccagggattcagcaggcaggcagacaaaattggatatttgcctaataaacacccttcttccattgtcccccacccctgccccgggggtactccacgggaaaacttcactccacagatgccagcagttccctttaaatgggagtaggaggttgtcatgtgcactttgaaagcttgtgtgaccccctcacacccagctggcttgttaaagcctagaatcggagtcctacatccttgtgtactctttgggtagggcagctggccttttcctggggaaagtgtgtttagcccagcttcctttcatctgcatggctcttgcggcagggaggtggagcaaaccagccttgcttcttggaggctgtggggaggagaaaggggttctacctgggccagagcctgtttcctagtggacaaggggcagccaggccaggtggacctcgctgtggacagctgcagctgttcccgctgggccagggccctttgaaaaggaacccgggggagcacttcccccctttcttcttttcactaagtgtcagaggcatggacaagtgaaacacgtgaagaatgccaaagagagaaacagtgttttcagattccagaaaattcagaggcagaataggtgattgtaccaacaaccagaatgtacagtgatttcagttgctcctgaaattgctcctgcacttctaaagaaatcggggaggaaaaactgctctctaattgtttcctcaggcttgtttaacagatttgagaaagggtcatccgacattgatgtttgagagtgtcctttgaaaaagagtggcaccttcaacacttttctggttttcaaataaacacacaacaccggattcaacattaatcattttctctgaaattaatttgagggtttgctgtggaatatcaagaattaaaaaaaaaatcattgattattatttttaggtttagaggatgacaaaagcatccttaacccacaaaactgtatttaaaacctgggaaaatgcacagatgataacggtatactttctgtgcatttaatatcttattttcccccaattctttcatcagcacagtaattctcaataatcctgtttgtg

SEQ ID NO: 95941 - DNA, 1403 bp, Homo sapiens
cgcccccgccgtctggaccttcctctccctccgcgccggcttttccgccacgcggagcgctggctggcgaggccgcgtgtccgagcggcgccgaccgtgccgcggccgggggacattccgtgccccgagcgccccgggcccgcggctgcggccctcccacctgcgcgccggcctggtttgcagctcccaaacaatggccacattgtcgcagccgcacaccggccgccgccggcgagtggcgggaggccggactctgctcgtggcgagtcgggaagaaagccaacgggccaggtccccacagccgcgcccggagcgcgcgagcggctcccacccgggaagggcgcgggttccgaggggcgccccgggtcttcctcgaccccgtttcccattggcctgccctcttgcccgcttccccaggaggggcttccagttgcctttacagctggcgaagtgaatgagagcactccacgggagccgggaagagagaggccccgtgaccaaacttttggtggcgtctgaaactttttctgtaaggcatctgcagacagtaatcactaaggccgccttctgcccttgtccactcccggcgacaggaaaggaagggcggtcctctcttccattcgtcttgacctgtagggattcgaaacctcttagcgctcagaaaaaagatctttgaatgcctgatgttaaaagagcgtccctgggtccaagatagccccttcagcagacgcttagcaatgcttctttgtgtgctggacaatgcagtaagtcagccagacttttgagccacatttataaggaactgtaagggccgctcaagtacacttgtgctaagttgaattgattgaaatttaatggcggttagtggcgatgaatggtaatgattttccagcgtatctttggcatacttgacattaataactggagtgtgtgtgtacgcacgccgagagcccgccacacacgtgaggccgtagcattattcattttccgaggtgccagtcctttctctcctcaaatccttttccatctcaccataattcagttgttaggatgactttaaaaaaaaaggaaagagggaaagagaaaaatctttctccattgagcacgtacatcatgtcaacgtaattttgagctcatgatttcttttcaattcctacataaatcagcttctaatatatagaatgtgacgaatttgttttagctgccatcatgaattaatgttatgcaaatagaagctgtgcaggtgaaatgatttacttaataatttcaacttctaatatttaaactcattcattatgttggagttaaaaaaagcaagtccatatttttaaacctcagatggggagattagtatgcaaatatttgcagtgcagcaacccttgatgaccagaaaatagctctta

SEQ ID NO: 95942 - DNA, 1446 bp, Homo sapiens
ggaggacacaaatgcatttacataattccatcgtgaccatcaatgtaccatatccagtgggactgaactctctctgctttggggaccaaggaaggcttcccatttgaatttgtcttgaagaataactgtaactgccaggtagagaagggtaaagggctctgatgtgccgcctccccgctccccttcctgcttctttgtcctttgtcctttgctagttaagaccatcttaacactgtaattccaggatttggggaggctgaggtgggaggattgctggagttcaggagttcgaggccagcctgggcaacatagcgataccctgtctctacaaaaaaataaaaataaaaaaagaaatcatcttaagagccagtcattaaataccggcctatgaaggtgaccctggtgtagaaagttgggccagaggactacccagataactgttaggaagactttcttatatataccatccttcccggctgtttccctctggaagaagctaaggaagagcacaagagtgatggatggctgcaatataaagataattagcccgaaccccttggagttatccccagggactgggagacccagtcactcaatagctgggtgaccctgtgcaagttgcttcgcctatctctgggaagggggcggggcttggtagatgtcatctctcaggtcctcccagcttcaaaaccctctgagctagcacaccctgcccactggacagccatctctaagagtcaagacagcgggtagggtgggaagatcagagtctggagaaagggaaggtcttgggtaccccctggggagagttgggtgcctgtcaaggaatatgtcctgcctctccttgctggccactcttcttagccagccgctgtgctcaggtacctctgggatgtggtcacagggtcagtgtaaatgggagtggccttggggacattggtagagagcggaagcctgtgatggtcttttcagactttcctcgaggctgaagatcagtgaaggaagggctgacacataaatttgtcttggatctctgaagatgataagggtggagttttgacttcacttctcaaaaaattgaggtcgttgcagtctgatgacaggttgaaggcacatcactcagacgtttctgcagacagctgtgggttgtgctgtcatgatacattgtgtgtgtccaggcagtgacagtatatttagggctggccctcgctgtctgtggagatcaaggtgaggggacatctctggtgctcttgggcttgagagaatgcatatgttgccttgtttatgtactgaaagaaaaattggactcagtagctactctgttacttccatacttttcaggtatgtgaatcaatagttggaacaggattgtagagtttgaatgtaattcaggtacattcatctaccgaagatgtggtacataatatagtaatttacatacacagt

SEQ ID NO: 95943 - DNA, 1023 bp, Homo sapiens
aggtggctctggtggttacttgcttttactggcccccaagagaaacaagagagtatattaagttaacatgttggtttatgtgctgtaggttctgtcccaagtgtccctgggatgcctcctttctttttccatgtaaggaactgcagcgccatcaggatgctttgtggctgaagtgggaccaatttggcattggacagtttgagtaggtcttttggaagtttgacccacacttaggtttggttgaagggcctaccttgtggacacctttatggtccctaagaaaagtaggaaggagacagattgtccaataggggtgaagttgcagaagaggatgctgtgtggtggcgtcaggcctgggagctggaaggagcctgccctgagggtgagcagagccctcactcaagattaggggcctaggaacagacttttcctttcactactgtcctgcaggccttggagacctgggctcttccacacccgcagctgtgaccatgtggggtggcttctggggctttgattcatacagttttgcactgcagacttcatttgcttgatgctaatgttacaagtgcacctgggccaggacttcaagagtgcatggaagaacacactggaaacatttgaaattgtgatgtgggtgggtcctcatccaccctgcagctggttcacctggtggccatgtggtgggatttgctggtctgaagaggctcaggattccttctgtccacatttttgcagttcttctgcgcaggcagatatgtacagtagattgcaggctcttgctggcactgggggccccgtgagaagggaggtgggatgtgggctggtgccatttccatctcctctgggtctctggtgtgcaagacctgggtgccacatccttctgcaggtgcaaccctcagcccctgggcccgtaggacctggtgcccagcccatctgttttaccaagagcagcagaggccccatgatccagtgcgttgcttcttcagtgccatctctctccgtcttcaaggggccaccttg

SEQ ID NO: 95944 - DNA, 1794 bp, Homo sapiens
tttgcagatgggtaagcagggcctcagagacactggcggatctccatgttcacctgggcagtaggggcagagctctgagcggaggcaggtttgctgacccccaagccaggaccctctcccagagttggctcctgagggctgccctgggagcagctggtttgcctcaaacaagggctatagcactgatttctcaactgggcagtgtctccagggggcatttgacctgtctggagacatttttggttgtcacaacaaggggaatgctattggtatttagtgggtagaggccagggatgctgctgaacatcctgtaaaccacaaggcagcccatgacaaagaattttcagcccaaatgtcagcagtgctgctctccagaaaccctgagtgggggcacatcataggggacccctcccctattgacacaacaggactctgccactggggcttcccagggactctgacagtggggctgtcaaagcaggcagcagtactttattcaaacctagttctcacaccaggctggaaatcttaaaccttttctgtgccttgaatttgaaacagtgtggcaggtgccatcaagaggaattccttgtgtaatccatcagtcaatcagccagtacttactggaacatctgttatgtgcccggcacttattaagctcacggctgtaggcacaccttgctaacttggttacggagccggcagtctccgaaatcccagcaggtttctcaaatgtgcgtattcctccttatcccccttgcctaggacggagcctactttaggaaaggcatgatctggaaaggcatcatgggaatattggccaggagcaggaattgccccaaactcttttccccaagaccctggataggtctgttttcctggctccaggctgacaaatttccacttcacaatgaattttgttttgagctatgcttgcagctactagtcagagaatgcaaagtcctgtcagtataatgaaaagccccagagtgaaggccttgagcagtggctcttttaattaaccagtttgcctgagcagtttggaaggcttcctcaaagagagggccagactgggtcttccaggaggaggactttgccagcagaggggttggggaaggaagggcaatctgggcagaggacctcatagggcaagtgctggacagggtgtggcatttctggggcctctggtatgtgggagagtcagcgtggggttgcctccaaggggtggctttgtggtccccccggatgactcctctgcctatccatggtttagcttcaggtcatgggacataaatgtgcagaggcccaggttctttccgaggctggaacatttgggatcctgatgtgcagcaatgagattgatcatcagctttgccttctcattctccccgtcttgggtttgggctcagtttctaaagttatatctttctgtctggtgggtggtggttctcagaatgctctctactatgatccccagtcaagattataggttgagattaagattatagtgatcttgcattctccatccatccatccatccatccatccatccatccatcctcaatccatcatcatccaactatccaaccacccattcatccatccatctacccatccatccatccatccatccttccacccatccatccatcatacattcattgactgcaaggattttaaaggcctttgctgttggtctttggtgtacccttcctccccatccatgaagccaagggtcatgtcctctgtaaagtatttcctaccacagccctaggctctcacttgtctctggga

SEQ ID NO: 95945 - DNA, 1944 bp, Homo sapiens
gctaatattaaagaatataattggtttatttatattgcttttatatcctgctttttgtagattttgtcagattttatacatgtgtttatgtcatcagtgaatacagatagttttacttcttcctttataatctgaattccttttatttagttttttgcctttcactggctagaacctgcagtacaatgttgcctagaggtagtgagagttcttattcttatcttgtttttgatcttagattggataacataataaatttcattagttggttttcaactgttaaaacagttctttaaaatttcttttgtgtattttgaagctctgttattaggtgcatagatgtttaggattgtcatggtatcagatgactttctttatcatctctactaatatcctttgttctggctgcttttatgattttctgtgggtttgtagtttttatcaaatttggaaaatttttagcttttatgtctttaaatatttcttcttcctatcctctatgttctgtttctcctttggggactccagttacatgtatattaggcagcttgaagttatcccacagctcatatgctcttttttaatgttttattctgtttataataccggatagtttttgttgctatttcttcaagtttacagatcttttttcttcaatgtctaatctaccaccaattccatctagtgatttttcatctctagaagtttgattgggtcgttttgtatcttccatgtctccacttaactctttggacacaggaattcatttataactactgttttcatgctctcatctgcgaattctaacatttgtacctgctctggctcagttttgattgatgtttattttcctcatgtacttttctgcttttttttttttttggcatgtctggtaatctttgctagatgctagaatattgtaagttttatcttattggatgttgaatatttttgtcttactataaatattcttgagctttcttctaggatatgattcatttacttgcaaagtttaatttttttagctttgttagatgggaccagagcctagggctaattattccttgctattgaggtaaaatccttcagagttctctacccaaggctgtgtgacttttgaggttttccagtctggctggtgggcataggcactggccttgtctacactgggcactcttccctctcatcctctcagctggatcttttcctggccttggggcaagaacagtatgtgctgattctattctgcaatgctccagggggaccctctgcaagttcaccaatgttccccttctgttcagctcttccactggtctggtgttctgccatgcaaaacccttcttaccctggtctccctcctctccaactccatctccatctccttaactcaggaatccaccaagctctgcctggttacccctccctgtgccgtggcctggaaacactctctggaaaggaagctggggcaggctaaggctcacctctttggttttcgttccttcattgcctgatgttcattgtcctgaaaagccattgtttccatggttttgctggttatttgatggttttgggagggaggttacatctggtccctgttattccatcttggccgaagcagagagctcaccttgcacttttctcactagcagggcctttctgattttaagtggtgtgagtggtccactgtaaggatagtcctcaccctgatgtgtttaagacctgacgggagaggctggtgtggccagcgggtgtgaggagggatggctggggagaggcctgaagctgacaggggcagggacatctcaccacttatccgggccgcctggccttgagggactaggcctcacagaacatctgtgtgggctggaggtttgcattttactcctagcaccacacacaatctcagcagcttttctgagggctttgtgcacagctgagcgtggg

SEQ ID NO: 95946 - DNA, 1815 bp, Homo sapiens
cactgtctctctagaccccagtctgggatccttgggcctctctcatgtgccctcaggggacaaaaccccacttcacaccctgagcccagtccagtcctagctgccactgggagagggcagacgggccgcctgtccttttccttgcacttctaaggacagggtctccctgggctgcacagccgatggctgactttggtggtggcctcttcatgcctttgcatgaggccaagcccggaggtatgaataagtggctaaagagcgatcaacccaggggagtcaaatgcaggaactggaggcagcaagaaggcctggtgttgggagagccggaacagagggccgccaagggagagggccagctggctttgtgcccagctgactgggcagggacctggtctgtacccaggccggggctggaagggcccctcaggatctggttcaggggtgtgcctgaacctttcccctgcctgccagtgacaccttggagctgacgccccctccatcaggacccgttagggcaggtctggggaacaggcttcagggagacaggagattctgcagggtgggatgggcccccttggcctagcaaagctctttctccgttgcagtcaggtggaggtgagaagagcccatcaggcgtctttgagaccgctgtctccttgtgtttttgaagttcgctgcctgatttccttttggcacgcgctaaggcggctgcaggagactcagggaatgagataggagatgttgatgtgaagagagaatgtggaatttacagagcagcaggaaaagcactcctcctggaattcagacagcatttgtcacagtgataacgcctgttttctaaacaaaagtccctctgtgggcaaggtctcggagacgtctggagctcttgcccagctcccctctcgcgtggctggatcgtgtttccttgcatcacgatggggagggttcggaggttcacgcggcaaggctggggctgggatgagttatccctgctgttcttcagcatgtctgcagccagctgaccctctgtgacctcgcagccttcggtccagctgtggcgcctcagtttggacacatcagtctctccaggaaatgcagcaggcaagcgcgtcacttcctgccacccagacagtgtgaagagcgtccagcataccctcgcaggccccataatgtgcccatccactggacggagagggcctcacgcccctggggctgaccctaggctccccacctgtggagggaaggtggctcctggagcattttccgggctggagaggattgtgggggaagcccttgagtagaagagtatggaggctgccctgggcagagaagaaaagtcagtggtcaggagggaccacaccatagaaatgggaaagaaaggccctcccctgatagcctgaggttctgtgttcaccagaagcaggaggaagccaggaggtggtgagagcagcggaggagcattagctctacgctcagactggcctggtggcatcctggctcttctgtttaaggtctttatgcctcagtttctgcatctgtaaactagggacataatggtgaatccttgcagggtggtttgtaggagtcactgagaaaacatgacatgagagagttgacattaaagaaaccggtggccatcatcattatattattatgtgagtagattcttaagagttcagtgaaattcctgggaaaaattccagaggctgtacttagggcagttcgctatggagggcctgttcccaggtctgcagtgtcactgggcagggaccatgacagggcagctggagagaggctggggaaaccgacaggcca

SEQ ID NO: 95947 - DNA, 1052 bp, Homo sapiens
ctcctcatttccaagccaactgggaaattaagtcgcatctccatcagagcgctattagtaattttcaagaaagaggtaattgaaaagaaactttttaatacactcaccaaattggcacaggggcacgggagcagtgggagcatcttcccaccgtctgcctgtgccccccgctctgagaggccatgcccctctgcccagcccccactgcctcgcctgggtcaccctgccccagccacagtggcctgcgtgggctctggccccacctgggccttaacccaggcgcttgtccagcaagccggctgtgtgacccttggcaagttctttgcctgtctgtgcctcttgtcttcatctggaaaagcagacttcagtaccacttcaattcccatggacattgtgctgtgggagggagataaatctaggaagtgcaggcccctgtcacatcagaaggactcgatgcctggtggctgccaccactgccaccctcaccccccaccacagtcagtgctgctgatactcctcagagttcagttcatggctgtcccgacgctcctggaacctcaaatccaccccaggctcttcttccccaaactatttttactcttgtctgaagctcgagtttggcatattttaaaaattaaaagctgcagcatctaccctggaatagcagtatttctactagcactgatgatcacaggagcccgcctttacccggcgtcggctgccaggccctgtgctcagagcccctgtgcctttcccattcgatcttcacagctgccctatgcggtgggcggacttatccccgtctcagaggaagcactgagccagagaggagaagcgccctcagagctggggttcctggcgaggccactgagctctgcttgcagggactttccatgggaaggtgggctactgtgggtgggcctgttgaactgcaggtgagaaactgttttctgtccagctggcctgcaggctgagagcaggtggagaccacaaaacttgcatctggcccgctgctgggaacagaaggggctccgtctacagagtgacttgtt

SEQ ID NO: 95948 - DNA, 1901 bp, Homo sapiens
gcatcccctccctgctgtttttgtaaataactgctttattgagatgtaattcgcgtaccataaaattcaccctcttaaagtgtacaattcactgctttttagaatattaacaaagctgaataaccaccaccactatctaaaccactatcaccacatatctaagttctacacatttttatcaccctctcaaaaaaccctatacccattagcagtcgctccccatccctggcagccactaatttactatctaagatgacaccttttcatgtgtatttatttgcacaaattcctagacaggaagtggaaaattggtaacccgtggcctggtcatcaccaggctgttttactatacaggaaaattgaaataaaacccctgttcttgacttttttgagggtttggtttactgagtcctcatccttgtgtgggaaaagctggccagaggggagcagcagctgtctgcttttgacaaggcctgtgtgctccagtttgccacagtcctcaccactccctattgccccaggcttgccagccctgctgcatgactccattggtatgggaactggcagtccttgcctgagacctttgcttcctctgaggggtgacacactgtcagctgtttgccagcctttgcaccccagatccttttctgtgatgtggccccctgcccaaagcccgggctcccatgagagcccaccagactcatgccagccttaaaatctcttttcccaagagctagtctgtgtgggtggtccaggaagcatcctccatgtccatctctacacttggaaatgctgccccttgccaggactggtcgacatagggacgtgggtatgccgggaccttgttgtcttgcccactttcctacctatcacctccccttctgtgacagctcctccactccacactaatttaagctttgtgtagatatgggcccgctcagcatttcaagccatttaacctgctgtgattgaagctgtggcaattaaattttaattgagatgcacgctgcttaagcagacacaagacagctacagctattgctaattaattttcttccgaaatgacaacatttaataattatgcttcgtgacgcgtgtgttatttatgtagcctcacctctcccggtgccgttcagtggtgtccatcaggggtagttggtggtggtgtcacgtgtgcctgctggatggcttctgatgcgaacagtgcgctaatgctccggaggtgctgagacgcccttcctggcgtttgaaagagccccccagtgcctgcctcggggtggaggcattttgctcccccatgcacctctcagcagagcgccgaagggttctcactagggagagtaccccccagagtaattaagagcccctggtttgcttagttagggaatggccttcctagttaaaaaacctgatcctccaaggcaggggagcagagcgctagagagagcctggggtctggaactctctgtggacttgggtttggaacatgagggtgggcatgctgtcagagcttcctcacctataaggtgggaaggggagtgttcccctggggggaatgtgaggctggcagattccatatgccatgtcgtacaggggcacaggggatgggcaggaggcatcagccaagtaacagcagacccggccttcccccgggctcccatccctttgtgttctgcggccctggaccccaggcctcctctaacgctctcgccctggctggcacaaatcgctttcctgggcttagcctgcccaggggctgggatggtcccatcagcaaggcagggccccagctagccctctgaactggatgctgtttttccagggatggaagctcctgagcccggaccacccccatcaggtgcctgggcaggtgagggatgagatggcaggaggcgatggca

SEQ ID NO: 95949 - DNA, 1120 bp, Homo sapiens
agggtctctgctgcctgagacttggccattgaggacttgcatctggggtgtagacttgggccattgcaccccaggctggggtgcagagcccagtgtggtcagagtgggagcacggagactcactgggggtacagaagttgctgggaggccatggggggcaggcagcccccacccggctaggcccagctgtgttggtggcatcaaacacggggttggcagcgtgcagctggctcagcatggttgtgatggggcagggcttgtttttgtttggaggagggaaggtggcccagtacccactgtaaacagagctgctgccacctaactgatgagttgtgctgctgaagccttgtagcccccacagatgatggccaagaaagtggggtctgacagggctgtcctggcctcctcgctcccgattctcctccctatgttgtgagatgcccaattatttggcagccctgggcttcctggcccactcctcctcctcttcctttgtatctcagaactcgacgttagctcctcacagcgtccctcctttcctgtgactcagagtgctcccatcgtcgctcctgattcagtccctgcagctcctgccatcacccacacacagccagagaaaacaattagggggcacggtgggttacctgccgggttcctagggcaggtgatgtggcgcaggactgtgtggcggggcgtgtgaacggtgagggcaggtgctgtgcctgagttctggggcatctgagtggcaggcaggcagagcttcagattccacatgtggctggtggggtgagacggggtgaagtcaccctaggacctgtctagctgtctgtgcccagggggtatacagcaggctgggggccagtccaggtaggcagggcacagagaccttccacatggccaggtaagtgctggatggagaacctggcacacccatggcctctggcctgcttgtcttgctcctgaagctgcgacagggaagccaccaggttggcttgcaaatacaagaggctttgtaaaatatgcttccggctttgccagtggaagtgctgggttgaaccagaggaaggtgtaaccctgggttgatttggtcacttgggccaccaggcttgcccggcaaatg

SEQ ID NO: 95950 - DNA, 1025 bp, Homo sapiens
gtgtgagtgtgtgtttgtgtgtgcgtatgtgtcacgggtgtgtttgtgtttaggcaaatggggaaagaaaacaacacccgcattctttttcagccccgtagacatcactgcatggtgaaggaatgtggattcagtgcagcaggttgtgtttcttttttttttttcttcatggcacataaatacctttgggtttctcggttctcagaaaggcatctattactcaggtcttacttagcagttatcactgaagagggaagcctggagtgagcatgtgggcgggcgtgccacacacactcataacgcccccttcagctggaaggcagactccttttgaatccagatgagcagatgtcttgagaccaagaagatccacttgccgagctccagctgggggctgagagctcgccctgtcctgggagcaggcatcttcccctctttcttgcagagaagcagagaccaccatccccactgaaatatagggacccttgcccagtgtgaaaggaggaagggaggaagacagggagggaaggaggaaggaaggagagagagaagctcagcacagctccaggcagaacctgtgggagtttttccagcagcgtggggtgtgtcgtttgctccccttcccagcaggaggagggagtttccagcaggcagagtggtgtgggatgagggacatggctggtggggaggcctctggccccatggcgggtgtcctattcaatagatggtatcactgtccactacactacagacacagcagctgcagcctggagacgttaagcctgccacccgggttcccagctggtaagtggcagagccagtcctgggtcgtttccagcctggaactctggagcttgccagtctgatgcacgtttattggagatgtggttctctcctctcccagcgatgtcctgtgaaggctctttggaggctttctgtcgtatttctgagctgtgttacagcttctggacaccagtgaggtgaccccaccccacctctgtccatgaacgtcagggtcatagtcg

SEQ ID NO: 95951 - DNA, 1032 bp, Homo sapiens
actgtagaggcgctggcaccagggtgggtggaggaggatgcctggatgggactgtcgtgtcaattcttggacagagccttctgttggtggggcagcctccaggcactgctcaggggcaggccttctccagctgcagggatgataaggccaggcctgtgtgtgccaggccccatgtgagacattctgtttatccccacttaacagatgaggaaactgaggcttagggagaagttgattcttgtcgacagttcctgacagagctgggaggtgaacatggccattccttctccagagtctgcactcactggcctccagctgaatgtgacaaccactgacgtgtgcacaggtggtgtcaaagttcagtcacagcacaaagaggttggtgagctctgtctaggactctgggaaggagggtgtgagagcaagctttctggattttaaagcatggcatcctcggtagagcagagggaagaatgttcctggcaggaaggcatggggattggagagggcctgctggctttcagggagtaaatcccagtggaaacaaacgaagtcttgaggccgtctcaaatgtcaacctcaaagtaggtcttacccacagcttcccagagggaaaaagtcctcctgatactcatcaactcttatcggaggctggctgcccctggaggggcctgcatttcccattggggccctccctggcccctgttccagcccagcaagtcagtgaattagggttaattatctgttttcctggacaccagcaggcccaggagctgggcaaattaggggagcttttgtacttggaaaaacaaattcaaggagcgataaagaagcaggtgcacctgctaggatggggattttgtatggtgcccacccctggccacactgggagggtgagggctttggccaccccctcaacttgcaggcccctgggctgcatcccctgaaagaggtggggacagcaggcacaggctggccaggctgtgctgcagaagcgtgtcagacacccaggggctggaggccttcctaaac

SEQ ID NO: 95952 - DNA, 1441 bp, Homo sapiens
aagaggaaggcacctctgctcccaggaatcccaggcaccatgaaggtcacctgtgagtttgctaagaggtctggccaccccaagtccagggggctgagctgcctcagacagcggtgggtggggcctgagtactgggaggggagagagggaggaggggagagagggaggaggggcatggtcgctgccaggcagccctggggtgcgtgcagctggcacatttgaaatgtgcccagagaacttcttgcctcttgcccgccaaggactgttttggaaagtaattgtctcctgatgccttctggctctaattagagggtcaggttcgggatttactatcttaggtgaatttttggccaacttaattataacaaaagagactacacgagccacagcctctcattttactgccccaaagagaaagactctctggtttctactgggccatccgtgccagcatcccgttgggaaagtttggcgggaaggcgagacctccgctgtgtctgcacagtccatctggaggccacagaactatttctgtctcggaggaatggagagacttcgatttcttttcctccctttttgttccagtgcatttagtcaggccctgttgctctcagggctgaggcacagctcagagagcaggcagggaagagaatgcgccttttcttccggcgggcgcttgggcagcgcccctcacactttgatgtatacacagttgttgggggcttgttttggtggagaccccgattcaattaagttggggcagggctggctgagtttctgcatttctgttgggtgccaagatgatgctggggctgctggttcacaggccacgctggggccggagcccaggaacatggaaagaccctcggaggggcttaggagttggtgcttctacgagtggacctgagggcctgcggggggttgttactgtatttacttttatttttcctgcggttctaagtgggaggtcattattgggatgtgtggctcatgtcaggaaagggagatctgaggtcaaccttcaggccccttggggaggtggccttctgagctggacgatgcctctccaccctgtgccccttggacggggactctctaggccctccctctgtgaggaggggccagctgggggtggaggaagagctcttaggtggagtgggaggagccaagcgcacagggagggaagagctggtggagcggccctggtcctggggccacacatggtcttttccttcccctgggtcagggccatccttggcctgtgggggcacctaaagctgcccctctgcccatgctctgaggccttgtgagctccaggaagcctggcctctgtgtatgtctggcctgccccagggttttcagcgggaaccatccccccatccctccgccccacaccctgcctctccaagccatgagtggatcatgaaccaccatggtgcaa

SEQ ID NO: 95953 - DNA, 1492 bp, Homo sapiens
gctgggccaggtgtcctcccagtgtgggccgcaccagcaacatcagcatcccctgggaattgttagaaatgctaattcttgagccccaccttagacctactgaatctgagtctgtgggggtagagcccagcaagctgtgtttacacaaaccctcttggtgattctgatacactcctaagttggagaaccgcatgttctgactacatgaggtagggtgggtcttcccatacataaaatgggagttagacacagagctgcagtgcagagattacaggagacttctgatgtgcttacacaggcctgccagggcacttcctggatagtagctgtaacactgcctctcttagtgcaggcagtgctaaggaagtagtgagaagcagcccaggctctggaaccaggctgcctggttaagtcccagttctgttgaccttaggcaggtccgtgcctcacttttctcatctataaaatgggcatgatcttggttgtgagcattccttgagttagcacatgggaagtgcttcgaaaagtgttgggcacagagggccttgtgtgaggtccaagttgagtatttgctttatgaactattgctattcttcctaccagttttccttttctagatctgcatactctgcctgacttagaaagtttccctttcactggtaacccttgcctgctgacccgttgaggctgacagcaggtgggaaacccaggtttctggtgacttcctacttgagagtggtgggtgccctgggctggaaatcagacctgggtgcctgtcccactttgctttgctcccagggcctgtcctgggtgtctgtcccgagtgggctcctggcctctctgacttggtcttttccccagcacgctggagaccagaccagaccaaaggttactaaagctggccaagccttagactctcgtgacaatcactatgtaagtgcagggtccagggcagcccctgggctggggcctgggcatatgtatttttaatacgcttcacaggtcattgggcgcagtccgtccaaggcatgaacaagatcccttggagtattcaagagtctcagggggggagactacggtttgcagctggtagtactggcggggctgtgaccaggctagcatagctagggtcaagcactagacgactttcagcagagcgctccagtgttccaggaggcgtgtgtgctacctactcatactgacagccctcctatcttcttcattggccctgctgggttcttggaaagtttttctgaggcacagttttgcttagtggcgaggcatgcatgtctatatgggaatgctgtgcaaatagcagaatatttagacgactcattttcattgtgttggccagagctagaaaatcccctcccaccacctgccttaccacacctaggaatctgtccaatacccctccattggtacgtacctccaagtccctggtgtctttgcactctgtctttttctgtgcctccaggatgtccttgtgggc

SEQ ID NO: 95954 - DNA, 1307 bp, Homo sapiens
aagaagcttttgaaatcctctagtttgaatccattcattttacagatgtggaaactgaggtccagagacacaaaatgcagagggttgcctagtgatattacttggactggaaaccaattccgcaggaacattccatcacatgggacacagctgtccctcaacctggccctcctcctggcccaaaccccaacttcccaagtgactgtgtttatgttggaaacatttttctgacgtttggttctgtcaaaactaattttagcatttctaaagcttggtaaaaatacagcctcattactttgatgtcagtgcatagtttactattagtatattctggggtttatcattttagtcatgtttaacacggctgtgccaggcatgcactattaaatctggcttattttacattcctgtccggaattatttatttgtaacaatttcctctctatcaaaagacacagctaatgctgtgttttaatgtgttatttacacacaaaataacctatttacaactcagtatgcgccggagggagaatggatgggcccctgtttcctgcattctgttatatcagagtttaacaatctggattgctaatagaaccatttatcattacttgggagggggggaaagagataatttattttatgtttgtggccaggtctcaccgcctctgatcttgggaccattttgaggataatgaagtgaagccctgcatttggtgggggctgtggggcacccgggcctgggtgcctctgggttccctgcattcatgtgcacatcctacagatggtcccgaactgtggaccagagaggtggtgatgacagggacgttgcctctgccttctaggagcttccagttagaggtgacactcagcagatggtgacgaatcctgcccatagggcttcacgggggaggcagtgtctgagcctggggacattcggggttccaccaggtggaaagaggaaagggtgggtgggccctggtgggaggaggaggggcagagtggccccctgggagtgtggggagggaggactgggcgccatcagctcagtctgtatgtctcctgcgtgagtccatatgtctcctgcctggcatatggggtctgaaggacaaggctcctgttgccctgcggggaggcgcagagatggctggcacccaggtgggtgcatagctgatccagggtgcaggccgaggtcccggaggctccactgaagtctctttgaatggacattgaggggtaaggagggaaagcgccatttgaagctgctgtcctctatgaagctctgtgtggacaccagagggggatag

SEQ ID NO: 95955 - DNA, 1090 bp, Homo sapiens
aggacctggtaacactgctgtgtacagccctgtgacctggctgctcagtcagtcccacagaaagccactgtgcactcagatcagggggctggggagggggtcaccaaagtgtgattgcaaagtgtggcagggcttgggcaagcccctggggacgatgcagggagccatcagccccaggacaccagcatggtctgggggatggggcctgggcttggacaggtgaggtttgaacccttgccctgccccttctcggttgggtatcctgtgctgatccgaaccccagtgtcctcattttaaacgcaggccaaaatgcgtatctttggagggctaggctgaccaataatgagactccagtgcttagagggtccctggcacacagttggcattctgtacatggtagttcagctgttagtattatggttcttgctcttattatgattcttaattcaagaactgttttctgagggtagcgcatacgttccttaaaaatatttgagagagcaaatgaaggagctgagtctctataatgagttagcagttcacccgtgatgtgcaaggaggaaccacactctagcctgagaaacagcatgggcaaaggtcctggggtctgagaatggctggagaggctgagctgagcgggaagcactggcaaatgaggctggttttgtcagccccttggcaaagggctcccttccctccccgatcctggcacaagctcacatctgaggccgagtctagtggcccctcctagggtctgtgtcctccctctgctcacagccacacgtggacgctggtaactcagccaggccctgtgtgcacggcttgcttggaccacccccccacacacctccccgcccccgccaccctgagcatctggcttcttctccttctgggtgggcagggtggggagggagccagaggggctctgtcttgagaagccgcccttggctctttccccttgaatatgtcctggctggccctgctgtcagagggcgtggacctctgctttgtgttttgggggattgtgaagcttgaaaccctggcaccagacagccaggcctctgggcagagcagggcctcatccgccgtc

SEQ ID NO: 95956 - DNA, 1023 bp, Homo sapiens
gcaggggtgtggagggtgaagtctaacaccaggacagccagtgggtacatttagggctcttgtttgccatccaagaagaagcctccaagaagaaagtagcatctgcttctctaatcagcccctgggaaggagtgtggacgtgccagtggcctgagacagagataaatggtgtgcaccgaccctttgaactggctgggcctagtctgggtgcatttagtgcagacaaagccaagagccaggaaggactgaaccacacaaggccgagctgggccaggcactggcattggctaagtccttaccgagtaggtgctgggcactactggaaggaagcaagagtgcgtctctccctgcccctcctccccaaaccccactcccaacacgaatcactcctgagtcttgataatattccgagtgagtctgggccccaggcgtgtctctccagggactctccagtcccccagtgtctccgcccaggccctgtgccctgccaaatcccaaggctccttcaaggccaaattcagtagtcaattctgtttcattcaaaaggcatttagatgtttacgaaaggcctactggttagcatgttaccagggccacccggctagtaagtggtttgagccaggatttgaacttgaatccttctgagcctcccccaccttatgctgataacctgcttatctgaagcagccgcagccccccgccctcttttactgatacccacttctaggttacgtgctgggaaacatatcattttgttagaatagtttctaagccaagaatccagacgcactgaataagggcctagggggcttttatcatacactcttagtgcaaagcctctgagatgtaggtttaggggctcaggggcttcttggctcttgttgggttcctggctgcagctggtagagttgccttttaggagtgagtgacctccagatgggtgaggtttgtgttgcactttaaaagtactgatagtagatattcagagtgacagagtgccactaatagagatttttttttttt

SEQ ID NO: 95957 - DNA, 2702 bp, Homo sapiens
ggctatttttaatatttttagtagagacggggttttgccatgttgaccaggctggtctcgaactcctgacctcaggtgatctgcccgcctcagcctcctaaagtgctgggattgcaggcgtgagtcactgcaccccaccggtttttgtattttctatccaccctcgtttttaatcttcctttgccattcctcctttagcagctgaaagccaatggcaggcacagagaattctataacctgagccttgttctcaagaaccagaaatctgaaggactttgccacaggcagtttattcatctgcttgcaggcatttaccagttactgtgccagtccgttatgctggggcaaataccccactggccaagcccccagggagctcaccagctaagaagaaggactgatcagtgcaaggacagcatcttagtgtggtaacgactccaagagaagtcatttccagatacttcatcctgctgctgggggaagagaggcagggaagacttcttggaggaggccagacccagcctgagctgggtcttgagggatgaatacgggttcactaggcagaaaagtggggcccagagaacagaatacgagcacaggcagcaggatggccagccgccaaggccatgggaacctggggaaggttggctgctttgctggaggaaacctccagcagcatctactgaggcatccacccttagaaagactgaggctgatgaaggcaagtgaaggaaaggtccaggctggtcccttttgccctctgtctggttttctctgagctaagatagttctctctggctcccttaaaatcaggacagtggagcgaaggtgggtttgggggccaatttctcctcctctcagccatcccaggctttgctttcttgccgagtctaaactctcagctgtcgccctcgtatttgctcaggggcccctgttagggggactgtgcactttcatccagctggacgccggagttccctggaagccgagagggttaaatcaccaagccagctggtgagcattagttcccccctctccaggcagtaacgtcagaggctgatgctggcggcaaagaagctggtggcaggaggaggcggagagctgccttgaggcactccgggggtgggctcctggcctgggaccctgccccagcaacccccaggtaggctggctgtggatgtgtgggctccggacaccctgcggggacggctgctgtccacgccagtgtgtggacgtgtgtgcacaccctgtgtgtctgtgtttcttctctttgtgagagttagccttctgctgtggcaaaaacttcagtggagaaggaaagagtgagcgctggagagggtagctttttttctagtgggaaggggactgacttctttaaacaaacactcaagtgttccagtggccacggagcaggcagatgtgggccacactgcatcttccagggtttctctatgccacttggggtgcagtcttgagtggccagaggagcagtttgctgaggtggcttaagaacatgttttctcatctgtctgtgaccaggaggcgtttcgaagggcttgccatgtgccgactcagtaactagtgtgtggcctcccggtggtttcagatgccttgccaaggccgacccacccacctcctcgaggaaatgcaaaaagtgttttcagggcccagaacactaagcctgggatgatctgctcctccctgactggcagcctgtcttgcgtgggcggctgagctcgcagccaccaggacctgatggggacagtgtttcctggggcctctgtacgggggaggttctctcgagttgcaaaggtgcagatgcgccaggagggttcttggcccctaggcttcatggatagagtttactaggacaagcaaaggcctggtgtgcgatctgttttcctatttgactggatgttgggagaaaaatgtccaaattagggatgggcccatggctcagctgagcagaacactgggtgaacttctactgtgaaagaaatagcagatccggcggacatttatgggcgacagagaagggtagctcagcattgaggagggagtttggtctcattctggccgagactgtcaaatcctcggatgggcttgtaaaccagctcctggcctagcctcatcaaacgtgaggatgaggaagagagagcctggtgggccctggggaggggacctgcactctcagtgggacacctggtgaccagtaagcctggtccactgcccttcctcaccctctcgtctttctaataaacagaggggaggtgcctgtgcatagacttggggactattacattgactcagaaagaccctcttttcccttttgccccaaccagtgctttacgaggttgcctaagcctgtgctgcgacccccagaggcaggtgcaaccccattttacagatggggatgctgaggctcttcaccagggccgcccagctggatggcagtggggtgggtcacaccgagcctcctttcccctgggctgggctgccacccgaggcccccactatgtgttcctgtttgcctttgactccacgggggccgggagaaagtggcactggggatgccaccaggctgcttgtcaactggcctttgctgtgttccacacctctgacatggaggtgaggctgtggtggctaagaccgggcggtgggccgagttcatgttcctgctatgccagtgatagctggacgag

SEQ ID NO: 95958 - DNA, 1788 bp, Homo sapiens
aaattcaaagcttcagaggaaatggtacgaatgcaacccaaatggcaaatttcccatctgattttattttcagtacactctgaacccatcttctgccccttaccctagctcttcctcaggcaaccttgagtttccttctctaaggggaatcttgcaggagtggtctaggactgggaggctgagggggcattggaggagacacctggacaggtgtgcacagaggtggatgtgagaggtggatgaaggacatcccaacagggaacctgctcccaccccctgcaccccccgccacccggctgtgtgtttcccaggcgaggctgtgtttgacatgcagcggccgcacaccgtctttggtatgccgtttggtcccggacttaatgagttctgcagggacgctccactgtagctaaagatcatttacctgaattgctttttaatttctgccgtgggaagctgcccccggtgtgatataattacattataatttacagcaatcccaaatctataaatttagccatacagtggggggaagggactggagttgtgtgtggggctgggggagaaatcccccccatcattaagtaaacccacatttctgggtgcaggttccagtccctgggcaggtgtggaggaggcagagagggacatcactcgcccagtacacgctgaagtgtgctttaacaccacagagcattcgggctggagctgctagtgggagaggatgagagagtgatgtgacattctttctgatctgccctcttatagcatttttgctgtgggatgtggggagcacacagaagtgggtagcctggggacatctatggaatgcctagcattggaaggcagggatcggaatccttccctgattctcttatgggaagatctcccggctgtgggctgtggagaggagagctgggcctcagggtggagtcccggggatgtctctgggcagatggagccactccctgggagcttgtggcatgtgcggaagtgaagccgtgtgggattccgataggcctaggcgaaggcgcagtaccatgcaggccaagggaggggtttcctttctgcacccacaaaagggttcacattcctggtggccctgccattccacgtcactgtgtaatttgccgtattcctgtaaaaccatgcatggaccaaaattattcatattttatgggcataaaggcagttcattaattaatggaattctatggtgaattaactttatttaacaaagaaagaaccaggtttttctgattcgtctgctctggagatctaaacgttcatatcttggggggattccgttgggatgactttgtagcagtgggaggcagtatagcagctaaagcaccagtggaacccaggttcggagaagctaagtcacttaccccacatcacgtagctggtggaggagaaaaagaccctgtgaaggctgttggatggggaaggtaagtagggggatagagagggaggaagagggaggcagcaacaaatttactcgctgtgttgaccttgactgttacgagtttgccccttggccagggggactgtgtggagtggtgctctggcagcagccttcccccttacaggggtgtgggcccccaccctgatacaggtgattgtccctcgccaccccgggaagctgctgatcctcaggcccaccctctgagctttggctcttacgttcacgagcgctggggctcagagatggcagaatggcggctccagagtgtccctccaggtgcttgtcattagccactgccccctgctccatctctggctgtaagc

SEQ ID NO: 95959 - DNA, 1038 bp, Homo sapiens
aaacacaaacatatgactatgttgcccagacccgtggctgtcttctttcaggacagcggagttggcacagccaaacccgagtgtctgctgatatgcttcttgctaagtggtgagcccggcgtctctaagtagtgcctctgcctgtgagcgggtgatgaagagtcagtggggattcatacccatactgtgtgaataggatggctactattaagaaaaacactcagaaaacagaacaggtgctggtgaggatgtggagaagttggcctccttgtgcactgctggtgggaatgtgaaatagtgcagccactttggaagacagtatgggagttccttggaaaatgaaacagaattaccttacaatccagcaattctccttttggatttagactcagaaaagttgaaagtagggtcctgaagagatatttgcacacccatgttcatagcagccttattcacaatagccaaaaagtggaagctacccaagggtccattgatggatgaatgaataaacaaaatgtggtgcgtgatacagagggctgttatgcagccttaaaaaggaaggacattcggacacagcacagatgaaccttgagaacgttatgctaagtgaaataagtcagtcacaaaaggacatatactgttttattccacttatacgcggtccctagagtcgtcagaatcgtagagacagaaagcagagttgtgattgccaggggccggagggaggaaggagtgaggagttcatgttgaatgggtgcagaatttcaatttgggaagatgaaaaagctctggagatggatggtcgtgatggttgcggaacaacgtgaatgtactcaatgcctctgaattgtacacttaaaaggcatggaaatggtacattttatgttttgtatattttcctgcaagtttagaaaatgaaattattgaagagagcctgaggagcaggtctaaacacccatggacttctaaagcttccgtgaaccttgggtcctcctggttcctccaccatcgatgaccagtgtgtcaccccctggttca

SEQ ID NO: 95960 - DNA, 1077 bp, Homo sapiens
ttgttactaaaatggattctctgctgaggccgtgacttccaactccaaaaaaaaaaaaaaaagatcatccacagccactattcctcacaatttctctgaaaggtcctccttgccccaccacgctgaagctaggcccagggctcttggaagaaacacacagcacttgctcctgcacactgacacactctgtcacccaaaatgacatgctgtcactcatactcacacaccacatgctcacagtcacacacgtacgcatgcatgcacacagggacagccacgcacctgcacccatgcacgcactcactgtcacacacaccatcaccacgtgcacacccagcacccacacgcacccttcatacacttatacacacatgcacacattcgcatgcacacgcctgcactcacacagtcacagatacacagggacacagagccccaggggcagtatgcctcagagcatgttagtacttccataaacgatctctttccacatcatttacagagtgggcgcattgtgagtgtcttaagtttctgaccagggttaatgtctttctgaggctgacttagctcaaaggcagtgtcatgattaagatctcaggcccaggagttggacagtgctagggctgagccccagcccagccacttaacagctgtgtgacattcgtcaagtagaaggagttcccccagccttagcttcccatctctaggtggtgataatgaagagttgacctcatagggtacatctgaggaataaaccaaggctgggcctaacagctgtttcccaggaggttctcatctgagttggctgatatcgtcattattatcaccaatccgtaatgctggtgtcccatccgttctccaagtgctgacttggctgtagctgtgggcccgggcctgggagaaggggactgtgtccaccagggtggctgcaggagggcctatgtgggccttgagatcctgcttcctggccaggacccattccttcatggggcaccttccccagttctcagggctgggggcactcagagggaagtgcagggctgagttcatgtaagttctgcaagcaagttctggtcc

SEQ ID NO: 95961 - DNA, 1829 bp, Homo sapiens
tgtaaagtttccttagaagaggtggcttttgagcagaagcgccttgggtgaaaagtgtagcaggcttggaagtcagagtgtgctgctgagtgagtgggagtctggtggaggtggtctttctaaccggccacaagaccctgggcccgctctgcccctccgtctgagtacctgccatcccagggggtgagtgctggctgggctcctggtgcagccacctgcaccgtgcagtgccatcaccgggtcgtgtcttgagcccctccttgccctcctgtttgtttaagtggccttggcctagctccctctgccctctgagggtctcactgtgccctagccctgtgggcatagtgcctggcacatagggggccctcagtctagggcacagggtgagtagaggaggaggttggccctgctggggcagcatgcttgccaagcctgtgtgtgtgtgggtttttgttcatgcttctgctggtgtgtacggagaagtgggcccagacacacacagacatacacggatgcccaccaggccccacgtccatccatgggaagggcagcacatgctggtaatgtgttccccaaacagcagcctcttgggctgcctgagctcagggcagagcagggacggggcctgtttgttggggctccagcagggcaggggagggcagagagtgtgagccctctggagaatgtgcaggtggctgggggagtgcccttcccagaacctcatggctggacctgtgagactccctgcccgtcctggtccccaccatgttccctctgttttctgggtgactctctctgcctcctttctctggttctctctgtccttctctgactttgttgctgtctctctcactgtttctttgtctgtccctctcttctctgtcattctgtttctctcacttggtccctgtcctggatcactctgtgtctctgtgtcttctgtctctgtgtcctggtttcactctgcctccgtatctctctctgtctcttttttttttttttgcctgtttggtctctttgttttcctgtcattctttttccctcatttggtcctcagtttcagctctgcctgtctctctctctgtttctgtcattctctctctctctttctgtcatcctctctctttctgtgtcattctccatgtttgtccttctgttccctttccttgtctgtctctgcacaccaaggttgctcccagctgggaggttggccctgtcccgatgcctggcccttcttctgccaaaggcatcttggaaagacttgaggttattctggtgcattcagtccagcgcttgataattgtactaacctggcaattggcaagtgctcctcccaaagaaaaccctcacagtgcagggtgctctgctgtgggcaccaggcctccctggaggttacagggctcacagtgtggggacaggttgtccaggggcagctggagcatccactgggatgctgatgtcaggccagagggcacctgtgttttcctgggtgacaggccacaagcaggacagctcacacccaggaaaataaaagccaggctcagagtacttgattccttattatggttggggatagtcagtaaaatagtagattccgttttgagagcagtatcagtgctctggggcctgtgaagggagctttgggtgtgctctctggttgtcacacagcccccggtggtgcaggttattgtcccagtctgtaggaagggaggtgcctcctggtctggtggctgggagtgtggctttaaatccagctctgattcttaccaactcacccaactctccaggcctcagtttctgcatttgtctgtgggttgttgtgaggattc

SEQ ID NO: 95962 - DNA, 1048 bp, Homo sapiens
tggcatttggggagggttcctaagggctgtaaccccagaaacattccccctgcagagggcagtctgctccctccctgagctaggtgagggtctgcaatgggtccagaacatgggatctataccaagttctgggaaccagctcaacaggcctgggcctgcctctcacatctctgtgccctggctgtgtgaccctgggcaaggcactgcacctctctgagacctgtttccccatctagagcacccaaagaatcaggctgcctttgcagggctgtcatgagtggaagcctcatcccccaaccttggatgagcagacccctcaaatgtgcagctacccacagagattttgactgtccatggactttggtgttcagacatcacaacagccacctcccaccaccgaggtcagctcctgccacgcttctggtcatcaacaggactgccaagactcctgggctgggagcatcctttagctccccaaacctgctagctggcaggaaacatggaggccatttagggacattcagcatttgaacttaagatttgttttcagtagaacccacaaacccagttttaaaattcagttggaaaccaatccacaagtcttcaaagtcatcttagtgcagttcttaaacttgcaaagtaacacctagtgggtctgtcattggcttgtctggctcagctgaagtcagagctcacagcacactggcctaactctcagtctggcttcaaagtaacctgtgatgctgctgcacagctctgggggtgctcagtcccccgcccccaaccgccacatcatcttgcccagcatcctctgcacaatgtacaaaaatgttttcaaatgcaggttttagcatgattcaggtatggtgaggccagtagagcaggggagagttgccattgaaaagatgatttgttattcacacttcccagtgggaggacaccccacaccatacaggactacttggggaagcatcagggtcagtcagtgaggcatccaggggagagcatgggaaggaggcttcattggtttttgtggaagggctggcaa

SEQ ID NO: 95963 - DNA, 1722 bp, Homo sapiens
tgatgtcattatatcgtttcctttctttcttaggtgtgctttgacattattttcccaattccttgaattgggcacctatgtgattgatttttagccttcctccttttctactcttcttgatataaacatatttctaagttatgcttcagttacatcccgcacattctgaaacatagcaattttattaaatttgaagccttaggatccacgtctttgtacagttttgaaaaatttccaccaaccatctcttcaaattatgcctttccccgcttctgtccattctctcttcctggaactttcttattctgtcttccatgtgtcggcacctggtttttatattacccatgtttctgttatgcattttctaatcctctctcaagctgactttgataatgctctttgtggtatctggtgactcttgtgtgtgtgtctgcatgtctgtgcatgcacgcgtgtgcatgggcactttgtaatttcagataatgagtggagatttatttgaaggaaacctgtgcagcatgagttaaggctatccctccaaagtgcttttctgtgtgactaccaggttcttcaggagtagcacagatgtgagatcaattttgtattcttttgatagcttaggggtcctggaccacatggggactataaatttgaaccatcactcagcgagaaggcaagcatgtggctacaaacactcagaagatactttttcagctcctctgcccgtttcccagcagaggcgtgagaagccaagcatcttggtgtgtccctgtgctggtgggcattgaagggtatccagcctgttactagagatgcagcgatcccatggcctttgcacgtgggggtctcggatcccccttcttgtttctcccagactccaggcctcctgtcctctcactgcatggtcgctaaaaagagatccactgggttactgaggccaacacccactcctgggctgcttagtgtcagctctctgtctggtctttggggtccctttgttatctggccctacgtggcctctttccttgccagctgaaatgtgcatctaaacagatgttcattctgtttattgagctggagggcctttagtttcccttgttgatcgtatggctgaaactcgaagtcgctacgctgttgtttttcctatgcaaaattaaaggtagaaaatgaagttgatggagaaagaaacacacattttgagaaagaactgtgtaattattatccactccctgcaaaagacccatgaagtggtcggttttcagaggaggaaatccttggcgtctgccttattccaaaatccactggctaagtcactcaccacctaagccctcttggacgaggaccaaggcttctacgctccatactaaggcacaatgtgagggattctacagagggcctagtgaagagagaggagagggcccatttcatctcactttgcctggggccatcctgcacgctgctctgctgtgtgatctctgcaggacacttgaccattttgtgaacacatccttatcagtgaactgctatttttgtaatggcagttccccccagacactgaatccacaagcttaaggtaagcttaagtcaagagtgatgacttcttgactattctagtttttctgtcttcattcatttcaacagtatttaccgagggtcttctgtgtgcccagcactgtcctgggcactgtttaaaacattgcttcattgcctctggtatgccag

SEQ ID NO: 95964 - DNA, 1882 bp, Homo sapiens
tcctgagtttccagcgatggaaggaagcggagcaatggctgtttctgggcctgccaccgcctagaacttggattggggggttggtgaacttggattgggggatggattgggggattggattggagcaggctgaatgtcagccctggaaactgccactggcctcccagagtgagctgggagatcctggtgttcagatgttcctgccttggctgcgtggggggcaggggcgggggggcggtggttcctatttggagccagggagttgatttaatacagctgaggccaagacccagcgtggagcctacgactgcagctggatccctgccagccctctttcccagccgcatgtggctccaaatcccagaaagggagaaacccgctgtggggagggggtgcagcagatgtcactgtccccacatggtacttcttgtttatcttttattaaaggcaggcgcttaggcaggggcagtgctcagagcagcccttgtgagcgggccatggtggcggcctccctcagaagctgtgggaagagggagaaggcatgaataatgcaggctgcatcttgacggagcttgtccggcccccgcagaccgcgcagcgcgcacctgagcaagcactttgaatgcctctggcttctgaacttgagaaggaagctcccgggatgggcctgactccgccgcctggttgcaatagtcctggaaggggcggcggagcaagcagaagcctcctgccctggcccgtgggtttgcaccagctagaacgtggggctcctccattaagagctccttggcgttgggagctacgcagcctcacccctcatcttatcacaccaggagaccggcgagcagagtggggatggccacacagggagttcgcagcagggtggtgctctgcctaccgactcgcccctggggttgtccctgtcgcctcagcctttctctttattttgggtggaggcagggtactcaggacagggatgaaaacttaggtctgtttttcattgttcatcctattcttggcaacttttgcagaaggcgctggcaggaaggagaccctggggagggaagagttggaggagaaagaagtctccttggcacctttgcctttcctgctaaaaatggtggcagttctgcatttctactaaaaatagctagtcctctgtcaagaaggccacccacactggggtgtggggactggggacagcaagatgtgggccctgggccacacattctgtggagaggcctagaagctcacagatagtcacttttcttaggaagaaggaaggagtggcaggaaggggctgggatgccatctctggagagcggagcggcactcctgcccctgtgtgacaaggacaggtctgcacactctgtcatgtattactctaagtggctttaatattaaatggatgatgaaggcaaggataaacaaactgtagcttaccatataatggaatagtattcaaccatcaaaaggaaggagattctgacacatgctgcaacatggatgaaccccaaggatatgcgctaagtgaaacaagccagacactagaggacacgtcctcatgattctacttatatgaggcccctagggtagtcaaattcagagagacagaaagtagaatcgcagctgtcagcggctggggaagaggggaatgaggagttaatgtttaatgtgcacagagtttcagtttgggaagatggaaaagttttgaagattcacaacaatgtgaatgtatttgatgccactgaactgtacacttaaaaatggttaaaatggtaagtcttatgttatatatattttaccatcattttaaaaaaattaaatgggtgtcgttgattcctctcttcctctcaacctcccatatagaatgactagaatc

SEQ ID NO: 95965 - DNA, 3337 bp, Homo sapiens
acgcttctgaaaacttctagagaaggggagaacagaacagaacagaacagaacaaaacaaaactaaacagcctaggtcatctacaaacgaaggaggactaaactactacccttccgatcaacagcagtgagtgtgtcaagtcagtgaatttgccctgggaaattagcaatgaaactatcagacaagctctcaggcagatgggaggggacaataaggctatcttcagtcatataggagggactcaaagcatttaccttctgtatatctttggcctttacttaaggattctctcttacagcgtaagggagtaagtgaatgcagggaagacctgaggtcccaggagggagacccccaagaagggaatgatagcaaggccggggctgtgcagctgccccctctctacagtcagagcagaggcttgagggattccaggggagggactccagaagagggctgcagccctggtgcctttggaggatcgggagctgctgtcatcactgtgcgagaggcaggggttggccttatacaccattctgtgtgtggtgggggaggtccaagtgaattgagttgtcctctgtataaataaccaataaatcagaaacattaagctcataggattaaagaatcaaaacgtggtattttaataccttccttatatagatcagatagctgccagaggaattaagagcaggaacattttttcaaagttaaaagtggttgcctccagggcacagggaggggactattgcctttcattataagccctttggtgctatttgttctttaaaaaatcatacgcagatcttttctcagccttttggctaagatcaagtgtaaaaatcatatgcaggattgcttagatttttttaaaaaaagaaaaagaatcatgaaaattaaaatgaaagaacttgcatgggccccagtttgtaacaagaactcattgggggtggactcagggcagcatggaacaggcctctcagtggtgttcctgggaccatgggctgggccaccttaagggaggtcatgatggctaggctgggctgggactggagtgacctctcaagtgaggagttttcagttctatgttgctctgtttggatttacttttttggaaatacacaaaaatgcagcccgtgggcccccagggccaggggactggaggtggcccctgctcttgttgcctgcaggttgtggttgggcttgtctgacatgcagcatgaccaggaaggctttgtcaaggctgctgtgtgcctggggtcattagatcctgggatgactgcctgtgacttaggcctggtccctgcccttggggcctggctggtactgaactggagtctggtgtagctccaggcagactgaaaggccccaccagggaggtcttcacactgtccccgaacacagaggaggcagtgagtgccagccgggcatcaggcagtgggcttgggctaaaccagtgcagtccccacctccctggcactcctgttcctgtgaggaagaatagacaatcaacaagtcaacacacaggtgaaacactttgagggagaggtgctatgaagaaaatagagtgggcatgagagggtaactgggagatgccccccactgggtactggggaaggcctttcccaggaggtcccatttgagaactgaaagcttagatagcgtgagccttaggaagcaggtttgcagagaatacaagcagtgccatctggtaggaggggcagcattgccacgtcttggagaaatacaccagtcaattgaggagtgagctgagactggaaaggcaggccagaggtgggacaaggagcctgactccacactaagggcgagaagtcccaggcccagagtgagtggggaaggccctaagggagttgtaggattagaacccagatggcattcgcctgtgtggagggtgaacctgagcttggagtctttcaggagttggagagaggaggaggacaggttggagcacatggagtcatccctaccctgcccaggcctatggatcgcacagagacggatgggcagagagtcgttccccatgcagcggggctcctcctgagctccattttcgggccagctctgtgctgggcttgggtggggccactgcaggccaaaggaggtgctgaaacacatagcactcctgcctacccccaccaggggtgccagggggacagctggctttccgacaggacccccagatgatatgtcgtgtccgtgccaatgaagtcgaggcaggactgagggacgagtgtgtttctgagggatggcatccaggaccagtgccagcattccagaggcagggccgcctgtaaacacagacaggggaggtagctgtttatgtggttggtttgaggaaggcttctctgcccacagatacctctcctgcctccccagcccactttgggatcaagcctagaattccaccattataggttcattcctttggcttgcaatacaaacatcccagtgaggaggtgatccctgagctgtcactggtactgagcaccccgtatgccttggtaggtcatcaggacctttgccattcaacaggacagccagccagcactcgctgtgcccagtgtgtggccactgtgatggttctgggtgtgtgaagagggtcaggtgctgtccacccactctgggggagacagacgcaggaagggataatgagtaatgaattctgtgagagagtggccaggaacagaggagcacagagaagacagcaatgtgcatccttgggcaaatcgaaaatcccaaatcccctaccctctctggccctcgacatgatcgctcaggagacagtagacgacactgtctctgcaaggcgagtgaaggccagcaaggtgctggccctcagagggtctttggcaaaggctttctgcgggggctggaggggggtaggtctaggttcagctgaggctgaaaggagggccaggagaccttcaaagggacagagaaggtgcaggcagaccaggacgaggaggttggcacaaaggtgtgaggcatggggctgccaagagcagtttgatccaggacagaagctggagatttgagttcagagaatgacacctcaggtcactagggactgggcctggggagagaggaggtgtcgtggaagagaaattctgtgacatggttccaccattggttctggggagaagattctcctgcagctcagaggggtctcccttgagaaaggccctgggcctgtctagcaggagcagcaggcctgccagtctgcaagggctggcatgggattgcaatgctgagctttctggctgtttggatctgttgtttttctaagtcactagtcccttgcatattaagagaaagaaga

SEQ ID NO: 95966 - DNA, 3708 bp, Homo sapiens
agcacagcaaatgagcagaggaaaacagaacccaccagacatgcaaactcacagaaataaacaatttgccgatgatcagggaagaggctacaggaaggagtttgtgcagacagctcctatgagaaaatggtccctgggaggtcccagagggctttccggctgcacgctgaccctggaggcagctgtcagctgtggcaccatggttgttctcgtgcttggagctgtcttcaaagccagtgagcgagccactcaagaaacttggttggtcaggtggcttcacagatgtactctgctttttacccaaacagtctgcacagtgcattgtccatcagcatgtgtacccagggagcactgtgaattcagggccctgtgtctccagtactcagcatggttacagaatgggtgaaggtgcagtgaagtgacaccctcttcccatcactaaggatattcacaaggtttaaaaacagttcccaaagcaggattcccaaagacgctctccagagaaaccgtggagccccccaggggaattgagatgatgaaactactgcgagctcacttttcttagggttccaggcactgcttggttttccatgcactggattatttaatcctccaacagccctggtaacagtcccataatcctcactggacagtgggggaaatggagaccacagaggtgatgtgatgggcctgaggtcccacagctggtaaggggtggagcagccttccagccctggctctctgaccctgggcctctgctctgagcctctgtgctgggcctcctctccactcaggaaggcacacatatgttctattaggttcattaaggaaaatcagttaccctatttaaaacaccagcaggcaccatttgtgcagcgcctacttggatctggggacctggattatctcgtgccatcttgataaaagcaaggtcactgtgcttgtccccagtttacaaaggggtcatttgaggctcagggagggaggtgacttgagcagggctgtacaactggaactgatccctgggctgctgactcctcagcctgagttctccctgctgtccatcccgcacttattttccaacacctcaggctgagaagctgcctgttctgcctgcctggcttctctcatgatgccagccaggagggagtgagggcagggggtgcccacctctagcagctcaggcaggttctaatgtgggcattggcagcgccttctgggatcagagctgctgtgccactcaccttgccaccctttgttgcaccttctagctccttcctgtggggctccaggttgggaatcaggcctcccatttatggcaggtttgggccgactgtgcccgggccaggaagcaggacggctcctaggtagagatttggatggggttctcaccatcatgggcctcgttttaaagtggacctgcccaccgccccgatctccactgcctgtagactttgcagtgtccggacctggctttgacctgggaccagccactgtgtaagggagctggctcagctgcctacagaacactctcatggcaccggaacctccagggccccctaatctccagggactgcagtcccgagccctctgtcattctacttgcctgaccactgccctcccatggctctgcagaccagcgctttcctgggctgctctgttggctgtcccactgcattcctcaggggcgtctgaagaagcctcgtgtggctggaatggggataaaatccagacggaaaggcctctgatgaggacttgggcctttggtgtgcctggctcacttcaggcctggagggagtagccctctctgggttgaactgggcccagaggccctctgatttatatcaaggtgggagctgcctgggcaggcagaaataataaaggtgtgggccggggcttatggaagatggggtggagggaaagctgggcagaaaagctcatccttccatgccttttggccatgctagcctaaagaccaggggaaggcttagagcttagtgatgcacccaagacgtgcagggctgtggatcttaacctctgaagccactgcccactctgtgggcagctgcacatcacaaagatctaaactgaaatggctatggaggaaagaggagtgaggtggggaggagggtagtgacagagagatgacaggaggaaatatcctgactagagagcttccatccattcaaccacccacctacccatctgcccatccacttacccatttgcccacccacctacccatctgcccacccacctacctatctgcccactcacctacctacccatctgcccacccacccacccacctacccatctgcccacccacccacccacctacctacccatctgctcacccacccacctacctacccatcttcccacccagccacccacctacccatctgcccgcccacccaccgacccacccacctacctacccatctgcccacccactcacccacctatccatccatccacccacccattaactgatccacctcacccaaacacccacctactcatcaacccatccatcctacccaaacacctatccattcatccacccaccaggccaccccgctatccaatgcatttttcatcaatcacctgctatattccagcattttcatccaggtcccacctcagtgtagcccacaggggatcaacccccccacccccacccccaccaccagtttctgatctctttttgcacgcacagcctgatggtggccctgggcccttgtaaaccctccttcccattttctgatactctgcttgtttctcctcgtggcccactgagatagtaagctccttcactcagagttgcggttgcttctaattccctcgcacctttcttagagctctccttggaggagttgctcagagcatcttttgtgggtcgatggaaaggttactgggaaacttcagttgtttgagactgggatcacctggcctctgtgtagggtggtcgaggtgagaagggagctcacgttaggtgaacacctgctgagtgctcagggggcgggggagaatgacagcttggtgctggggaaagaacccatgtttggagctggcaggggtgggattggttcccggagttgatgccagctgtgtggctttcaacaagtcacttaagctttccgagtctcagtgtttttatttgtcaagaaacaaaatataaacaaacctgaacaattaaatgcacatgtaagtactccttgtggtacttggcatgtggctagtgggtgatggtctctccccatgcccccgccatgtccatagatttgaagactgatcaaggctactttgttgagttaaaatgggcatagatgaagcttggctctgggtcagggccaagctagtgaacaacaatgggcagcctctgatgtttctggcctctcgcctccacccttgtcctgtctcatcctcttggccaccggcctgctagtcccctgggcaggatgggggaagagacaagctgctgagttgctggagggcaggatggcttggattcagcctgctgccttgctgtggaccctgtggctcaggccctctgtgcagcccagtggccggaggctggttatccataagcaggaaatggtggaggtgagctgagcatgagatgatgtcaggagatgtggggcaggaggctgggctctggggagggcctgcagtgctggggggcacaggcatttaatcaactga

SEQ ID NO: 95967 - DNA, 1177 bp, Homo sapiens
agcaatacagccaaagtggaaggctggccccggctcagagcggggctcctcccgcctaagaggacagcctgctcagacctccagctaatagggctggtggcaaattgtactttgtgttcattggtagcatgagattgtagctcgtatctctttccctccctggctccccagtcggagggagcttccagaggcagtggagcagctggggatcagctctgccccttgccagctgcaaaaactcaagtcttgggttttcatccatgttaacaacatctgcttcataggcctgcaaggtgaccagagcgcctggaaggggctattgctgtggttgagccattggaggacttggcttagacaactcacaacttggacttagtcaagaccaatgagaggacaacatgcctactgatggattaacaggagtttctgggagaccctggaagcatgaagcccacaagttccctaaagaggagcaattgcaggcatttctccggcagccgaccactgcccctcaggacccttgcatgccttggctccggccagtgcccgtgttgcccctggtcaagggctgcctgacccagtcagtgcttgcctcttcctgaccgcggtctccaccccacacctgtgattgcacaaccccagggctgtagaatccaccacgggccgtctctcctgctatgatgagagcctgccttgcttcaagcactaggactccacgtgaagaacacacagttctttattctgttttaatcagatgcttaatgattttcagtctacttaattactagtattgtattttttaaatagaggttttaactgcatctatgtagtatcttagccacaatgtggattatctgggcatttgtgggctaacatggaaagctactcatattatgttacattattttttatgggaaaatgcatttaagttccaaatcattgatttataatatgtcgacctttgagaacacagctcatttgtaagtgggaatagcctgtattcagaacaacataaagggtctgatatgtcctgggaacagcacagataagctgagtcacaggagggcgaggccgaggcagcccttccaggaagccttttgcttggaggaggagttgatggggctgaggcgtcaatgtgaacaggagagagggtggcgtctgctgtgtctgctgtgtc

SEQ ID NO: 95968 - DNA, 1099 bp, Homo sapiens
tggggtgacaaagagtgatgacgacaatagcaatgacccctccccaccccattatgtctcctgccatcccccacccccattagcagaaaatgcagcatccttgcacatggcacctggcagacagggcgggtggtgagtggctgagtggaatcagcagtccgggcagccctcaccagcgggtccgtgagctttggaggtgctgaggttccagtcttctgtttgattggaactccgtgtcccaaagtacttttcacgtgcccactccctgcggaagggaaaagagggtgggtgtgattttccacagcttgattcgaaagactgaaactcgatgagtgacatttcaggctggctggggatgtgggttcagatccccccatgacccctgtgtgtgaggagccaccttcacctgcactgcccgcagggactccacttccaggctctgcagctctcagtgccctcagggaactgcagggagccggctcagaaggtgcacagtggcctgggggccagtcatgtctttcacagccttgtgcgccttggacaagtctccctcccttcccgggcctcaatttccccttcttacccagtgggctgcctagtccacatggcccctaagatcccacccagcttcctcttcctcttggggccacagagtcaggagttggaggcagcatgacccccaagttccagaccctggagggcagccgctgcccctggaaggcatgccgacgtcagcttctcccgggaggcggaattcatgcgggccctagtctgagaaaggcacccgcagggtggacagcatgctgcccgccagcagtgtggctggatccccgagtccagccagcctttccgttagccagccagccagcgagcgctcctaaaccctggccgccgccggttataaatgattcatgcagccccgcctccctcggcggccacttgatgttccctgcgctccagcccggcggtccaccgcctctcctgccgctgggcagtgccgccgctgggcagtgccctccccgcaccgccgcccctctgggtgctgcgtccctccgccctccccgcacgctgggtaagttgaaggaggacggcagctttt

SEQ ID NO: 95969 - DNA, 2080 bp, Homo sapiens
ccatttctgggcctggaattcctgagagtggcctggccccagtggggacagggaggggagagaagcaacctggggcacacttccctagccagtcctatgtttgtgagacctgggagggctgtggtcagggggctgggccctgggggcaacagtgcctttgcatttgaacacaaagtgccacttggtataatgggcacagctcagtcttggctgttcttgagttttaaacaaatcatgatccccaccttccaaacaatttagtttttttcccctagctagccccatcacaaacttttgaagcatgaaatgaattttgctggccctcaccaataggatcctttccctagataatggattttatgaaatggccataatcctcctaggtaatgagcaaaagctacactctccacttgggtccagcattcctcttcctgatttatgatagattggttaaaatagtaaactgatagcagttgcaaaatagtcatcaatcaccaggcagtgtcgcttaaactacagaaaggtttccagaagtgagatgctggaagccagagagagaacaatttggcaataccaaaggcataaagcaccaatgaaatcaaatctctgtatttgtattctgaagacagaggagtagagtggctcagggtactaaggaaggaaggaaatgcaagcaaacccgttccccaaggtcaaaggacaccccctcctgagctccaggctgcagggggccctgcagggggaccttcagtccagggagttcttcagggggactgtccagagggctctgcagggtgctgcagagctctcaccagtaggtttagtgttctgtttctctttctagacagttttggaaagttttccaatttctaacatgtataaatatgttgggctaatatacagtaatggcttttaaagcaaagtttttcaaaagtataagaggattgaagtgcaaagctatcaaggccatgcccaggtctcacccgtgctccctcacccccttgccccttcgtccagacacctggcctgccacacccagcccaggacagaacttttctttcctcctgtacgctgagctgtcagaccatgagtgttcatcatgggctgaggtgatagttgatgctggagaaactaatgttttagggaccaaaacaaggtctgcagcagtgtttccatggaactgccttagtctggatgagtaacctcatggctgtagattacttgcatcatcagttcaggagaaaacattctcctccattggatgaatagatgaatgagtggtgagaagctgtagagatcttgtgtggtgtcaacgccctcatttcacaggggaggaaactgagtcccgagagagggcagcgacttggttcaggtctcagggaattggtgaaagagattggagtatggcctcagcggaggtgtgactgccagtgacacctgccggaatgtgaacttcacggatagcgctggctcacacctgtgttgcttagtgtaggctgctgagctgaccacttgcccttgattatttcaagtgaccgcgccatgtgccaccttcagacctgctcccagatcgatcccagagcctagggtgggactgtggttgctgtcatcataggtgtgtgattttccacaggtcatataaccctcttgagcctcatcttcctcttctgtgatatgagagactcttcctgcagaacctggcgtgtaatacatgcaacctgcatgcccaccttcagtccagcaagcagccatcaggcaccaattctagaccgagtcctgggccgccacagaaactcaaagttagataggagctgggtgggaaggcaaggaacactcaggattttgaacacagctgtcaacccctattccttaattgagaaaggcaaatcctgggacttgaataaggagattgggaagactcatggctgcactagtgcatgaaatattatggtaaaagcaggagaataaggcagtccttttcttagccctgttcttctccaggccagagcctgggctttaacactgactcaggcagcagcccctgcagaagctacctgcagccaggttggcctgtgctccc

SEQ ID NO: 95970 - DNA, 1601 bp, Homo sapiens
ccctggttgtccatcattatgacacatgattttccaaaggatttactattagttagcagcacagggctttctccctggggtagcagctacttgcagtgaagaaaatgcatgttcaatgtagcaatttgtctttttttatatatttattataagagtaaatgagttattgttggagacttcaatattattgcaaattaggtgctgcaaacagagccgggcccatttattatgtttctcaactcccacagcaagcctaccagttcagaaatcagctgagagttgtggcccttcccagggtgagcatggagggacccccggggtctgggcatgacaaccacgacgtcacattgtgccagaggcaaaagaaacaggagccacctgtgcaggcgggtgaggggccctggaagggagcacaaagtttgttgtgccaggtggtcagtggctggtgggctgacagctgtggtcagagagctgtaggaggtggagtgacctcacgctgtgacacttgctccaagcccatagctgtggtcatggagcagaggtgaggtggtagatgtttccagagtggcccctaagccatgaactcactttcaaggtattggcagtttaggccacagagactggacccaggttctgatttagggtgtgccccgtgacagagagtggtggctggaattaaccagcttacagtggggtcccctggaatggtgcactccccagtgaggagtggctgctgcctagtcctgtcctttcgccacctgcccagactaggggtggacacaggggctgcaggatgcatagaatgttagggtcctgcctaccagagatgaaggtcatactgcaaagtgggcatgctggctgtgtgtggtcaacaccaagaagtgggcaggctgaggccctggcatacagccctgctccatggctggaagagtccacagggaaggccacctagcccagtgatcaggagcacaggcttctggtgacaagccagcccagattggagtccaggtgtcgtcacctgctggttgtgtgattgcggacaagatgctcaactttgctgtaacctcagtgtctcttctgtaaaatggggctgataatccataggtattattggcgttaaatgagctcttgtgcttgaaacactcagcatagtactagcccatggtaagggctcagatatgtcacttgttcaattactattcagtaggcttctctgaacgtgacaggctaaactcgaaacattaattagtcacttcatttgatggcaatagtaataaatgtgagtgacagacacgaaagaggctaccctcagtgtaccacccagggagagccagagttaagattttggaatatatgcttgcagtcttctgtgttgtatatagtgtgtgcacaattattcacacacacatacctgcctgctttttacaaaatgggattatattgtgcttgctacctcgtaacctttccacctgagaatggatactgtcattactgatgcctttccgttcaagtttttctgcagttgcagtctcaaactttttggtctcaggacccctttataccctcaaaaattattggtagcttcaaagagcttttgtttt

SEQ ID NO: 95971 - DNA, 1400 bp, Homo sapiens
acttctgagagcatagcttggttttgcttgcttttgttctttatgtcaatggaattatgcagtgtgtgcacttttctatctggttgctttcttatgtttaggggattcattcgtgttattacctgtagtcgtggtttgctcttcttattgttgaataatattttttcctgttattgtggatatagcacaatataccaacgttttctgatgttgatgggcatttgggttgtttccaatttggggctattctgtgctgcttatgaacatccttgtacggtctcgatgaatgtctatgtgcatttttcccaggtatatacctaggaatggaactgctgggttatagggggcacatgtggtcagctctgataaatactgccagctgtccaaagtggttgtaccaattgccttagttttgatactggaatttgctattaaaagatttattttctcgaacattcttttatattaacatctaggaaaaactgttgagatcaatatggatacattaaagtgttgactgagcctgggtccctgatgagaaactgaagaattgtgaacttcagaaaaatagacctgggggaatattctgtgattcactgactccctcacttacctatttgttcttccttcagccacagatattcattatgtgtatcctccctcccaggggcagagcaaggaagtcaagacaatcttttctccttacgataccaccgtcaaatgtattagttatttcttcttgccaataatggctctaactgaggaagcccatctctttatacaaaaaattaggtccaggaagagctgcctaagcagaatcatggttgcagtaaagtcactttatggtgtttaaagacttggctgaataaaggggaaagtttaaataaattagtgtctagctatggactgagacagtatgaatccactgaaatatttatgaagaatcttaatgacatagtacaatattaaaaggaaaaaaaggatacagaattacatacacagtataaaagttatttttttaaactcatatcctgtcacaaaaagaaaaaacacacttggtctcatttttctggttttaaaaatctttcggccaggcacggtggctcacgcctgtaatctcagcactttgggaggccaaggcaggcggatcacaggtcaggagatcgagaccatcctggctaacacagtgaaaccccgtctctactaaaaatacaaaaaattagccgggcgtggtggtgcgtgcctgtaatcccagctactcaggaagtcaggagaatcgcttgaacccaggaggcagaggttgcagtgaaccgagatcacaccactgcactccagcctgggtgacagagcgagactccatcttaaaaaaaaaaaaaaatctttcttctggctgcagtcct

SEQ ID NO: 95972 - DNA, 1006 bp, Homo sapiens
aagctctggtgtgtgcaggtatttgtagagcatttgctacgctgacccgttaagtccctacagcagtctcatgagggtagttattattgtaatcctgtttaacagatgaggaaaccgaggctcagagaagtgtaatcattcactgtggtcacatagctcagatctgaacccacttctgtcatcctcactattctgtgtggttgtttggctgagtcttggatgagggatacttgcaatgataggtagcctctggcccctggtggtgggggtagggagtgggagagtcggagaggtagaagaaagccgctagatccaggcctctagcccctatctctacgggggactcccttccaaggaaaattgtctgtgctccagacccccgcagcagatgagtgtgtggaggcctgattttggagagtggggatttgcacccttccgcaggccacccctgtgttcctgctcatacttttgcatagccaccacctgaagttagggcagccccagccctgggggagactttaggggccaggggcagctcagtgctgggctcacaaccacagaacaccagctttcctggcctaggtcacactttgccaggccacaccatgaaggggagagagcgcccatccttggggagcaggatccagggtctgtgagacccaggcgtgggctgcagggagagtgaggtcgtccgcacggatggtggagtggacagaggccagcagaggctgcgcgcccatgtgcgggccaaggggagagcgtaggtaaaggacagtattgcagtcttgggaccaagtgccactaaaccttatgggtaatgggtttttcatcccctgggtaataggagacaccaaaaaatgaggacattacttagtgagtccctcacctccctggccccattcagcagactcggaggaaggacattgcccagcattgagccgtgtgtggatttaatggggtttccagctaaaccttccatcaaatttacggctgtgcctgtctcctg

SEQ ID NO: 95973 - DNA, 1026 bp, Homo sapiens
acttaacaaatgtctatggcagaactggtgtgtaaataccccagctccctcacccctcagctgggtctactctggttctcagaagttctgtgtggagctcagctgcccttgcccagagtggtagggggtgtgccattgtccctgattcaccaccttcggtgtctcttcctgatgtcctcagctgccctgtcatctccaaaataaaccacttgcactcacatccttgtctcaggttctgcccctaagagacccaaacccaatggggttgttgccacttttctgatagatgctgtggatttgaagtcaggaaggatagaccaccgctaacccgaggagtgaccgccagtgtgaaatgtgggccatgacccctgcctggcagagctcctgcccccagcgtgcatagttatgagttatttgactaaggcatcttgccacagccttctcaaatatctcagcagctcagcctgtcctctgtagtttgggaggaaggctgaatggccaggaatagctggggcttctatttcttgtttcctattttagtttttgtccttgttgttggatgacgtggagggagaagggtgggctcaaggtgaataaccaagcccagcccctgaagggagagttcttttcaaaccctggtggcccctgcccgccccccagcctcccctcccccacctggggtatgtgtgtggctctggcacaattaagattcttgctgggtgcccccagcccccgctggccctgctgctgagcagcctgtcttgaaggatcttctgagaacggactccttttctgggagcgtttataagagatttctcatggctcagttcccctatagaaaaccaggaattgtaagtcttacatagctcaagaaagaaagtgaagggagtgagtcagagccggccaagaatgagtgaacagggttggtggcagtgtctcgggaggaattaccaaaaaagaaatgaaaggaaaaaagaagaaagaaaaaaaaaaaggaaaaagaaaagcaaaaccaagttcccccca

SEQ ID NO: 95974 - DNA, 1027 bp, Homo sapiens
atgggttttgcagatcagtgtaatatagaagcaaacacttgaggatgggagggagagcacgtttctcactttaggggtttgcttccaggacttccttttttggaagtatgttctttttctctctcatacacacttgtgtgtacacacacatacacacacacacacacacacacatacacacatgcacacacattccaccccacagcctgttcctcaggctgcagcttccccaaggaaggcgagtgccccgagcctgctcctagctgagcctgcgcaaggccatcagccagtcttgtctgggtcgaaaaggtctcgttggctgtgtgatgcaacttgcagtgaactgagggtgactgtgggcgtcacagcagcgtctcagaaggccctgttcagccctgtctgggacctgtatataacggaactcagtctcacctctgcagaataggaatggcggtgcccatcttcctctttcttgtggctactctgagggttaagtgaagtcatcgatgaaaatacgctttagaaatgaggtttgtacagcgagtgtaaaggcaggctgtttttctaactggtgtccaagccaggtgtggacctgcagtaaaatgcaaatgaccctgttatgtggacaggggccattgtgacagtgagctttgttaggattgctgcatcacccacaagcctgttactgctgagccccaactccagcttctgattccaagggcctgggaaggtgcggaggatttgcgtctctagcaggctcccaggacatgcagaggctgccggccgggggccacactgggaactgctggggaaagtttgctttactttgagttctgaggcaggcaaggcagaagaggcagaatctcctgggggtgggagggtggttacaaaatgaggccccagcttgtttgcagcccccattgcctcttgaatggtggatatcctggctgccttgctcttttcccttccggctctttcttgttccttctttaacagaatatatcccttaaaccagtgcttcccaaac

SEQ ID NO: 95975 - DNA, 1065 bp, Homo sapiens
tgagaactcgctgccttggtttcccttctgcaccctagcgatgttaacccttggccctatgagggttctgtggaagaaacaagatgaggggacaacacccagttccttttaggctctagataaacattatttgctgtcttcttctgtcttttactttcacagcccctgggtaaaatagacaagggatgtgcgtggagacggacattgtatccaaaaatcggaggtcagtgatgttgagcggtttgctcaggatggtagaggcggctctggaggtggccccacatctgctgacttccatgttcaggttcagagttgtgggttcagatttcagaatgcggatccatcagagaatctgtctggtcactcactttcctttgcacttttcaagaatttgatcctttttctttttaagagggagaacagagccctcttggctggcaggtgtaaatcttcactttggggtttgtttgtaccagggtatgttctttctcacacacccacatacttaccctcgcccccacttgcataggtaaacagcttttaaatgtgtattttctttcaaaataaagccacttaagctttaccaaaatgcactgctgacatggaattcacatttggcaaacccctgccatccgtgttttactgagtgcagactattgtaaattaagggaagtcactgtgtgtgtgtttttttcttccagactgttatggaagcagagctggtcctaagtaaaagataaattatggcgggatctaaagaggcatcatttaaaaagtgtcaggatacaattgggttcttaaaaaccatgcagagctgctaaattcacatgaaaattgagtggagctggattgcctggggtgacagcgtccttggcattgatttatcccatctgtttggccggcccatatgacttgaggcctctggtggagaggcggcttccgctgggccggtgctgctccgtggcctctgcaggtcttcctggccccagcccccagccaggccactggggagcatgaacaggtccaggggtcttcatagaccactaggagaaagacaccaatgaa

SEQ ID NO: 95976 - DNA, 1022 bp, Homo sapiens
gagtgtgcaaaataaggagggaagggggaatgaaggctggaggtatggtgtgctcatgggggtgtcaggaggcactcattccttgttgtagatgatggccaaaataaaaattccagctggtgctgtgaacctgaactttgacattagccagagccctccagaggctgtgctgcccctcgccgggtccctcctgggtgatggccatgatagcaggatgctgtgcacctcctgttcctggcatctggttcctattttattagaggttggagttcaccctcagcaatctacagcatgcatgcatttcaaaggaaatgcttaattagtccccaagcctgggcttctttaggctcccaaggagaaatgaattttgttgccttgatggattggggaggacaggtggagctctcaagtatgtttgtaagttgcagaagttgttcatttggagactgtgggtgtaataaatggtatgagctgaggcaggagagggaagtgagactcaagtgatgaatggcagagggggcatttattgaagccagttctccatggcaggatttggggccagacaacatgggggaataaactttttttaatgcaattcagggccgggcgcagtgggtcattcctgtaatcccaacactttgggaggctgaggcaggtggattacttgaggtcaggagttcgagaccagcctggacaacatggtgaaacacgatctctagtaaaaatacaaaaattagccgggcacagtggcaggcacttagaagaattgcttgaacccaggaggcgaaggttgcagtgagctgagatcacgccactacactcaggcttgggcgacagagtgagactccatctcaaaaaaaaaaaattgcaattcagacagtttctttaaacagtccaccagcctcttgattgtgggttctgggtgctagtgaccctccccctgagagcccccaggcaggcctgggcctcactgagagagacaaagtcccactgtcagttctgactgactgtccccaggaccc

SEQ ID NO: 95977 - DNA, 1074 bp, Homo sapiens
aggacagggtctgtgtgaacatgtgtgagccatggagcggcctgccaagggaagtggcactgtgactgaggaaggacccaccttcccaggaggagggacccacctttccaggaggaggcgcagctgttctcaacgccccctgcccgatggaatccactggggagctttttaaaacgctggtgccctggagccaccccagagagtctgcttctgtactgggctgggttttggcctctcttgattccctggtgtttctcctatgcctccagagcctgcgatctaccaaagttggaaaataaaggaggtgaggtgggggtggatgatgtctctcccaactctattggcccctgtgcttcggcctctggcccagcagagagaagggagggagtttggctggtgtggggcagggaggcaggaaggacagagcgcctgagctgcaggctttccctcagccattaaagtttatcgttgccacggacagtgattgaaaaaggctttttgcaggactgaaatgtgagcaatgaaacttgccagttggtaccgacacagggcacttatctcataaaaatatcctccagtgtcaaaaggtttcagtaaatgtggctggaagtattagcagtcatttctggcagcctcaggctcccttggggcctgcagtgaggggctgtaaaagggggctctcagttcctgcaaagaagaagggagggagggagagaaggaggaggggaggggaagcccaaactcagcctactgctgtggggaaagtgctggaacctctacggggcgccccacagcatcagtgggggtgcctgtccctgtgcatactccagctgctgacttggagggtgggagaactgcctaccagaggggccagcgtgccgacttccagccagccagggagtgaggttatgggtatgtgatcctgcttctgctgacctgcaaggaggaaatggagactcagagaggttgggtgatctgcccaaggtcacccagctgttaagtggcaatgtcaggattaggaagctaaagccctcctcctttccagacgctcagagcctgggatgagttctctgt

SEQ ID NO: 95978 - DNA, 1049 bp, Homo sapiens
ctgagtgcttcccaccggactgctgggcatgggaaagcaatcttactatcaggaacgatgcagctgtgatgggtgctgccctcaagggggagccaattgatcctttttcaccacctggtgaaagcccccagcagggggctagactgtcctcaggagccctggtgtggacagcacaggatggcctcatgcccacatggggccctattataggtcattaaacctgcccttggcactgtggggtcagcaggactggttgatagtggggactcttatagcagaggagccatggcctggggggcctgtcacccaggggtgacccttcatgccctggtttggtggtctgtgcactcagccgtgcttggctttggcctgagtggggctggccattggggaaggtgcccaagactgtccagagcgtggcatggacatgggtttcagggtgactcatttgtgcacacttgggtagaacaagagaagtggcatcctcgcctcccctctggtgggcagctgcatggggacccctttcccaagccccttgcatatggaggccccctcttctgagcactggatctgcttcccgtgcagactcatgctctagagtcatccactgtgggtccctctcagcacctgaaaagggaaaagaagcctgggtcctgggctgagaactatgaggcagggccctgcagccatctgtgatgtgggagaaggcagtttccccttcctaggagggaagacaccccctgccccccaacagacctggccactgcttgggccccctggctccagcccctcccaccgatgggccacacatagcatgtgctctgaagctgaagctgtggtttaggggaaaccaatgttatgggaacagctcccagctctagcttgtgtcactccagcctggaggcagattcagggtgggtggtttggtttgggaatcttattttgcccagaaaggaaggggggagccagccactaaggagagtgctgaatggctgatggctggaggacagactgtctacaggagtcagatgcaggctgagaaggcttca

SEQ ID NO: 95979 - DNA, 1013 bp, Homo sapiens
gtggtggctcacacctgtaatcccagcactttgggaggccgaggcaggcagatcacgaggtcaggagattgagaccatcctggctaacacggtgaaaccctgtctctactaaaaatacaaaaaattagccgggagtggtggtgggcgcctgtggtcccagctactcgggaggctgaggcaggagaatggcatgaacccgggaggcggagcttgcagtgagctgagatcacgccactgcactccggcctgggcgacagagtgagactccgtctcaaaataaaataaaataaaattttaaaatccactttacaggtggggaccccacaaccctggggacagcagacccttcgtaggccttcctacagatttattccataagggaccgatgactgaagccatagctacagctcctccgtgtaggcccagctgggggtggagtgagcctccgtccagccatagctggggctgtgggtcccatttccctctgggtcccctccgttttcctgtgctgtggtttcctccttttagctgtcatgtcccaaccttgatccccctggggcatctggtccacccctgcccatgaggcctatgtccatcccacaacttataatgctaacaagccgtttggggcctcccggtggtcagcaggcctgagccaggggtgacagcagggccctcagccacctggtcccttggcacggtctgtcagggcttcttgcctaatcaagggatgcattttaatttatgcaaatgggggagggatggtggcagggagtcacagacatccatcaccccatttcctagcagcagtcattcatcagtggggccttaaagataatacactttttgtttcaggcaattacttaatcttgacaaactcctgtgttaagcagggctattagcggggtccatcattaatcagcgcagaaccaagtgggtgctttttctgaactgcaatcactcttggggacccggggtgggccctttgccatcctcgccgccctaattacaca

SEQ ID NO: 95980 - DNA, 1048 bp, Homo sapiens
tgacttcgctgggtacctgggcagcacttagatgccgctgcatggcagacccattctgttttaaggggttacatttccttttggaaagaccacgaatgaagtgaaaataccaaggctggccttgtgtttcctggagtttgttggtgctccacctccttaccagggcctgggtcacagagtactgctccctcctccatcacacacctgtgacccttattacaccaatgcctggcccaggctgccctgagggggagtgggcacccaggagaacaggggatgagtcgggcaaagactgggacctgggccttcccccggcctcatttcttcttcctggtccaagaagagctcataccgccctaccctaccccacccatgtctggaatttcagagaaatgggcatgaggtctggctgtgacacagattagccatttgactgaaccagggcaagttactgaacgctcctgtgcctcagtttcctcatctctaaagtggagataatagtaacaataccttcatcaattgctatgaggatgaaatgagttaacaaatgcaacatgctcaggaaggctccagtgtgaaggaagccctgtgcactggctgttagaaccactgcggtttccagtctccaaggaagggccagtgcgtggctgactcctagaaactgctctgtctcctactgcggccccgagcagcatggctttctctcctcggtcctaaattaatttagactgacagtcggtagctactggccacccttgttatcctcgggttctgttttccaatagtgggaggattcactcattcatgtattcattcattcactcactgggcacatactcctcacctcctccatgccactcgctgggctggtcgttgactcagaggaaatggtgtggagggagtatcgtctgcctgcggtggaggggggtggcagaagaaaggtccaggaagcttcctggaggcaggctcgtgtggactggggttgctgagggcaggctgagttggcatgatgaggatgagggggtgtggtggggaggggctttctagg

SEQ ID NO: 95981 - DNA, 1045 bp, Homo sapiens
cagtgctcgtttgcttgtccaggtggctgattccgctgcccggttttaaaggtcattgattgtctgtggcaggccctgcctcagaatgcagcctggaataaagaggtgccttggctcagcctgggaaaccatcaccagggcctggtggagaccaaatgtggtggccttactgtcgtctcaagagctatggcagagtgcaaagctgggacttgatgctctcggcaggacgcaaggcaggacctataagccagatcaagaaacctcttgttgggctctgcagggaaggggctggatgctagttaagtacacagaatggcaagtgacaccttcacgacccgtggggaccagacagaggaatggcatggtcatcctcctgaaagggagaatcacctgcgacaagtgggcttcttgccggggaccagtcagcattgcaatagctagccgacaaggtccctgccagctgacggggtcgccagtgtatactgtcaaatgagtatgtcaaggggcagcaagattttaggggaaagcctgaatccatcccaggccacctggcctagccctggcctgtgacaggtggaaggagcactagggcctgggcaccgtctcctccagctcctgggctggattcctgctttctgcattggattctgcaaggtgccagggtccctgggagccatggtcctctgggcttcaaatctattgcattttgcagtggggaggctgcacactacttttttagaaaccttctgtgaccaagacagagttttcaaccttaagcaagcttgaccagccctattgtttcttccagccctaaaattctctaatgtgggactctacatgtctacccagacagacaggcagcccctcccattccttgtgatggcggggatctcccaggtgtccctctggagctcaccccagtctcccaccccttgctaaaggggcaggagcccagcagaggggtctgtagggatggccacaccggcacccttcggggccctactgcgtgcctggccctgcactagctcttctccacttcacagtc

SEQ ID NO: 95982 - DNA, 1008 bp, Homo sapiens
gtggcctgtctcctgtcacttcaaggccactgttgcagggaacagatcccatgactgcctggctcccgagcggccagacccaaatggcacggggctggcctctcccgtggcgttggctggagcacactcctcaccctggaatgtgcaggtccctctgcatccctacctgccctcaccaggagaccagtctcagaactctgtgcctggtgtggagtggctgtgctggccccagcccagcacactctctctttcggcagctaatttgtcaagtaacacctcagcctggggtgggcagtgtgcgtgggcggacccagcagaggccacgggtcctgctaggctgtgtctgcagggcaggcctgattgcgtgagtggcctgggcctcagccagccggacaccagccagctcgtggtgttggaatttcctgtctgattttaattcctccccccacgtttttcccccaagtgagacagaagcactttttagttgcacgttgtggagtggccattcaggatattattcttattaaatgcttcctgtggggtggtggctgggcatcaggagggcctctggaattctcctgtcctgtggcttattattgaaaatcatggtgccatttgcataaggccctggggaaggaggttttccatgattcgtgctcttttggtgcttcctacctctgatgcttaggccagtgacttcgtcctcatttgcgaacgaacacctggtcacctgggctcacgtggctgaagggctggcctttgaaagtgtcaggatctcagaacagaccaaggctccctagcaaggggagaaagtccctggcagcctctcccagccctggtgtgcactttcattcatgtaccatcgaaaagcacagacccctggatgccttccaaacctgcattcccagtggcacccagaccccttgcagctgctgctcagaagcactggtaaatggtcaccaggattcaaatgtctcccccactcccgcctctctgatcttctgtgtt

SEQ ID NO: 95983 - DNA, 1410 bp, Homo sapiens
atgtttccatgacccagttttcccgattctttgtctgaactctgcagacccctacctccttctctcccccaggaatccacaggatcatttctaatggggcattaacttgagccaggtttccggggaagggctgtccttgccccctcactgccctcctcactaacacaagaagaccattacacccagtacactgcccacaccaatgtctgctcgccctgggaccgccagcaagaaacatttggtgttgaaactgcagcgtagaaaagttccaggattttaaagaaaaagccgtcactccgccgccaccctcagcttctcaggctgttgggctttctgtgtaggatcaaaaacaaatgtgcatttttttttccagaggggagtgatgatccattgaaaattcccatcttagagtttcttcctcagaaacttaaaaagagagtcatttctttgaaatggcatacggggtgtgtatgttttcagggggatggtgtgtctgtccctctgccggaaggacatgattaattttggattttttcttttacttgaaaaaaaaaaaaaaacacaaaagccaacaatgaaagctgtgtgtgtaagggtctggctcaggatgtcactcaaggcagcgcctattcttcccacgcatcttcatgctcctcgtgggcttctgcagcctctggatgcagcagtttcttgccagagttggaaagcagaatttttccctcctcagcctggccagggggctctgagcaaggcattcacctctgaatgtttccatcgggggctgtgggacaatccgtgctggtctgaaagagaccaccaatgagtcagggtcaacctttatccctcaggttacttgggaagaaaaggtggtctgtagagactgtgtgtgcacgtgtgtgcatgtgtgttggtggggggtgttggggtgctgtcctattatacctgggctcagaggattggggctggggctggggctggtgtgtcaagtgggttagaagggccgttgggtcagtcattatacatacagggccacaaagatgagccagcatctgcacccagagccctggtctgggcctgctcaggaggtccctcctgaagccttggggtgtcactggctggaataagcgaggccctttgcctgggaagtgggcaaccatttacagatagcaggaatgtgccagtaggaagggacctcatagctcctctaatccctgttgtacaaggagtgtgagacccagagaagggacataatttccccaaagtcccatggccacctagcggcagggccagtctgggattcctggcggatgggcaccactgccccacagcactggaccctccttgtacagcatttccaaaagttgtatcagagcaggtgactgcctgctcaggacttcccaggggcttccc

SEQ ID NO: 95984 - DNA, 1032 bp, Homo sapiens
aggaattttttcttttaataaacaaagagcatcctacaattatcatgatgatttgtcgagggcaggccaagttcagacaggaggctgactcagctctggaaactgacacgcacgtgctggcgttttcgatcctgggggcacccgacagcgtttaggggtcaagaattaatattaagagctggagaactaacagatccacatagatgtccactttatactgccagcaaaacgggacagcagttgggtgggatttggccttcctgaggctggcggcaccgtctgtgggccgtgccatcacaaatggctctaggtcaacacctccagcctgcgtgcactgcagcatccggatgccgtaacctggtgctgctggagccacacgcagccagggccggcatgggcagaagccggcggagttggagcctgtcgctctgtcagccctgatttgcgggctgagcccagttttgtggccctgcctgtaatctccccgagttcaaagagtgcttagctgcttgtctttgtcaagagcgcagttggggatcttttatgtgaaagatgtagaattctcgggcagactttgattatttattcatcccccttcgtgggtgtgtgatcgcgcgggcactgcggagccccttgtcctggctgctcttgctatgaaattcattgagctttaaagccctttgaaagtagctttttgagggagggggaaagtttttgaagtcttgtttctctctccccctctgcagtgccgcagcatctcttgccaccattccatgcgcccctaccgattgacatgcgacaccaggaaggaaggtaccattacgagcctcattctgtccacggtgtgcacgggtaagtcctgccctctgcctgctgctcctggcgtgcagtcacctgccatggggaggctgggccggcagcctcagccacatctcctgcctctgtctttcttttgggggttcctgatctacattgtcctgagcgggcgatcacctttgctatcatggcctgggaccctgtgtgagcatgtgc

SEQ ID NO: 95985 - DNA, 1049 bp, Homo sapiens
cactctctcattctgccctgccctctgcccctccggagtaccttggtcatcacccaagagcctgccattgtcagttctcagcctgccaggctacccgcactgggacccattgccgaaccctccctagctgtgattaacatgaattaactcacctcagctttctcatctatagaagggccagatctgctgagacaacccacataacccagccaactgagttattttgagaaggagacagggtaatgtgagtaaagcgtctagaacactttggaaacattcaatggatatgagcaacaatcgtgatcattgttgttatcctcacttgctgatttgagaagggggccacggcaggctgggagactgggtggcagaggccggccacagcatgtccttgggagagttgactgtctggggactgtggcacagaaggtgggggatggggctgaaggagtgctgtggtgcggtgtggtgggggtctttctttcccccagttgaggaatttggacttcctccttttggcaaccaggagcagcggggagtggtcagatttattttcaggcagctacagcagtagttagggagtagacaggagaagggcgggaactgtggtgagaggacctgccagagctgccacagtggccctggggagaggggagcaggaccagggctgaccacccggctgtaaacaggcagctgcacgtggggaaggcagggcatggaggttggtgtgaggacagccttgcagcccagcccagctcgatggcctcctcatagacacccaagcccactcctctgcagagcacccttcccggtcacttaaggttcaaatgcacagcaggcttgcatggcttactgatgctcacgtggttccaggggaggaaagtcaccacccacccgtggactcctgctgcagtgtctttgggctgtgcaaaccacaagtgatggggagacaaatggggcaggggtgtgtgattgctggtcaagcaaggttctcttgaagcccccatggggacatccctaagtctccaagagtctgtacaagggcgaga

SEQ ID NO: 95986 - DNA, 1056 bp, Homo sapiens
gggagcaaggctgaggtgtggcgaggaagggtccctaagttggtgctccccatttcctcagtgtatgtggtcacacaagcatgagtccggcctgccctgggccagcgttaacttgtgtcctggagaggaatgtagaagtccatgctcctggttcggggggctggggtggaccttcagctccctatgttgcttttgaggacctttccagccctgccctgccctgccctgccctgccctgccctgccctgccctgccctggggcttcagagaagaccaatttcagctgcttcctgcccagaagggcgtacagaaactgccccatgcagaggttcccaaacctggctgcagatctgaacacacagggtgggtcttaaagatgcccattctcaggccctggccccaggagttcttgttgattttcagactagggtgaagcccggaaatctgcttatttacaggcgcccataggccagagtttggggaccactgcaggcgccgctgcttgcttgacgtccgggaaagcagccccagagctgcttgttggctttctggactcatcactgacagcgcctcgccgccaaaacacgggttgttaaaaatcccctggttcctcgtgataacccattcacagacaagtccctcctaaacctattcatatgacctaaacctattcatattctcagcttgcaaaaggcagtgagtgtatggggtgggaacagctgcagtatctcagccttcctttctcctcctgcctggcaccatctgacctctgacatccacgactccacccccgacctgaccactgctgatggcttcctgcagatctcttgatcctgagctgtagttggtttgcattgcattggcagtcacggcccaaggccacccttcctggaggagtgacgagggggctcttgctggcacagatggctcagggttgtagctatcaacccaggcccaggtatgttagggcaatagagtgaacgccagctggtgggcatgggggcctcacctccctttcatctgcatgcttggtcacgcaaaatgcatattacccag

SEQ ID NO: 95987 - DNA, 1010 bp, Homo sapiens
gccacctgccccctcactacctgggtgcatgcggggccctggccgggtctgtctcagaaccccagctccccacacctgctccctcactacctgggtgcatgtggggccctggccaagtcggcctcagacccccagctccccaccatcagtgccatcagaggcccatgctcagtaaacatcagctgatccgggggagtgacgtgtggacgcagacacagatcagcaatgaatgtctgcaaactgcggcctcagctcccgtacacagagcctccccatgaggacagactgccaccagacacacaggagagtgcagattgataaaagacatggactgcgcttcagtttgaggaagggacagttctccattgttttccaaaagaatttgctgtatggctcttaaaaaatgcaaatccccttagtacattttggaaaggacttgatttctagaactttttaaaacaaatgtatgggaaacatggtaagcaagcttgccagtgtacagtttcacctacaaaaccaaacaacaaaactcaaaccaacaaacgaaaaccctggggaggagattgaattccatccagaggagcgttctggagctctgtttctatttgtcggtagagccgagggtggcaggagctggccttgctctccagggaggccctgggagagcagacacatgcacgccctgtcctggcagtaagaagttccagtttggggaggaagagatgcagggcaagctttggggactccagcttcctttccagcaggtcagtgggcccagaggacgcctgcccagcatttctgaggaagtgggcacctggtcctgagcagctccgcaacagcaaaaaggtcccagtgtctccactctggagctccgtggacccacccatggccctgtgatcctggtgggtggtaggcatcttggcccaaaggcagggctggtgtacacaagccagcggttccgaggcaggaggaaatggcatgctggggctgtgtgctgggtggattctggc

SEQ ID NO: 95988 - DNA, 1057 bp, Homo sapiens
atggacgtgctcaggtcagaggaaggagccacctaacacagaagcaccgtaggaggatcctgaccttgacctggggctagggggcaccttgggtgagaggtccctgagctggcacctctgggaggagaacaggagttaactgggggaagggatgaagaggggaagggcatgactggaggtgcagacatcaaagggcaaagctgtgagaggcaagcatggccaaggaccagagagtggcatacaggacacagaggggagaggcaggccctggccacatgggattgtggcccctcgcctgctgccactgaggtcataagtcaccctgagaagcaggcaggtggtgagatttgtaggctcatatccccaagtgactgggcctccttttctcttcatcagcaacagctgttggaccagtctgggggcatccgggtgcctgtgttcccacccgctgctgccgctggcctcactgtggccatgcccctggtgctttgggactcagcagtgctgtctgttaaatgggacatgaaggagctgttcctgcctgtgtctggccccagccaccagcacagatcttggagcaaagccatctctggcatgccaagggtgggcttctcctctgactccaacccccgagtgggacagcccgccctgatggctggtgctgagtctgggtgagtcagcagccctcagctccacattgttcagcttctccaagcaggcaccgaggctggggtgtgggggccccaatccctgcacttccttccctttctctcacaccttaaggaacatgccggttcttgcccccacaccttggctcaggcggtgctcaggccagatgccctcctttctcctccccagccctcaaagtcttacttgtttctcaggcagaagctacacaccgtccaggtacacatcccccatcattctcactcccagggacagcacccactccgagggtctggcatgctcgcttaggcccagccagctgcatgctgagttacacatggctgtgcagagtgctcattaccttgaccttttatctcccaccaaaaatctc

SEQ ID NO: 95989 - DNA, 1024 bp, Homo sapiens
ctgggagtgaggcccgctggagggagctcctgcttgcctctcactggccgcacagcatggagaatgactcccctgtctggatgcagtgtgctcgtggtcaagtgcagtggttggttccatttttccataccctcctgaggggcacacagccggtgcttacttcatgggggctgccatgaggatatagtccaggcatccctgcagagacccctggatgtccctacagagcccagggcctgagagaggaaaaggctgccctgggctacccctgggctcctgactcccttggtgatgcttgcggtgggaagggggaggtggagtctaccttccccaaatggtggcaactgcaccgtggaggcggaagtcccagctcctccatgtgtgacccaggccccacctgccatctccaggcccagctgcctccatggcagccccagacagtggtgtgcatgtggctgtgacaacacctcactccgggcctctcaggggaggctcacctggccagtgggacctgggtcaccttggacagactgggcctgctgtgtggcctcaccatgtagcttgaaatccccacgtgatcaatggctatcgcagggggcctcagctgtggttggcacaccccacagggcaaccctggtgccagggaggctggcattcccgggacctgaacaagccacgtagggccaccggcatctgattacaggctactgtgacctcaaaccctggccggcatcctgcaggctctgggaacctgccgtgcctggagtgtctggggaggaccgagaagtcaggacagaaggcaccttagctattctctcagcctgtagacaccctgcattttgctgagccacactcagccttccagaacttgtatccttcagcccaggtctgcccccaggagccatagaggcgtgatgttgtctcagagccttctcttcacaacccacccatcccgtggcaggatgtgagtgtcatcctgctgcagtcacaggctggagcccacaggacctgcccttgtccaggg

SEQ ID NO: 95990 - DNA, 1051 bp, Homo sapiens
agagattgtttatgagtctaatgaagtggtggagtacagaggtcggggtctggcctccttcagcagcaacaccgcagctcgtgctggccaagcccaggcccagcacagtgcaaacagtggggcagtgggggaaaatgccgaggagagaaaccccgacaccaggtgtgcatttctctctgccttttttttttttttttttttttttttttggcaggagaaggcacagccagtgccaggttctgacggcttctttctctcccctctgcccacagtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacggtgagtgctggcccccaggggctgaggatggggctagcagatctcctcttgaggctgagaaggtcactcgctgtttcttttggggacaaggacccttaaggagaggtcgggctgtaccccaatgccttccaggatggctgtccacaggcactgaatctttggacaacacttactgagtcaccacaggccaggaggcgttgtaagcatcgcagacaccacagcaaacaaagctggaacttacagtgcaatggggagaaacagatgccaagtagctctaggaattacgtatgaaagtagccaattataaatggaccagggaaacaaagcaggggcggggggagcgagcactgggtgagtggggtgcagtttggaatggggaagtcagaggaagcctcactgggaagttgaaatctggggggcgagtgctccaggcagaggaaactgcagtgcaaagggcctgaggcagcagtgggcctgccaagctcaagaaatagccaggagccagtgctggcagtgaggggtgggagtgggggtgaggccagagtttccaggtggggtcttgccagccagtgcacctcagaagagactggctt

SEQ ID NO: 95991 - DNA, 1874 bp, Homo sapiens
cgcctcctccaggaagtctctctggaagcctcctccttccctttcccctgcccccctcagtcactgggacagctccctcctctggctgctccttcactctttgcctggcccacctcatacttacagcaaccacctcacattgctcctcagctatcttgaacatctcctgcttcccaggaaaagttttgctgagaagagggcggccaacctccgaggctggcccctcatggatatggtcctcgccaggccctggtgggaggccataacatgcctcagtgatgccaccagaatttggtccctgtgtctgtcccgttcttccttgcctttcccagcatggtgtttagtccagaattaagcacaccatccagatgttcaacaacacctgtcagctctgtaggacattgacgtccctctgagtacacacacatccatgtgctctgttcccctctcctctcagcagccctacacggtgctcccacaagccacagtgaggtgtcagagatactgagagaaagttgtgtgctagacacgctccttgccaatattagaaaccaaacagcagcaaccgagtgcatgaaggatcatgtgcaaattgccacacccgaatgtcagcttcctgcaagcaggacccttcttccaagggcctgagggtggcaccaggccaataggaaagtggacgaggcagagaaaccacggccaagagaggtgagatgaggcaggtgtccccacagggcaggaaaggctaagccaggcagccgggagtcatccagtgattttcagcatgagcgtctgtgtgtgcacgtgtgtgtacgtgcacacgtgagagacagtgaattggaatgcagactgcctctgttctgtgcttttaaacacattcttccatgtaattcccttagccaccttctgaggctagaaatatgctccttactttaagatgagcaaatgggctcccagcatctagcggcttgacccaggccttgctctgtttgttaccagcaccatctgcccttccctgggctgcagttttcagcagcacatgcacctgaccaaccatgagccctggcccaagggagggccagccgggccaggtggacttgagctcagcccagagcagctgggccggagccagaggggagaagtagtacagcgagctccagggcaggcctgggtcaggcctggctgcacggtgtcctccctgtggtagctgggctcagaggtggtgacaggactgaaggggtgtggagtggcaatcccaagccctgcgagctgtgtggattaaacacattgactgagatggcacatgtgagcctggcccagtgcctggcatctagcaggtgctggaataatgctggtgcaggtctctttccaccagtatatctttccctctttaaatccactcactcttgcaggattctgtatcttcattgtaggcagctctgtccacctgctgcctaagcccaggccccaggttctcccagaccttttccttgccatctcccatccatcccatcctgtccctcaggcctccaagagtggcgtgtcacccctcccgggccagacagtgacatatcgccctcgtagcactgctccatggctgctgctcatccagcatccccatctttatcctctccgccatcctgcgctcagcccctgccacttctagccccctcaggataaaatccagactttagaacccccgtccagaggccttcctctccagctcatctctctccactgcacactggtcttgccatgcactgccccacatgcaggtccccagatacctccctgagctcattcctgcacagagtcctgtgcacggtgcgctaggccttctcctgagaccccacaagaatccagccccaggcctttca

SEQ ID NO: 95992 - DNA, 1919 bp, Homo sapiens
ttctagggtgcagggtactcttgtctggggcaagccctcttcccttccacagttatgtaggtgtgcgacagcagctggtgagggctgagggcatagccatgtgtccacacatatgtgtgcatatgcatgtgtacacatgtctgcgtgtgggtgcacacaagtgtttgcatgcatgggtgatgtgtgcacctgcgtacatgtgtgcctgcatgcatgtggtgtgcacattcaaagcaacagcttcccagagcctcgggcgactttagaactgaggacctcagtacgcagaagcacctgcctgtgtcaggatgcctctcgctgccatgtcctcgtgtcctccctgccctgttacagcaggctgcccagtaggctctggagagacagccaaaggcccagacattgcgaagagtctgggggccgccatccaggcctctgcttggcaaatgccctatcagggggcactttagtggtgattccaggtacaacgtgacctgtgaccttggagcacttacttccattccctctcttccccatggaattctccatagcagtgggaacaggcaagcttctgccacacacaatagcatggagaaatcttacaaactgaccatgtggatgaaggaggccagatatgaaagagtatttaaaaattccatttacacaaagctcaaaagtaggcaacaagaagctgtgtgttagaagccaggatagcagctgcccttgggctggaagatggagggggcctgtggacaatggccaagcactgtttcttgacctggggctggcttcccaggtgggctaacttggtgagaggccaccgaactgctcacttatgattcgtgcacactcctgtcatgaggtaagcattgctggattccagccctggtctctgcacccagtggtaaatacactatgctcagtgctcatattcactcgcccaaacaccttacatgcacttctccagtcctcaccacaccctgcgctgctcagtccattttacagatcaacaaactgaggccgagaggtgacatccttcgcccaagagcccacagctggaaagtcggcaaagctaggattcccattagaccatccttgcaggctcttcctatcccccacccacatgtcaccccctcccccatccccagtgatgctgacctgtcttgtgttgactatcccacagtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcaggtgagccccgcctgcaagcagagagctgaggaccagagctgggctgagggcccggtggggaggcgctggcttttcagtgggcgcttttgacccgaggagaaagacaggacctgtggcatttgtgaatccacatacttgcaccttttttatgaattcaaaaccaataatgatcaaattgaaatgagcccatatctgagtacatcttcatggaccaggcctgtcatgaatgactcaaatgtgaaatcaaaggtgtttgaggtcaaagatggttttcctagtatttcactgaatttggtggagcagccaagtattggccaaccttggagaccacacaaaatgtgacattgacatggcccatgctctcagcaagcctctgggctggcagcaggcctccctctgtagccgcatggtggcacacccaagcctcactgacaccagccacccttctcccttctgtgcggctctagtctgtctgaggactcagaccccagccagcttgactgaaactcacatgcctctccagcacctccggaagag

SEQ ID NO: 95993 - DNA, 1009 bp, Homo sapiens
tctataaagatgaacccactaaattagtagctcgattgctgggaagagcagacacacacgcacgtgcacacacatgcacacacacacatgcacgcgtctccgattcatattcagaagctgtccagaggcgcttgcttctccccagctctgtgaacttagcatttaggacacgccgactccctctgcttcttccacttatgcaacttgctcacaaataccgtaggtttcttttgtgttggagtttgtcctcccaaacacagttctcacccagaaggccagaatttcccagcaaacgaatgcagctggtgaagcagggtcttatctaaccccttctggatctcaaacttaatttttcaacttgtaccacctctttggggtaaacaagccctagatggagcagggaccgtggagctgtgagttgcagaacaaatcagttagatgaaaggaggagagagggacagtctctcaggccaggggaaggccaaagccagagcatgcagatgaggatgtcaaagacgtgctctgtgataagtgggtcagccccaaagagcaggcacggaattcctcagatgaatgcggagggtccccaaactgggaggagggctttagccaggggcttctgcctgtgccctggactgtcctggagctataggtggccacctccaccaggccctggaaaaagcagaccccttcacccagctctgtctgtctgtctctctctgtttctctctgctccctggaaagatggatggagcaggcgcacaggcgagctggagcccctggtcgattattaacaatttgttgctaagtaaaccaataagaaaaaaatgaaagccattgtcaggaagcatttttatcatttgaaaggctttaaaaatggaaagtgaggctaatatgataagatttccctggaagttcaaagcgctggagatttcacatgctccagcaggggcatctgtacgcgtgacagttgggcgagtcgcacagggcatgagggcctggcagtttt

SEQ ID NO: 95994 - DNA, 1037 bp, Homo sapiens
gtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggca

SEQ ID NO: 95995 - DNA, 1020 bp, Homo sapiens
ggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggcatttactggctgtttgtttgttgtctccttggggccgggcagggtttgacatttcacagtgaatatctgactgctcttccggtgagccactctgaacatctatatgcattgcagaccggggtatagacccaaacactcctagggtcagaaccctccctttggtgggccctctgatggagcatatttcatcagggtggggcggggtgagatgggcaaacccccaaggc

SEQ ID NO: 95996 - DNA, 1051 bp, Homo sapiens
ataatacacaggaaggtgctgagcacacagccagtgctccataaacacttgctcccttccggctgagcagaagaggcctggctagcttcacttctggtgacaactagcaagtgttaggacagtgcccctgccaagggccctcagaccaaccctccagggcttttatgcctcagatggctcatttgcatgccctggttggaaactgcttagctgaagaatggaatgttctggcctcaccaatttgattttcaaatcacttccctctgagcaatagcctcccccaagagcagcatcccaatacttggtcacacccatggactcggcctagtgattttgggacagtgagattggagggagggaaggggctcaccccaccctttccacaccctactcccagtatgcatatttctagaaaccaggttaagaatctgtagatttggagagatgtcagggcaggctgaatgggtggctgtagggagagggcaggattcctgctttggcagggaaggatgttgtgtgtgctgttggagtctcagtccctatttcttaccccaattgtctatcgcaggcttctgtcccaggggaaaagagctggccatgtcaagcctcaggaactctcctttgaccctgaactgccaacctgccttcttctttcctgatgatgccagcagagggcaccaggagccagggaggagctgcgagatgtcctggcctcagtgctgcagggatgctgcccccagccagcctcacctgcagacggaacagggagccgcctggctggagccatccctcagagagcggtccctgctaccttgcacaaacctccctctgagatcagaagccctttcatggagggcaggtctcaatttccagttctttttggaacaggaaacagagggacttgtgtgtatttatacaaaattgcaactgagaaagtggaggctcagagagtttaagccactcgcctgacaccatccagctgctaggtgacaccaacagggtttgcgccctgatcggcctgacttcagaggtgcactactgttctatccga

SEQ ID NO: 95997 - DNA, 2323 bp, Homo sapiens
tgtcagctagcatacggtgggcccacctggcccactggctgtttatgccactgatttatgatagggaatattatctttgaacccaatgaagtgttttctcccccatcacaaaaaaaaaaattcttatttttagtagacatgtatttaccaaaaatatgtactcaattattgtattttggattttatcaatttaaaaattgtggaaatttgtttgctcttacgccaacataatattgattttgcctcttggctctgaaagcccaaaatatttaccgtctagcccgttacagaaaaagtctgctgactactgagccagacctccattacctccatccctgttggattatttaaagaaagcctcagacagtaagggcttttttaaaagaataaaatgacttggtttgcgcttggaagcaggggaagcattcagatgagcggtttctgcattaaccctgcctatcacgcatctcgtgtcctgtgtggctggcgagccccccttggaaggttctggtgcttcagctggctcctgcagagtccaccccgcctcgtggtgggaatgcagagccctttgctttccttcttgccgcctgcttcctgttcctggggacccgctgggcctttggtctgcatcccctggccaggtccctcagggttgatgcgtggagaaggactttgagcagtggtgggcagcagtggcctcctggccagctcacactcttgtcctgggaggggcagcctgatctcacctccacctagtaccttggggactgaggaccttttggcttctctggagcctgcaagcctcttcccatgtgtccagctgctcttcctgctacaaaggggactgctcacagtggcctcagcttggtggttttgaggggccgccccccggccctccataagggtatcctgggcctgagaattctgcatctgccattggaggatggacagcctcaaatggaaggagtcccacgggagatgggtccgaggtccggctgtggccatccagccccctgtggcttgtccagcctctgtgcacccctggtgtcttcactccaggggcagacagcagccactgcagttcctttcttcgtgagtaacagtagtgatagcagctggggctaacaggctaggctttgtgttctgcgcatttggtcagcttctcactcgatcctccctaaagcaatggggaggcccccactagcccagttttcaggaagtcaactgggaggttagatgggggccagggtcccacagctactgatggcccgagccaggttgagcttcctggtgtccagtccggatcccacttgcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtaagaaacctctgtggctcaggccttgagttgttttgcttttttgtttgttagattctggtaaaatatacaaaacataaaatttaccgtcttcactatttgaattgtacatgtcagcggtattaagtacactcacattgttgtgcaaccatcacaccatccctctccagaattcttaattttttgttgagacagggtcttgctctgtcacccaggctggagtgcagtcgcatgatcactgctcactgcagcctcgacctccccaggctcaggtgattctcctaactcaacctcccaagtagctgggactacaggcgcgtgccaccatgcccagctaatttgtttgtattttgtagagacggggtttcaccatgttgcccaggctgatattgaactcttggcctcaagcaatctgcccacctcaagcacagtggctgatgcctataaatgctgagattacaggtgtgagccaccacgcccagcccagaattcttttcatcttgca

SEQ ID NO: 95998 - DNA, 2282 bp, Homo sapiens
ccaccttgtcccgtggatctagccaccgagtgtctttttttttttttttttgatggagtcttgctctgtcacccaggctggagggcaatggcgcgatctcagctcactgcaagctccgcctcccgggttcacaccattctcctgcctcagcctcccgagtagctgggactacaggcgcccgccaccaggcccggctaatttttttgtatttttttagtagagacggggtttcactgtgttagccaggatggtcttgatctcctgacctcgagatccgcctgccttggcctcccaaagtgctgggattacaggcgtgagccaccacgcccagccaccaccaagtgtctttggggccttgggggccataatatccctgagaaccacagttgtccaaatcctccttggaacgtaggttttcatccttgggcctggggctatggtagaaagacctattgttaaaaagacactaaacgaggcagatgtcagggcatgtgagatccctgcttctgccagcacgctttgctgtatgcagccctattttggtggtctttgctgataccctaacagcgtgccttttgggactccccaatactgtggcactgcaccttttttcctgtgaaatacacccagtgtttctctcttgcagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctaactatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccgtggcattcctacagaacagagtgaggacaggctcctgattcctcttccttctttagaggagaagcggggagtgggttaactaacagctttattgagatgtcattcacatgccattcagtttacccattgctagtgtc

SEQ ID NO: 95999 - DNA, 1056 bp, Homo sapiens
tgggaggggcgggggcgacaggtggatggatttgcaagattcgaggcagtaatccagagcaggccataaaatgtggatggcattttttcaatttgaaaaggggttttgctattgtgttagctagtgtgtgtgtgtgtgtgtgtgtgtgtgtgtgtattgtatgtttatatattttattttattttattttatttggagacagagtctcactctgtcacccaggctgaagtgcagtgatgtgatctcagctcactgcaacctccgcctcctgcattcaagcgattctcctgccttagccttctgagtagctgggattacaggcacctgccaccgtgcccggctaattttgtatttttagtagagatggggtttcaccatgttggccaggttgttctggaactcctgacctcaggtgatccacctgccttggcctcccacagtcctgggattacaggcgtgagccaccgcgcccggcctgtttatatattttaaaaatattctttaaatgtaaattgtgaaatgcagtataaatatggaaaaaatttgtaaaacttacttatacagttaaagaaccattgaagtacccatgtacctgcactcaggttaccagaatgttacattagaagcccctttgtggactgatttcataacagccaactggctagtatgaattttctattaaacattcccttgttcctcctcaatatattgtttaattttgctatttaaaaactttccatgagtgaaatcatagtgtattcttctgtgatttctttcatttcacattttgtttggaaggtcatgcatgttgaagtatacagctggcgctcattggcactgccgaggagcatgattccatcacatctggttcatgcttctgctgttgactgacggggctggtaggagtttggtgttactgcagacggtgctgcgctaaccagcctcatgcccgtctttgtgatgtagaactttgtccagggctcatgacttgtaggagaatgtaggaaaatttccttgttggaaatgcatggtcattcttactgggtcccatgaaca

SEQ ID NO: 96000 - DNA, 1009 bp, Homo sapiens
cttcagcccatctgggtgtcactgggctggggatgggtctagggatctctgcatttcacataagcaccccaagagagaccgagaggaatcaagagtggcagcctggctgggtgcagtggctcatccctgtaatcccagcactttgggaggctgaggcgagcggatcacctgaggtcaggagtttgagaccagcctggccaacatggtgaaaccccatttctactaaaaatacaaaaattagccaggtgtggtggtgcacacctgtaatcccagctactggggaggctgaggcaggagaatcacttgaatctaggagatggaggttgcagtgagccgagatcacgctgctgcactccagcttaggcgacagagcgagactccatcacaaaacaaaacaaaacaaaacaaaacaaaacaaaacaaaacaaaacaaaaagagtggcagtgtggtcctgccccgccgccctgggtgtggcattttgacaaaggacttactgctttctcagggcgggtgggaggctcacactgacagaatggccacttggaaagcagcacttgctcctccttcccccagtgtaccacgccatcttcctggaagagctgaccaccttggagctgattgagaagatcgccaacctgtacagcatctccccccagcacatccaccgagtctaccggcagggccccacgggcatccatgtggtggtgagcaacgaggtgagggctgctgcctggcctgccccgacaacgggctctgggccacgggaggagtgtcagaacccctgccccagaaacacacttgggtttgggagtgacagacaggttcatctgcacaccacctgcagctgtggctgtccggggctgcgatggagagtgctgaggccccgtctgggtccaaatggctgccatgccaagtaggcactccttacccctcctgggctgggtgcccggtgggagccaggaggacagactccactctggcccaaggtgcttatagtcagggctgtgg

SEQ ID NO: 96001 - DNA, 1848 bp, Homo sapiens
acatagatgcaacactctgggaaactgctggcagtatctgctagagccaaacacaccctgtgatcccgcagccctctccggggctagacccggcagacacgcaccttgtgtaatgaacaaagacatgtatgagaacgttcagagagcctattcataacagcccagacctgaagcccccccagcgcccatccacataaagtgggtatgtgaattgtggtgtagtcacacaatgataggtaataacgggcatgaacactctgactacattccacacaaatgcaccgtgaaacatgacttgcggggagggaagccagaccaggaagagtgcctaccgttcaattccatgtacagaaacttcagagaacatgcaaaacgtgtctgcactgtagcaagtcaggatagtggctcccctgggtgggagtaggggtggtggctggtacgaggggcctacaggaggctggcaatgtttcactgctggctctgagtgctgggtcctggggtgtattcagattgtcagcatccagcgagctgtatacttccacatacagacagatgcacacatggccagtgccctgtgctgatgacatctatgcatacagattatatgtcaaaaaaaaaagagaagaggccagatgcagtgactcatgtctgtaatcccagtactttgagaggctgaggtaggtggattgcttgagcccaggagttcaagaccagccaggctaggcaatatattgagaccttgtctcttaaaaaaaaaaaaaaaaaaaaaaagaaagaaagaaagcaagcagggcaggcaatgaggcagtggggacctattggcttctgttgtactcactgttgtgagcactggcacttcctgggctgcaatcttttgatgttgttgagcattttgccattttctctctgtgagatagtgcagctggctcttccccaccccccacccccagtgctatggggtctgcagctggttggggaccgagccctttctctgggttccatgtaacaggcatccccgtttttttcctgcctaggtgctgacttgctgaagatgtcccgagatgatttggtccagatctgtggtcccgcagatgggatccggctcttcaacgccatcaaaggccggtaggtgttggtttctctgtgaagccagccagaggctcatgtcccgtggcatgtggtgggaaacccctacctcagccttttggatggtgggtggtctggctggggggacaggactcctgcagtgtggggtcaagtgtaggaggaaatgtggcaagaggggcacgggccacagcaggggagtgagacactgcagtgggagatgtggccagctgccgcagaccctgcctggaggcccctccctcttcttggttggacgagagccttggcctctggatctcggcctctgagccacttgcccatgttctcagatgcttgtgtggtcctgggctcggagctgctcccccgctgaggggagctgtggacttggggctggtcagatggtatcatgcagcagtttcaggggagactccagagcagcgccgtcctgcacaccttcctgccatggcagagacgttctgcagccgtgctggccacatgtggctgtggagcacttggaccgaggctgatgtgatggacgaaatttttatttaactttagtgaatttaagttttaatagccacacatggacagcatggttttagagtgagagcctgggtttgagtcccagatctgcctcttaggtgctgtgcagtgaagggaaagccctttgccctccgagcctcagtttgctcaactgtggaatgagagcgatagtcctagctcccttgcaagttttgtgaggat

SEQ ID NO: 96002 - DNA, 1046 bp, Homo sapiens
aagctgcgggtgcttgttcactgcaaaataactccccgtgggattcttatgccctctcccctcaccacctgacaaagggtttggtggaggacccttgagtttggtggtagccttcaggtgccaaggctctgggtgcccttggtcagcgtgcctttccctggggctggggctttgaatctccaagttcaagaccagcaggggtcagccagcaggggcctgggatgtgttgccggtgactcagggtagaggagtgtcattgactggggcagtgtagcctatcagaacttgctgtctacaatgaaggctcagttagggattttgagggattggacattggctcctgctgtgtttctgtgactcaggaaattcttgaggactcatttcacttagaacaaatcctgcatctgataggaagtaaaagtgccaggctgggtgccgggaccgtggccattgccctgggagccccctctgtcctcatcactggttccttttccttgcagcaacgcctctccgacccacccggtggaggccctgcccgtgggcagtgacgtaagtgtctgagcagggctttctggctggtggtccctcgtgggccctgagccaccatctcaaggcctctcccctctgctcacagcacctgctcccatcagcttcgatccaggatgcccagcagtggcttcaccgcaacaggttctcgcagttctgccggctctttgccagcttctcaggtgagcatctccgaactgtgtttaaagcccatgagtatcttggagacacttcaaggctggccaccttccaggccttgctgtcaacactggcagcgctgtcgtttcagctgggagacccgagatagtgtgggttcgctcgctcacgtgccccaaccctgggccaagtgctggacataggtgatgctgcccccagaaggtcccaagtgagtgtgacttgagggggaccatctgggtgacttggtcaagatctcctcacctgcggggggttggtgggctctggtctgtccaggaagagtccccttagcccggcagggtgat

SEQ ID NO: 96003 - DNA, 1017 bp, Homo sapiens
actccacatgcatttgtgtttggcttccatagtagaatgttttcgagggcaaggatcacatctttcatgtttgtggatctcccttagcccccagcagaatgcctgaaatggaatgaacaccatcaaatttcaccgagaggagctgcttttggtgattgtgcaagagcctccgcccctgtcagcagattcttttttcaaatagcacaggttttaatactgactcttactgcttatttttttgtttggaagttgcctgtggtccagtactccctataacagacatttacacgaatttgtctctcccaggaaaagctgtttgtgaacaactggctggtttcgttttttctctctcgtggacccaagaatcacatgactgtgatgtttcccctctggttttactgctaggaagcccagagagaccccttgggtacttcacttgctccaggggtgacttactgaacatttctgctggtttccttcatgtggccctcgtaacctgccttgccgtggctcactgtgggcactgggtaaacgcaggctgcgtttcacaggtgggggtctcatgcattggtgtcagtgcatgcctgcttgggaggacctggggagcacggctcagcgcctctccagatcccagctcgccctgtgctctctcctgcagtgctctccatggcccgacgtggcctaccaggtgaacagcgccccgtccccaagctacaatggttctccaaacagctttggcctcggcgaagggtacgtcccacctctctttcttcgggttccctgaaatgaaggcaggtgtactttcctttcttagtcttcctttctgggtctcctctcctttctgtttgggtttcagggtagctaactcgtgttgcagtcacaactgtcttcagcatttacacaacttttagtgctcagaaacacccctgtaaacgttgtcgggtgggacagcggcccagaacttacctggtgaaaccaggactggcttgagggtgcatgcggtcagccacccaagac

SEQ ID NO: 96004 - DNA, 1148 bp, Homo sapiens
ggtttgcaaagcacccatgattgtcaggctctctctctggatggagacgttcccctgcagacagagtgtaagctggggcttagcgggagtcctgagagttgggggtaaggaggccttcagcttatggccaggatttctcaggttgcaagcacagactaaatccagaccagcagcctgtacttcttccactttcctctgctctccctgggtaacccaaggaatgcactgggattccttgtgggtccccaagcttccttttcataagcgagtggccatgggaaacaatcttttccccttgagcagcagagtgcatgacccgtggcaggttccgagttcctcaggtggggaagcattcaggcagaatgggaggggagataggtgctgtcctgcccctgagttcctccctgcgccctggggccctgggtgaggtgggaagcaggagagggcttgggggctgctgcctgtgttggttttgggctgattggactctgtactctgctcgcagccgaagggagccgatcggaaacagaagactgaccgggagaagatggagaaaagaactgcccaagagaaggagaaataccagccgtcctatgaaaccaccatcctcacagaggtgagccggctgggtgcggggacagagcctccaagggtcttccaccaggagcagggctgctggtttagattcttggaaaatcgcccatctcgggtgactacttctgagagtgcttattctgttgtggtgggttccagtgtctggagctcgtgttcatctgataagacccagtggcccgggaggtatttcagaaataacttccagctctgctccctttgaatgcatttgtgctttcccaaattaggttccctttttttttttttttttttttttttgagtaggtaatgtattcacatggttttgaattcaaaaggtacaagagagtgtacaacagaaaatatccctcccagtgccatcccagcttcatggtttctcccctccagggcagaaaccttctgtatctggcccaactttgtctgcaggtgaagccagtgtagacacgtttgccccatgcctgcatttatataccaacagtgtacatagacacaacttgcttttttccattattagcttatcttggtgcctgatgcct

SEQ ID NO: 96005 - DNA, 1042 bp, Homo sapiens
gaaatcatttgaaagtaaacattttttctattatagtttctattgttgaatgaattattttgttatcaagcactggtgtggatccagccttgtgttatatgccatgtgagatcaaggtggtgaaggatgtgactgtggcattgtggttgcggttctggcttgatcctggctctctcgcttgctgtgtgtccttgagcaagtctcctcccctttctgagcctcttagttttctaacctcccatcttacaaatcagataatgaatacagagccattagcactgtctggtccctaggaatcactcaataaaagcgatcttttctttctctttttttttttttacaattacaatactcttaatatgtttaaaaattattacattgttattattacagttatgtatggattcttataatattgcagtattataacaatacattgatatcgagtgccatttatgtagtaggaacctaccagaagtacagaaatggttccagccttctggttgtcctttaagcctggcctgagtagcctggacaccaggacattagagaggggttagggctgtgctgtggtccctgccctcagtctaggatttgccaagggagaggaatctgggtgaggagttaggttgaggttattggggtcagtggcctggggagtggtggggacttagctggtcaggcagggcctccacagtaaagagacaaaggtgggggtgtgtatgtcttttgcaggcaggggaacagggaggccaccggcctgatggagtggacagagtgtcagggaaagcagggaggtcgaggcaggcctgcactgaccaagcagggaaggacacctccaatagagggggcgcttgggggatccaggggcaccctgcttggtgcctccttgccacctgcccaacgtttctcctcccaggtacactgcatcagcacagaattcacccccaggaagcacgggggcgagaagggagtgccctttcgagtccagattgacacgtttaagcagaacgagaatggggagtacacggagcacctgcac

SEQ ID NO: 96006 - DNA, 1685 bp, Homo sapiens
atttccataccctttcaaatacatggaattcttttaactggggaacatgctttgcattctgccattagagacaatgtttaacaggcttcttcgttccttcaaacctgctctcaggaagggtgtggttggttatttaccctgtaatgtgaacttaagtagctgtgttctccatcccgttgtattggggggtttgtaaagatgtatgagtttgtgttcagtgattttaatgctaactgtattttcctggattctgtttatttgaacattgtagaggtgctatctctagtagggtcacacggtgtgttgtctggggtatcctaggcccgacctggcggggtggacagactgatgtcagtccagagagtgagctgagctggtcgtgggttttcttctctgctttgctccccagggccttgaggcctggatgggcactgagggtgttgagaaggctgctagctgaatgaaccccaaatttagaaatactcagaaatggaaaatgtccttttaacccccatccaggtcagtcttatgaaatccgactactggagaatcggaagctgggagactttcaagatctgaacacaaaatatgtcaaggtaagcctcacaggctgttctcattgcctcggggagaggggcttgattagggtctgggcacctgggcttgctggggttgggcacgggtagctggaaggttagggagaggccgggttcagctcagccctcaacggtgagacgcagcccctgtttggcttctctggagcctgttgcccaggtggggattagatgggctggcagcgttgaacttttctgagctgcagtttgctcatctgcacaaaagggttaataacgtaaagcacttagtaatactgggacaaatggtagtcatcactgttgttgctgttgttagtgttactggaatctgaggaggggacagtgggcaaagcttgagaactgggaaaggaagccccagggggaggggcctcaaaggtgggagggtttactgtggctcagggaaaagaggtgggttcctcttggccccccgcggtcacttgtttccctgctggcctccctccccagagcatcatccgtgtggtcttccatgaccgccggctgcagtatacggagcaccagcagctggagggctggcggtggagtcggccaggggaccggatcctggacatcggtgagtctcctggccaggagaggccaggcaaggctcgaggcacccaggccacattgggttcttcctggatgccacccggacctatgccgagaaggcgttttagcttgcacctgctctgtgtaaaaccccgcgggagcttgcagagctgaccatacactgggtcctgccctcgaggagtcccctttttcagtggaaaagaaaggtctgtggaattgagagacctgctcacagggagttcagggaaggctttgcggaaggatggtgccttaaaggattttgataagtgttgaagacaaccgtgagcatcacagagatagatgggcaatggaaatggaattctggggcctcagggactggcccacagtcctttacccataatccttgtggccaggtgggttttggaattcagaagctagaatgacaatacgatgtgtgtacccagagcatcagggaacatctccaacaggcagccaagcacggtcatatttctgtagcaaaat

SEQ ID NO: 96007 - DNA, 1137 bp, Homo sapiens
gcactatagcactgtaaagaaggtgaaatcccatggatgcatttgctgagtacctactgtgtgcagacagcgcagtgatgagcagaacagacacgacccgcgccttctcatagcccgctgtcctggcttccacccacgcccagcagtgatgtcggccaggcagagaaatgcccttgtgccctaggtcagttcagcctgtgtgacctcgctcgtcagcctgtatgtgactgtgggtggtggccttctgcgtggcttttgggatggtgctgttgtgctgctgtgtgagttgggtgggaggtcaccttgggcccactgtgttggcacgggggtaggcatgcagagggtggctggatgtccatctgcatggctagaaaggaggatttggtggtgaagtgtgtggatcaggaccctgctgctgatggagaaggctcctgcagccgtgatccctggcccaggagaagctgtgatcctgggcctaacgcctcactcaatggctttaccctttgttcaagggctgccccttatgttcaggcctggaagttgctctctacaggacaggaggtgcttgctgtttggcgtgagctgaggttgccctgcagagcctggggtcagtgctataactgggccctgtggcacccgtaaactcacttaatgaccacctggacattgggcctcatgctagggccgctgtcagcattctttatctgtgaaggcagaggacattggaaaaaccagttagggtgtgtgaggcatgttttatgttgatatcaagggagtgttggactcttggttcaggagcctggaaatgtatgcaatctggctttttcagaaagtcagccatgttgaatagggaagcaagacctttttaggcgtcacatctcctgaacaggcaagtgggcaggatgagagtttggggtttgctcctcttccctctgatgggaaaggcgtccagcgcgtcaccatgagcagcactggggtttggcatggtcaagaagtgttcactggcatgtgaccagagaccttcctaatggctgagacggagtctgacccagtgggcatggctgtgctcggccagtgtcatggccggtggggagctgtggtgacaactccaggaacatggtgccgtgtggctctgct

SEQ ID NO: 96008 - DNA, 1009 bp, Homo sapiens
ctgtgctgggttctgctcactggggcacagccactctggctttccatgctgctctgcaggagcacctggtgggcacgacccaggggaggcccactgggagaggggcagcctgctctgggcagtgctgtggttgcagcagcagatcctggaagacagtggatggcctggtggagttatccctgcctgggggtgtatcccagctgggctttctcctggctctgtgaccttggcagttaggtcacttggtgtgtggagctgtgtgagggctggaggacagtttctgtgtgcagcacggaatacagtgacctgtgcatgggtagggctccgtaggagggcgcatacgatacctgttatttggctggcccttgctgagtacttactattaatacgtgtgggcgggaagtacattatctcatttaatcctcacaagacttctgcaaagaacattttgcagatgttgagagtgaaatgctgagagatttaagaactcagctgtggtcctggagtgtcaaggggtctgagtcaaccccggtggtgtatctgacctgaccccagctccctttcccctcttctcctgggccaggctgtaggctacttagtctttgccattaacttgcactgtgaccttgggcaggtcagcacctctctgggccttagtttcttcatctctgaaatgggcacggtcctagtgtactgtgggttcttcagggtgatctctcaatgagaccctgggttgatggggcttctgcctgtcttacatggtctgcatgtgtttcctgctctatgaactggactcccttccccaaataccacctgtctgattggcctttgggtaccagcctgacactgggaaaataaataccaatcgctgtattgtgagcatccattatgtacttggaacagtgtggaggactttcccctcttttctttgttttgtatttttcaaattcagatgcaatatatccctagttgttttttttcaggccaatactgaagatatatctaattt

SEQ ID NO: 96009 - DNA, 1038 bp, Homo sapiens
attttagtatttttagtagagacagggtttcaccatgttgggcaggttggtctcaaactcctgacctcgtgatccacctgcttcggcctcccaaagtgctgggattacaggcaagagccactgtggctggcctattattattttgttattatcatttttaataaataagagacgaggtctctctgtgttgctcaggctgctctcaattccagagctcaaacagtcctcctgccttggccttccaaagtgttgggattgcaggcatgagccaccatgcctggccaaaagcttgattttgtagaatgctcctcaatttgagtctgcttgatgttttttaaatgatgagattgggcttatacatttttggcaagactactactgaagtgacatcgtatccccagcagtgcattggggatcatggtgctgatacgtcttttgctggtgctgttcaccttgctgatttagttagggtagtgtctgccaggtttctccactgtaaaattacctctcctcctttgtaattgataaataatcttggggtggaggatatgacttggagactgtttaccctttgctttttccctctcaatctttgcccacttattttagcatccgttgttggactgtgtccacaccagttattattgtaatggttgcctaatggtgattttctgttgattttcttctgtaattggaatgctactataaaagagtttttccttctctaccattaacttatttattcacttactatatcagtatagactcatggatagttattttattctgtgggtaaaactgaaatcattttgctgtttattgtgttgtttacattgttcagctgtggccatcgagagctcctttgggttggtgcttgtgttgctctgacatggcttcattcttttttgagcatttcctcaccttttggcactacagatgcttaagtctcatcttgtattctgcctgccccagctctgtaaacagtcctttctctaaggagcccccagtaactatcttccaagtgtttacttggattca

SEQ ID NO: 96010 - DNA, 1004 bp, Homo sapiens
gctcactgcaacctctgcctcccgggttcaagcgattctcctgcctcagcctcccgagtagctggggttacaggcgcccactaccacgccaggctaatttttgtatttttaaatagagaccgggtttagccatgttggccaggctggtcttgagctcctgacctcaggtgatccacccgccttggcctgccaagatacagttcttaaaaagtagttttgacacatcattcaagacatttttcgttaattgaaaagcctgctattaagtgtttataagcctctatggtagttactgcattattcttgtgaagccatcacaggtcctctccccttccttgtaatgatgtgtttaaagttctctgaaaacatggaaaagatgctgtaggcataaatcaaaaagtcacttaaaccactggatgcccatttctcagtgccgtgtcaaacaaatgccttgaggacctgtggcttggacatgtgtgtttcatagggatgtcctatcaccaagccgagtggctagttttagatatggtgaaaatgatttgaaaaacaaactctgttctcttcctctgaaaaggtccttccaaggggtggatagagagttgaacagaggtttgcaaacttccagataacttcctctttgtcagtggccaaaggtcattgtagacatatcttcccgaaggctggagcctgagggaagggatgaggagggtgtggagggatgacaagggatgtggaggaggaggagtccgggagagcagagaagagagaaccccaggcaatctgcatggggatttctggcttgagataagaaacaacattgcaaaaatgacttgcggtggggaatgctttgatattttctgtcaaaacaactcttgagtcttaagtatagtaatgaattttcataatatgcttactttcattcattcatggagtaaaatttcctattggttggaagaggatggtggcttggtgagaagaaagaaaagccacatgcaaaggcaagc

SEQ ID NO: 96011 - DNA, 1027 bp, Homo sapiens
aactttatgagtgatcgcttgtggatagaaaccaaataaatgtcttagaggtccctttgctgctagcctgtctctggcatggagaggatttctgtagatgttagctaactttgcccttttacctccttgatgggctgattgaatcagtgttttggggggtcattgagtgaaactagagtcacgaaggagcggtttcctctgttttaaagcatctggagtattcgagggttgcaggagtgcagccagcaccctgcgatgcgcgtgccgtgtcaccctgggccccggtggtctgcgtcgtctctctagcttcgccctggctctgtgcaggagccccctggggctctgctcctgacctctgcttcccgtgtgttgcagtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtagtggccagaggccccgggccagggcggaacccagaagtagtggggagctgatgcgaaaggcccatttgggccttgtgactttgttacggtgggtgaggtcgggcgaggtcgggctcgggaaagagaacaggtgcaggttcagattccattttccagctgtgtgaccccctccagcctcagtgtcttcatctgaaaaatggaaacatcagatacctcacgcgggtaacagggtaacactctgcattcctcctatagcccctccatggagcagatgctagcattatttctgtttttccctccctccctccctcccttccttctttctttctttctttttttttttttttccttttttgagggggtcttgttctgttgcccaggctggcatgcagtggcatgatcatggctcactgcacccttgacctcctcaacccaagaagtgaccctcccaccttaacctcccaagtagctgggatcacaggtgtagaccgccatgc

SEQ ID NO: 96012 - DNA, 1024 bp, Homo sapiens
gtttaaaaaatttaaaggcagcagtccgtggattattaacttgacatggtctgggcaaacatgaaattatgcaatcctcagtgttcctagagaaccacccgggctgggagtgtgccctgctctgacaaaaggaagacgccctgtgggggaaagtcgagacggccttgcacccttatttttcggcagtggatggtgacgggggaggcccacacagggcaggttttccaggtgtgtgctcaatgccaggctttttcttctcaaaattgatgagatgttgatggggtgtgtgccgggtttgtgttgtagagacgcttgtttatgatgtgcgaggaacagattgtaccagtgactctgtttatacagacaagtggggtcagctaattggattcctagtcagggacccacgaagggaagagggttatcaagataagagcactggcacttatttggcacttgtttatgtgctgctcataatttagagaccttacacaagccttgcctgcctgtaggtcattcatgttctcaaggaattctttgtcccttgtaagggcatttttaaaatgctgggttttttgtttctttctttttccttttttttttttttagagatggtggggtctcactatggtgcccaggctgatctcaaacccctggcttcaagcagtcttctcacctcagcctcccaaagtactgggatttcaggcatgagccactgttcctggcttaaaaaatacgtccagaaacaagttcctccctaagtcgcaggatgatgacttcatttttttttttttttttttttttttaatgtggagagttttgttaagaggtggaggaaaagaaacttggagcaaggatttcaagatttcccacttggataagaaaatagactgggctgggcgcggtggctcacacctgtaatcccagcactttgggaggccgaggagggtggatcacctgaggtcaggagttagtgaccagcctgaccaacatggtggaaccctgtctctactaaaaatacaaaaat

SEQ ID NO: 96013 - DNA, 1094 bp, Homo sapiens
gaaggacagcttcttgaaatacaatttctgtaaattgaaatttgtcacaaaagctgtttgggaagatggatgagataggactgacgataagatggcttgttttctcatataagcaagcgtctgctttgtcagtttctttcaaaagaagctatatgtgcagaatgtgtttcttacacattgaaaatgtgccaagtaccaaatctgtctcagacaccattcatccaaagctaacatacatgttctatagtaagcaagatagatgaaggatttggacaccaatttagagtttttattttaaaatttggtgtttctgagcttagacataatgttttcatagtccctatttgagtaagtctctttcattatctaacttctttatctttttagtaaataaattttgctattgagtttcagtgcctcattaatgaagttaccgtggtttgcagtagagttggcatttagcaaataccttaaagggctaaggccttgagagtgaccttttaaaattttgagcccattttctgtttccaagagaactccatgaatttgaactcttcttatattagaatttgtaatctgtttgttagagctggtacagaacctctcctttggtgattaaaaagagaggattaaataagagaattgatactacaaagagattctggggtcagtgtgagataaaaatcttgaggcagaaaacctggtttttagtcctgcgtctgctgttgtccagctgtccccagtttcatcatcttagtataaccctgaataagcagctctgctgtgagaatgaaagatattatgatatagaaatatgcttttaaaattgtcatatgctatacaaatgttgctacataaaactgttctcagacatccttattcatttcaaaagtgcccatttctcaggaaatagttgatatactaattataaatcattgtatgcacacttaatgcaagaatatttgttgctgccagtcagtgtgatgtgcatatagtacccataatgttgaagttcacagtaaatgttttatttaaacttgaaagaagcccaactgttttttgaagatattctgtaattgaggttttctgatcat

SEQ ID NO: 96014 - DNA, 1053 bp, Homo sapiens
gggctttggcggatacaggcatttcttctctttgtctgaagtagaagggaaaagatagcaaggaagggtgaagacattgactgttggtactggacagctggtctcgcacctctgctttcacagtgaacttggtgagaaggttggtggagggtgtgtaggctgaggccggacagcgaagcagggcggagggtgggaggggaaccgtgaaggaggcatcgcctctgggagaggaggcaggaagggaaggatcactgcgcaccactgagcaagcccctgtgctgggcatttcctcacgaggtgacgtatgtctggtgtgtttcaccagtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagacgtgagatgctggtttggccttatcttgcccctttccatgtaatggggtcacgatgtccttttcttattgggcttagcttcagctttactttctgggttgtgcttactgtttacatcaaaacatttatttgttcatttttcacatattttctgagcacgtttagtaaggtcatgtttttatcagcaacaagctgctgcttggcttacgtgcatggtctgcaactgggtttatagtagttgaggaaacttcattcctgcatctagttgctttaacacagaatttcttaaaactttattagcatagaatgtggtcttttaggatgtacttttttacttgtgagtttcatttttgtttcatatgtaattgagaaaaagtttcattttaaaagacctgattaaatgctacattccatgaaattccatcttggtccccccctacatatgttaagagttccaataattttaatcagtcaagtggcaggttccagaagcatgattctgatttttgtattattaatttaaaaataaaaaaagcttc

SEQ ID NO: 96015 - DNA, 1002 bp, Homo sapiens
gggccgcagtgagaagcccccgttgctggtctggtgcttgaaagcaggggtgtgagtggacagcctttccttctcaaggaaaggcttctgagcctttcatccctcagaaaacatcttggtaaagtggatcatcaaattacaaagtaaaggagatttaaagcgtaaagactagatgcaaataaatgcaggtatattgttccttttatggtagtttacggatttggtatttttacattgcagtactagtagctgtccttttgtcactggccatacatatttcaagtgaaaatctctggccttcttaatatttctgagcattcaaaggaaatgtccattacaagtcccagaagggaactgacagtgtgctgtgctgcaggtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacggttggtgtctcttttcttaactgtccccacccagaagtgcttcccttgtgctccctcccgtctggccagcaccaggcccactggtcagatgtaaatggagacgctgggtctgttctttctgcttagtcatttgttcaggcactacttaactgaatccctactgtgcgcttgggcacggggaacatggcagtgaacagaagcacaagtagcggggcagtgaggaaataaacagtcacacgtgatatgaagtagccactgccacagctgagcatgagggaaggccaactctaccatcaggaaggttttgctgtagaacccagggcccaggtaggccaggggtgtaggaacaaacaggatggcgagcgcgggctcagcctttgtg

SEQ ID NO: 96016 - DNA, 1012 bp, Homo sapiens
atgttggtgccatgggaaactgatacaatgttttggaactcagtaaaattatatttagcaaaagtgatttgcatattctttacccagtatggttaatctacactaaagaaagaactcaacagaagaaaaaaaaatgtcatttccataagatagcttatttcagcattatctacagtagcaaaaatattaaaggggaacatctgagtaaatcttttttaaaacacaagtagaggtagtggtgtgattaaacatggtggttacaaaaacttcatccacacgggaagtgcttgcactgtagggaaaggaaaacagaagccagcgtgcacaccgggttcctgctgcgtaaagcctgcgtggagacacacactgagggagtaaggttttgttgttaacagtgattagaattgggagttgagctttattttttaaatgtctgaaatttttaaaacccttctctttttttgttttttttaaacctcctgttcaatggcttaccttttttataaataatttttcattataatggtatttttagaagacttataaaaagaaacaattaaaaccatccatgaattttcttccacccagagaaaacctctgttaagatttgatttatacctttttagtcttaatttgtttctgtctacgcatatattatgtattatttttacatcttaattataaaattttgtttgtgggtgttagaaaccaaatgcatcccagcacctccactagattcaagtccaaaagaattgaaagcagggacttgaacagatgtttgtgcaccagtgtgtcatagcagcattattcacaagagccaaaaggcaaaagcaatccaagtgcccatcagcagatgaacagataaacaaaatgtggtatatacacacagtggaatgtgttcagcagttccacttatctgaggtacctagcataggcagattccaagagacaaagtaagataaaggttaccaggggttgtggggaagggagagggatgaggatgcagggtttt

SEQ ID NO: 96017 - DNA, 2012 bp, Homo sapiens
ccttcaattgttcttggttctgcaaatggtgctcctgaattgggagtttgagttggtttattaattgaaagtgagaaggaggaaattacctggcagaatcctttattttcttattttaaaaagaggctattgtaatagtgaagtgatgtgatctgaaatgaaatatttttaagaaagttcaggttaagaataatgagatgaattatctgaaagctgacattatctgaagcgacatatggaaaataatattgtgacatcccttaaaaaaacttgaacgttcccccagacttcctcttgtccatcccatcattctttcagttttttggattttttttcttttgcatgggctatgctgttatttttggttgttgtgattaaaagtattttaaggcatttttttacatcttgtatatatattttttgtttgagtcataatactcagtctttatatataaaaaatagtgtactggccagatgtataaatgccttgtccatacaaaagctagtattgtggtgtcctcagaaggagcgggggagcctctggccccttggtcatgcctttctcacatctaaggagtgttgcctctttgacagacagccttgtgaacatagaagaggttgaaatcttaaattctcttcaggttttttattctacctcctgtcagtttagacatggaatttcaacagcaaacctgttcaaggttcacatttctttttgtttgatgctcaagtcaatctttgagttgaattttttttttttttttgtgaactctccaaatattcattcatcaggaaaggtgggttttatctgggccatatttgcaattctagacaaatagctcccatctttgagattgtggtcagctcttgggctctagaacctaccagcaccagccctagaaaacacttggatcattgctacatcaagccagtagagatctggccactccaagtgagagctctccaaatcttaccttgctcatctgccccaactttttttttttttttttttaaggcagaatacttaaggaagagtatttactaaatgttcatcatttttacattacaggaaactcactttgggaatgtacaggattggttgtgttgcccttaggaaggatacttcgtttcttcagttactactcttttgaagaacaggaagattgcttttctttagtccttaaacagtgttgcatgcttacagccaaggattcttcgcgtgtccctagcaatcctcagtatagctcaggactattttaaaaattaaattagacgaattcatctgatcttttcttgaaactttcttgaaacaagtgacatttaaactaagatttttttttaacttgcccttggttgactgttgcttcgtgttttgcttgctttatgctgatatatccatcccatgcttttcttttatattctcaggatggtttttgttctcaggattctccctgtttcagtgcactttccagacatctaaaaggcacttgttgacaaactgcagtgcaccaaaaaggattgtttggcttttttgcttcatttcatgttttgctgtgcccaatgtctataaagacagcagtcaataacacttttctgtgaacaacaaatatttcttgcttttatgaggatttttagatgtccatccaggaatgtgactttttataaaatctgctttgattataaaactccaaacagaagcatgtagaagagtctgatattaatagcaagctcatgggtgagatgatgtgagagttactttctgggcctgttcatagggtggatctgactttgagtctagggttttttgttttgttttgttttaatagggttttatttgttttctggattggatacctgggagtataacctagccttgtgaggtcatttactttgctcctttgaaatttgcttatagtactagctttatttccaactgcccattcctcttaagtttgtacatttgagaccagtaacaaccaaactccttttttccatcttcaaaataagaaagt

SEQ ID NO: 96018 - DNA, 1050 bp, Homo sapiens
cccgtttccttgtcctctttcaggaaatgtcgagcatcctgaggatggggccatcttaagccccagtgaatgaatgaatctgatatttaagtatgccgttttttctcaggttgttcagtcaactacattttcactaggttatccagttagtcattcattcactgagttggtcttatttttcaacactggaaagatgcaagtgctcaattttgtctgtcactctagcacacccaacatcaatcatttgactccaggagtgcttgtatgatgattattcatttttggtttatatacacttaaaattggccttatgattctaagggaaaaaaaaaaccatcctgggcagattctacccatttatttacatgtgggttaaaagaccaaggaaagaatagaatatattctatatacagcccttgaataacgatgcctattctgcttcaccccagggctctccaagcaatacgattggccggacgccctcccgacacaccagcagcaggaccagccccctgacctcacccaccaactgttcccatgggggtctgtctccaaggtaaggtcacttctttactttccacagatgtaaagaaactaaagcaccttaattgctgtgcatcctatttctagatttttagactaagctaaataacaaaaagaatattgagtatcaagaaccgtgggttctagtcctcactcaaattgtaactgtataatcttatgcaaaggggttaacttctgtggtaagatgagtcatgtgtgctgaatgttctctcgttcttgtagctctaaacactcactagtacctaatagtacctacaactaaaagtttgtatttagtactgttttacatagaatccatgtagaagctcattacccattctgcaagtggtagaacctaaaggtatttagtcatccaagccaacttgttatagtcagttacaccaagtctagggtagtttttcaaccaagtaatcattctaaacatagttgctatcatgtttgaagcagaatgctgctctgaaggactgtgatttagaatctgggaac

SEQ ID NO: 96019 - DNA, 1742 bp, Homo sapiens
attggaaaactctgcctttcctctcaaattttgttttcccaaattaatacaaacactgaagtgtttggtaaagctttgttttgatctgatctgctagggagaattcctttctgctataagatgtgcaacattcaagacagttgatgtccctgggagttgtcttcaaatggtagcagtgagatgtgaagaaccttttacaaaccccacctctcaaattcctctatgagggtgtgtgtgagaatcatttcattttaagttgccatgtgatccttaaaataaattgccctagggttgcccattagaaaaagtcagcagtactctgagtttttcatctggctgcctaacggtcttgcctcttacgaagataacagttcacatatgccgacaagaacagtggcgtactccactttttgagtcactagtaaacatgagctatgccccaggcttttttaatgcatctctccagcccagttccatatctggaattacttgtttaatgagatcatattggtggtaatgataaatataacccagttttcttccttgcttggattccatattttaacctctcactgattcagagggttggagataaaatatttgaaaacagtaacagtctaattcgtggcaaaactctgatataaaatcttttaaaaattggatacttgggcccggcactatggcatatgcctataatcccagctactccagagactgaggcagtaggattgcttggagcacaggagttcgaggctgcagtgcactatgattggacctgtaaacagctactgcactccagcctgggcaatgagacccctgtctcttttcttaaaaataaaaaaatgtatatttaaatgatactttctaccgtttctagaacttggatcttatttttaaaagattttactttggaaacactctaagcttctaagttaataatttgcatcatgaaaagcctcaagttagcttggacattaggtaacattctgggaagaaatattgtctcttaaataaaggcagtggcacatttcacataaaaagcgtactattcaagaatgtaatcatatattttataactttcaaatgccattttcaaccaacaaaatttaagtgccaatatcttttaattaaattgatgtgttttccctgctacaattccaggctgctgctttctttcctccttgtagtgcattatttttctgcatgcattgttttttttttttctaacacctaatacaatgttttttaaaaatatgcaggttactttgcatgagttttggaaattgttctgttatgcaaatatgcatatcaaataaacagtacattaaattggtgaaatagattccttcagataatttgtttaaaatgtttccaaaatgaaatgcagaaaagtgtattttagtacaagtaataataatgctttttgcccatgtcataaaaatattatgaccacttatttaatttgggtggaaaaggtattaatgactgtatttgaaattaaaggggaaaaaagtaatgtacttttgcccaatactgtgattaatgaatgatttcaaaatgttaaaaaagtaacttttgattatatttttaaattcataattcttatttttggttaaatacctttgggtttttggatttcttttcctactccaggcacaaaatagtaattttgtcctaactggacctataattaattttagcattgtaaaagcattgaaatattttgtgatgtttatttccaa

SEQ ID NO: 96020 - DNA, 1095 bp, Homo sapiens
aatccctgagttcttgtttattatctgtaaaatcggaataataatacttgcctcaaactgggcatggtggcgcatgcttgtagttccagcctcatgggaggctgaggcaggaggattgcttgcagccacaggaagagtcctatctctatacataaataacacttatctcaggcattactgagaagattaaatttcataaagtatattaaaacttagacattttatttgcagttgcagctctgctattattgtttgaggattgttttggttttgctgctgctgttatttatggaataaactgagtaccagaattttttctaagatttaggaagccaggtgatcaatcaaagggaatgtggtaatggcagtagaattttaattatatgtttacattttggaatttaaaatgcctgtatgtttgcttatcacatgtgactctctttgtcaaatgaagcaacagatttagcccccaaaccttgttttgagaagtgtgggcaaaaaggcgtggcgaagaaacctagaagtataaagatgctgttggctagagcagggagaagtattaatacataaattgccttcaaaagatgagatatctagttgacttttaaaaaaatatgattataaaggcagcatgcctctagtctgaaagctatgggttttactatcaaatagctggatctcagcttaactgtgactgcgagtctctttcaagtcttttttgttgttgttgagacagtctcgctctgttggccaggctggagtacagtggcacgatctcggctcactgcaacctccacctcccaggttccagcgattctcctgcctcagcctcctgggtagctgggattacaggcacatgccaccacacccagctaatttttgtatttttagtggagacgggagtttcaccatgttggccaggctggtctcaaactcctgacctcagttgatctgcccaccttggcctcccaaagtgctgggattattacaggtgtgagccaccacgcccggactctttcaagtcttatttggacatcttccatttcatcacctgtagcaagaatactactttcaagattattaagtaaaagacct

SEQ ID NO: 96021 - DNA, 1334 bp, Homo sapiens
tgtggattttataataattcataaggatgatttacaagactggctttttgttcttctcacacaattacttaagaaaatgggagcagatttacttggatctgtgcaagcaaaagttcaaaaggctctagatgtcacaaggtaagtgtttaagggttaggtccattttgatgttacaggatacttgtaagtgactttttgccattctcttttgttacccatggcctttgtcacccccttgaatatctcttttactcagttctcactttctgttgttgacatacttgttgacatgtcccaccagtccatgaaatgaaataccatatcttccttgtgttgatattacttttgtgagtatttaagacatatataataaacaaatgtaaaactttggaaattgattctcttctcattaaaaaacatttaaagggaacatttagaatatttgtttacatttctctgaagaccttagtatttttattacttcaacttacaagtcttactagaaatttttctatcggtgtatgatgtagagtttccattggtccaggaaaattctctaaattaatagtacactggctagagattaatagcacatttgcagtagttgtgacccttctggctgttatgagaaaagaaaagctgctgaagcccagaaaagttagaaaaagtacatgctgctgctgttcagaaaccgcttctctattgtctatgcagttgtgggtcctcaatatgcaagtatgaaagttgaaacatctcagaagacactttgcaataatgtcttggttgtgatttggtggaagatggatggggggaatgtcaaattggtgaacttttttaaagaacaaaggaataacttccaagtcactcagaaaattatcagggcaatgacttttataagttactacaaactggaataattctagttatcatagaatttcaagatggaaggaccttaaagatgatgctcattttatcagtgagaaacagacagtttgccttgactttgtgttagtggctgtttgggaacgcaaatccaggatttctgaagattgcactgttgtctgtttttattgttgcaggctatcttgtgggtgtgtgtcctcacctcctgtgggggcaggggggtggtatggatagcactggaaccttctcttccctctctggctcccttgactagcacagtagcacatcctgccctgccggcatctccctatgcgtgcagcttttacatgactctgacttcaaagtatgcgtctgttcctctacaccatgatgccagctgttttcttttggcccttgaccctgtcagtctgtgtaattgcattgctctagaa

SEQ ID NO: 96022 - DNA, 1058 bp, Homo sapiens
ctctactaaaaatataaaaattagctgggcatggtggcgggcacctgtaatcgcagttacttgggaggcaatcacttgaacctgggaggtggaggttacagtgagctgagatcgcaccactgcactcctgcctgaacaacagagtgagactctgtctcaataaaaattcaggaaagactgagcttaaaggccacatagatatccaaagataaaatttatcaagatttttctctaaggtagtggtaaaagcagtaagatttaactcataagcataattagattcttaagatttataacgtgaacactattagatggtttagaacactgataaatttctgttacctgtcacccctagattgctgattcagaagcagaatgtgaggataaagaaggaaatttgtttccatcagaagtctcttgtacagtgagtttggaggtctcagtttagttagtatttgttagctgcctgtaagtgaagccaggaatcccacagctgaatgactttttcctgagctgtctcacaggagacccctggtggtgaatagttgctgtgctagaaatgaggcggtatagggtttgtggtttgtccaagtagaacaagtttcattaacaaggtagggatactcagtgctacttttctctctgaaattggttcagagatattccactgtgcactctattttgccttagcaaaaatcattacacaacagcatgatgattatgttaatatttttatatattttattctaagccgtaatctattactttatgatatctgaaattggtatacatcaaaatgtctgacgtgaaaagcaatagctacacaatagtgagtaggtgtttttattggctcattttataatagtatttgttgactgctagatagtgaataagaatactatagaattagggcaagaggatttgttgttgtttaagaaagaaaagccttcaggattaaacacagaaaagttaatttctctctgtactgctttttaaagacttacattgatggaggagagaatatttcattggtttgtagccttttcaggttttcttaa

SEQ ID NO: 96023 - DNA, 1325 bp, Homo sapiens
ttagaaatccttttatgtgggctgcttctgccattgacatttcaaattctgacttttttaggaaacataaatattcacacaagtttacccatagactgtgctcaagatatattgcttttgactggggaggggctgttggctgcacatatttgcattgtgccaggtgcccagctgaaatatttaacatataatttcatttaatcttcacaacaagcctgtatgataggtttaattattgttgtcttaaagatggggaaactgaagcaaaaggcctaggaggctttcagaagtcatgcagcccagtcagtgttggcaccaaggttgtgatctgtctgtcttcctgtaaagtctacgcactttactagaggccatactctttcccttctactacagagtgctttgcttatttacctaatggaaaactgcttttctgtttttatttccctaatctataagcacaggaaaagtgtgtgtgtgcatgtgtctttttacacttaactctttgttgtagattttgtttggtgtgactcacagtcatttcacctttctatttcttcctcaatcactcccatccctcattggacctgtcagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgaggtgaggaccacagcaagaatatgagctaagtttgaatctcctgttggactcttcaggggtttaaagggatttcctataattaatggagtctaattcctataattaatggagataccaagaggtctgcttgcaggaacaggcactaaaggtaccaagatgactaagacacagtccttgccatccatttgctttgccatccatttgctttgaaatatctggcaaatatcctttttttctttactttttttttttttttgagatggaatctcgctctgttgcccagactggatgcagtggcacgatcttggctcactgcagcctccacctcctgggttcaagcgattcttctccctcagcctcctgagtagctgggactacgggggtacaccaccacgcctggctaatttttgtatttgtagtagagacagggtttcaccatattggccaagctggtcttgaactcctgacctcgtgatctggctgcctttg

SEQ ID NO: 96024 - DNA, 1079 bp, Homo sapiens
gaaaaacataaatgatcatggatcctttaatttttttggttataccaaaaagtttcctagtagaatcagcttgtggtcagattgctttttaaagatgcatttcagctagtcacacagtctcttgcatattctggtttatgtgctcagcatttgaaatggatattctttagaactgtctgatcactggccttgctcttgctgttttaagatttattctcttgtaagggaaaaaagtatgtaatatcctgctttcagactctgaagtttttaatccagccatgttttgtcagatcaacattttatagtttatggctatggtgattccagttttcattccttcttgtcttgccctcatttattcctgctcagtcaggttctttgacaagtgtctgtgagcagtttgctgctctcctaatccttttcctgtaggcaagctgcctggccacctgtattcctcaaccttatgtatagaaagacttttttctggcaggtgctagagttcagggtaactgctctaaccatggctttaggagtcaagagctggaacagaattatctgaagctgtttgtccttccaagttgcagcatttagaatctgtatcttatttgttcagagaccctgggaagtggaggtcaaaggggtgggaaatgatggatgtgaaacccttagttgagacttccacttaaggcagggaaatttcttagttctttaaagaactgcataagggactgtgtgtaaagttctaggaggcggaataggacttgagagtttgagctttggcttaacttgactggagcttttctctgagctctagctcccattagattcatgctgcccttgttactttttgtccaaactgttgagtctctccaagtgacctgcttctgaagagaaaacacagaaatggtacagaatctttgcctcgctgaatagacaccacggcgccagacagaatgtctcagaggaatagatagtagaattaatggtgaccttagagatttgcctcaccgatatgggaaaagttttagcaaagaattacagcaagttaccagaaggtcttctgagacgtggaggagggt

SEQ ID NO: 96025 - DNA, 1058 bp, Homo sapiens
taaattgatttttaagtaatttttgttgacacaggcatcgtgacgaacaagtatctaaaattaaatgagcttaacaatagttaaacagaagtgacactaataaaaatttgcacagaaatcaatttaatacatttgtttcaaattttaagcttttaccacacattgcattagaactcttatgaaaccatgaagctttctaattagtttgaccaaacatcaaggccacttgcctctacagggaaagctaaatagattaaaagactcaactcatagcctagctaccttttataataagttcccgcttccctctcatatcagaaacttttcaataataaaataccatgtttgaacaatttcgagtgacagtgctttgtggcactatagcattaaatgtgaacagcttaacctctaccactggtaaacaagtcaagtgtagttaaaattggctagagacttttcagtacttctgtctacttggtgggaagaggcagtagtccttgcaaggaattgaaataatttgaattaaagtgacacatcttttgcttttgttttttaaatagatcggtttgggcttggccagccaggaagaatacctggttctgtgaatgccatgagagttctgagcacaagtacagatcttgaagctgctgttgctgatgctttggtaagaggcacagtatgtatgtacacagtctttttgaaatactcatctgcatttctctctgtcctaacaggaaattgcccccaaatcaggttatgaattcatctttgaaactctttaaaattgtgttaatgttgggtaaatttatattgttattgtttgccccttaaacttttacctctgcacacatataagtgaaaatggactttacagaaaatattagcatcaagtatttcttatctgtgctcttcagtatcaaggagcttttgatgaccctggacttctcagatgtcattgggcttctttttttctttttaaccatgtttttttttctggcatttccttttttccattctgttgcttctgttgctttacagactttgatggcataacctag

SEQ ID NO: 96026 - DNA, 2268 bp, Homo sapiens
ttctaactgttgaacccccttcctgtgattttattttatttccgttgaagtaacattatgaacttctatgcttgtttttggtgcatggttgcatatgcatcacatactgataaaacatctcgtgagctaacaatccgtcttactgccattccgctctgggatgtagacggtgctctgtgactcctgctgttcttcatgttgcatatgtccatactggctgatagaggcttcatggcgtgaatataaccctggagtccgagttggttgatgcatacttagtttggagcacctttaagagcgcctttgttgtgcctgtgtgtttaatagctgtgtgagagccagctggccactgtgaagtttggggattggcacttgctgtccattcatatccagcaccatttcttctcgtgagaaaacatggccttgttggtagcagtctctgcatttcctctggactgtggcattttctgtctctggtacttctgtgttaatcctgtgggtgttgccattccttttacctgcagcctctcgacgtcattccaggtccactagtgctctctccactgctgaatctgttgggcagtcaggtgaacaagtgctaactgcatgacttggcttcttcatatgttctagtttcacacccatgtcaacatttgttttcatctgtgtcggctagcacttggcatgtttgcacctcatattttttccccaatgtgctttaatttttttaagttattgaatgtttatagttctgttaataggctgtagatgcttcatagcctgtttgacaacatcgtttctccagtgttcatatttacgttaaaacaacagggaagtaattcccttcctgccactctgtccccaggaaaataaccaaaattaggtattatttagggttcctgtggggcaagggggcatggatatcatccaacagattctttcccttccaaagtctttactccaaataaactgtcaaatattaatgctagttattgatgtcaagttcacatttttaaggtaccatttagttaacagcgctgcaaattatagcatacataatttcatatgtatgaaaataagtgtattgttctcaaagttttatggaaaaacaagatcaggattcaggtaatcaagtcaggccagaggtatcctttgcagcctgcaaaccccaaacctgctctctcagctctgtttagcaatactcaacatccactggttagccacagtggcaaaaagtaagcatacagtaatacatcaatttgttagatttaactgccactatttttatatgctaacagtccctaatgactacaattttctcaattgagtaaggcataatctatgaattttcagaccattgatggtaacaattgttaccaattcaccgagtctggtattttctcttttcttcttctaaatgaagccccctttgctttttttgtttgtttgtttttgttttttgtttttgaaacagggtcttactctgttgcccaggcttggagtgtagtagcgtgatcttgggtcactgcaacctctgctacctgggctcaagcgatcctcccacctcagccccccaagtagctgggactacaggtgcgtgccaccatacccagctagtttttgttgttttttgtagagacgggatttcactgtgttgcccaggctggtctcaaaactcttgggctcaagcgatttacccaccttggcctcccagagtgctgggattacaggcaaagccgccgtgcccagcctcctatatattctgattatgtacatttccctgaagattagggaccagactgagagcacagtcataggtattcatctcttggaaaaatcagacttcataatagtatcagagccttgagaatatggaacagactttgctctggcgaaaacataaagcttatagttttgcttagatccagataaacatttccccttaagatttgaaattcaaattgtctgtgatatatatcaaatgatctatagtcactctgtatggcaaagctgtatgcatcttggaagcacagaataattgcattgttcttatagttttaattttgtatctgaaaaaatctgtatattccctggagcaagaattgctggcatgagatttttttttttaaattttattagacttcgttttatttaagtttatgctgggtaattttttaatggcttataattgaattactttcattctgttactcataagtctcctactatctacccttttttaatgaaaaaaaaaacttgaacaaagat

SEQ ID NO: 96027 - DNA, 1022 bp, Homo sapiens
tagttttccctttcgtattctttttttaatcagggagtgttatggttctggtttataagacattcttgttatactttggctgtataataaatctttgctctcaaacaatagactatgctcattgcagtatagaaacatacttgttttgatatcagtgattcaagttgattgtttctaaaatgtcttgacattttttccagtccatcctctcaggatggaaacgtatattgtccccatcagctattacattaggcattccacctacatgtattcagtatacaaggttgttttggagtattttcccagtaatgtatttccattttctcagatggagaaacaagggtatcctggtcttttctaagcttcacagcccagttattatgagaccctgggctattcatgcaattctgtcttgtagtctcggtgttttataacatgagaatgattaactttagccgtagataatcagaaagttatttgctgttctcaggtcagtggagagatctttccccaaatactgagagtattgatctacttgctctagacacagtgtgaaagactgggtcagtggtggtgcttggtagagcacaggcagatcttttcagattttcatagaaaaagcagggataaaatgttgggatcagtaaaggaaaggataacagtccccactttttatatctgctggtttcgagaattggatatgtttgaagcatctacacacttacttggagtgggtaggctctctctctggttgtgtcaactcttatggcttctcttggtgaagatggccagcctgggagcagtgagccctcttccttatcattaggtaagttcatggacttcagtgaccagtgtggttattctgtttgttaatccaaattaaattacctttctaagaaacaagtgcatatgaatacagctttggttttttgtcctcttgttgagaagtttgctaagctcataaaaactgatcgtttctaaaaggcttttgatcttgtattttctgatgacagtttgttgtt

SEQ ID NO: 96028 - DNA, 1034 bp, Homo sapiens
tggaagtttgcccttgttcccttctcccactcctctatggaaaggctatgaaaacacatttgacatttttgcagctttcattctgtggatgtgtattttaaatgttaaggttttctggttaaaatactttgaaataattaaacattaataatagttcatttcaactgtgaaattagactactgtctaagaccaagacatgaaaatgtctagaccagagagacatttcatgtctttaacttctggttgtttttattaattctcttatattctgcttttatgagtcctggttggacccttccttaagatgtaaaagtcaagattaccattaaaacactgaagtagggtagagtgtctatcaagaaatgtaaaccaatcaaatgggtatcttacggcttcccagcatttcatgtaagcagaagaccccagaggtacctaggaatactgcttttttaggaagttcacagtacaagtatgttttcctggtctctccctcttatgccttctcttctgtaacatattttcacatagaacatttagtttggcacttaaagagacaagactattttggtgggattttcttcttttagttttgatcacctaattaattcatttataaaaagtcatttatatacttattttaggccgggtgcagtggctcacgcctgtaatcccagcacttcgggaggccgaggtggatgaatcccttgaggtcaggagttggagaccagcctgaccaccatggcaaaaccccatctctattaaagatacaaaacttagctggatgtggtggtgcgtgcctgtaatcccagctacttaggaggctgaggaaggagaagcacttaaacctggaaggcggaggttgcagtgagccgagattgcgccacacattccagcctggtcaacagaagaagactctgtctcaaaaataaaaaataggctgggcacagtggctcacacctgtaatcctagcactttggaaggctaaggcgggtggattgcctgagctcaggagttcaagaccaggctgggcaac

SEQ ID NO: 96029 - DNA, 1280 bp, Homo sapiens
atcaacagtgtttactgtgatgtaccaggcactttgttagacctgagaattagaagatacatgagatagatttagattctgacttcaaaaagcttgatatctattggggagaggtggaaatgtaacacagtatgacgaatactatgacagggtgcttcacataatcaaaactatgacctaaaaaaggagtatcttagacccttggccaccccagatttcttgctaggggaggctgcccagagtagattctgttttcatgaagtacaaaatgggattggtccgggtggggagatgaggggaaaggtttctagaggagagagaagcatctgcagaagcagtcaggcaagaggcagccacatgtaattcatttggctgctgtaaaggaagtcagagtgggtgggagttgggggcagagactggtagagtccagctcatgaaagtctttgaagcccaccttagctacgagaaggcaggagaagatatttaagaatggataagatttgatttgaaatcctatttccaaagcaagtagaaagtatttcttggttttagtaaatctctatgatgccaactttttattggcattgcgtagtgtggtctcttagctgacaagttatttgggtgttgatgtggatacaatcatagaaaaggtcacagctggaatatctgaattttatgtctgatgctgtaacatatttgtgtttggaaaatgcatttgattttaaatctaggtgttatgttttagctgtctttttccatagttaattgtttaagtttataggatgtctgtttgcaatccatgttagttttatacatttaaagattcttttctgttttgagattttttttccttttatattattaaagatgccattttaatcttcttcttgaaattgggaaataacccaacttcatttatctaacataattctaatgtgttccatggttttaactaggaagtttgtgttgtgtgtagttgaaaagacaatattttatatgtttttaaaacagttattatggagcatcagtaggaacttaagcctgttcccttccaaagagttatttgaaatattatttgaagaaagttatttccttgatgctaattaaagggatcagttacgtgtagagctttgaggtcatacatatagtttatattaaagaagatattttctttaaatttccacacattgcgagaatatatgcatataaagaaatctatatgaataaaatgtattttcatttttttcctgtggtattgcttagagattgcatttaatagg

SEQ ID NO: 96030 - DNA, 1251 bp, Homo sapiens
tgctaagaaaattgttatagttctacttctgctcttctagcagtgacacctaaaatttttaacataatcagctcttacagaattaaaaaaacaaaataagaataaacacctttgtgacatttgtagttatttactgtggaataaggaggctattccaccagtaattcttctaagtatattcttttatgatattcaattgtcttttatgctcctacatttaaaaaaattactaccaccaaataaaaatttatttttatataaaattgtgtattttagccaaattaatgtgtaaaatctggcttttgaaagtattatagttcattcctacatttacatctattattcattgtcattttgcttcacttttagctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattaggtaaggattctcaaagatcttggaataccattcccagcttggtcatagttttgattataatctaatgactatgtctaatgtaggaaatatagatctattttttgaactgaggatgtcactttgcctgggtgtgctttatacagattatggcatattgaggtttcagttagaaaaatatatgggacttaacccttcaaattgatgggaaggaattatgtcattgtaggcttttgtgttttgcagtcattgtacaaagcactggaattggggaaatagcagggtgtttcccccacaattagaagcagtgttgcttttcattttccttttactgattagcactaagtagacattaacctatatgaatttttcaaaaacagcatttagggtccacatttattttaattctgatcttctctaatctaattggtgaaacttatggtgaaaaaatatgcatagttacttttgacatagatttgtttaagcatgaaagctaggaattgattaaaaccaatacataatatttagttttgtgttacttagtttctttgtaatagtgtgtagaatcatgtgaattactgtcagccgcttaaataccttttgttccatttaaaatctaattcatacgctaactttttaaatataaaatttagaagtctttgtgatataatacaaaaaatctaaattcatactctatgacttctttacttcctaagg

SEQ ID NO: 96031 - DNA, 1108 bp, Homo sapiens
attcatagtcctgatttaatactaagtaggcttcattaatattagatttagggcccttaataattggcatattttaaatatttgaggtttatgggaagtcaggacaggtgaaactagttaacagcagtttctttcagttagttgatgtttattgagcacttactatgtggtaagcacttttgaagatggtagtgatacagagatgagtaagttacaatcacttccctcaggttgcttaaagctagaaagcagatgtgagcctggcacattgtaggtttgaaagtgttttatgaacagatctgaaataaatgctaatgtagaatgacaaagataaacataagtacaaaaataggaggaacaagtcctaggaaatatagctgttttgctaatgtatttgtgaacaaagacctttgtgttgtgttgcatgctgaccttctgtattgtgttattgtcttttaatccactttttgcctgtcctttggtctgctctcataatcaaggatccagatctgctaatcctgctggtggtaagccatttctcttcttgcctttttttgttgttgttgttgttggcattctccccgaccccatgttccttgcacaatattaatttctctctttattgtaagcttagttaatctttctgcgtttttctttgtgttcaaattctagagtttgaaatggatttctttcccctttatacatagtttaatagtttatatagctcaaattttatgggtaaaattaataggtcctgagacaaattcttcattggtttttataatgatttttcacttcaatttttagttaaatcattataaactattaatttttgtgagtattcacctacgtggttcatttgaatgatggtggttttgatttatataatatgtatttttaaataatatatatttaaaataaacacacatataaatttacaggtaagtgttgcttcaaatgctttcttcctctgggtcattctattctagtacatagtaaatgtatactttatattttagaatgtattgccttctctacttagggaggtaatctgtcaatgcaaatgattgccatttgagtgtattggtgtgatgcttaaaattttgtt

SEQ ID NO: 96032 - DNA, 1057 bp, Homo sapiens
ccgccgtgcctcacctattactttaaaatttattaatgtagtttaaattcgggagaaaaaccctcttatctaaaaagatcaaaacatcaaaaaattcaaacatttatgataaaaattgttggcaactaggcacagaaatgaattttctttttttttttttttcttttttagacagggttttgctcttttgcccaggctggagtacagtggcacgatcttggctcactgcaacctccgccccggtttcgagagattctcctgcctcagccttccaagtagctgggattacagacatgcgccaccatgcccagctaatttttgcatttttagtagaaatggggtttctccacgttggccaggctagtctcgagctcctgacctcaggtgatccgctcaccttggcctcctaaagtgctgggattacaggcatgagccaccgctctgggccaaattttcttaacctgttggcagatacactttctgtgaaatttcagaaattctttttaaaaatcttgtttgagtcaacagtgcttaccctcactgcttctattttgcattatattacatgaccaagacaccacaataaaggcaaagaagtaaaagtgaattatttgagggtaataagctgatgagttatttgtgggtgttattctatttagataaccccaaatctgtatacaagtttagcagaatcctagagtgttaagatcaaaatataatgattccattcttacctgccaagaacagaaaatataatttaataaattataaaaataaagcaactttaaataagtctataaaaattgagtaagaactttgaaaaaatgatcagactttatcaaaagatattgacaaagttaaataaacatagaagatacaatgaatgagaagaccaatattataaagcttttccccttaacccagagtttcacataatgccagtcaacatttcaacaggcgttgttattgtgtctgcacatacatatggaagacagcaaagggcttaggaaaaggcgaatttacttgtcctgccaattagcaggatgtcttttaaaaa

SEQ ID NO: 96033 - DNA, 1062 bp, Homo sapiens
cacttaatagattataatacagaactgaagtatatttgtactgcttgttgctttatttttatttattgtattttgaggtggggtcttactctgtcacttaggttagagtacaatggcatgatcatggctcactgccgccttgacttgccaggctcaagtatcctcccacctcagccttccaagtaactgggactacaggtgtgcaacaccatgccctgctaattttttgtggagatggggtttcgccatgttgcccaggatggtctcgaactcctggactcaagtgaccctcgtgccttggcctcccaaagtgctgggattacaggcgtgagccactgtgcccagcctgcttgttgcatttattgaaacttttttcccctaattaccacagagcattttatatcatcttttaaaaacatgcacaggtactcatagtaatattgccaaatcaatagactgaaaacaaaacaaaatgaaacaaaagacaccttttcctataaaataaatatatatctgagtttaacacaacagaggccctttaagctgtatagctgtgttcccaaaaaagtaaggaaatgttcaaaaccaagaggatcacagactggaatgacaagcttgaactgatttttaaggctgtccccgagggcttagtttttttttttttttttagttttttttttaattatactttaagttttagggtacatgtgcacattgtgcaggttagttacatatgtatacgtgtgccatgctggtgcgctgcacccactaactcgtcatctagcattaggtatatctcccaatgctatccctcccccctccccccaccccacgacagtcccagagtgtgatattcccctccctgtgtccatgtgatctcattgttcagttcccacctaggagtgagaatatgcagtgtttggctttttgttcttgcgatagtttactgagaatgatgatttccaatttcatccatgtccctacaaaggacatgaactcatcattttttatggctgcatagtattccatggtatatatgtgccacattttcttaatccagtc

SEQ ID NO: 96034 - DNA, 1374 bp, Homo sapiens
taggttattatcttcagtatgttatgttcagtaatttttggagattttgatgagggaaacataatgtcttttatgttgcacatgaggaagtttatgattagatgtcatatggtaaatgaatgcattctcatacttttttaaaaaagctagtatgcttaggaaaagcattcatatttttcccaaaataagtaactttaaatgaaaagttacagtgctttgaatggcctgtggggctgacaaccattgtttgtttggggaataatcatgtttattaagatgtagtcaaaagccatatcaacttaactttcagtgattttaattaagattacacgataaaaattatatagccttgtcttctcttcaggaaaaagaacttagattttagtacaattttactgggaaataaaatgtaaaaaattatccaagaactgtgaattttaggtaattgtcctttttacacagtggaaaaagtatgcatgtctatatatagaagtaaaagggtgttaagcttcttttaaatttttaaaatatgaaggaaatttttttttttttaaaggcagggtctcatttgttacccaggctctggagtgcagtggtgctattacagctcactgcacccttgacctgccaggctcaagtgatcctcctgcctcagctccccaccctgtctgtcagagtagctgggactacaggcgtgcaccaccacgcctgcctggctaatttttcaatttttttgtagagatggggtctccctatgttgcctagtctggtcttaaactcctgggctcaagtcatcctcctgcctcagcctcccaaagtgctgggattacaggcgtaagccaccatgcctggcaggaaattattcttttggggagaatagttgtaggtagcaaaatgtagaaatgatcaagttcctctgttttggttctgtaaaagatgtcagtgtatgagtaaaggctgggtttaattatgcccccaagcagtgaaacgtacagcagatatgtatgccaaaacgtcccagtgtgatgagaacagagacttactttgaagaccttttaattttataatctgtaatttgggaatttgctagaaaatttgaaacacgtagggaacagaaaaaccctagtgacataaggctctctagtggtttttcatttgcctaacaagaagataggaaaaccaggcctacaaactacacttggtacgcagggtgaatttctcctggtttggagtcttttctagaaggtatggcaatgtgagtgaaaaagaatccttaggagcagtattaaaaagtcatgagatgaatgatctttctttattccatgaaagtcaaaggctttgggctcctcttacaagtctttgttttcctctggg

SEQ ID NO: 96035 - DNA, 1331 bp, Homo sapiens
tagatccacctttagtatttgtaattagtatttgtttcattgttggaaaaagtgagtaaaaatcagcctcagtatttttgtttttctgtctgtattatggagtgtttgaatatggctggtatagacttcccccagtgctagtaaaagccctcacgtcttttggtatgataatatggagctgacccttcagaagcactgatgataagttttcagtccagtattaacctcttcaaagaacgagactggagtattcaaattctctgtttcctgagaattctacctcaacttcccttattttgtccccaaacaaaaacaccaaaaaattgaaatatagcacaatcctagtgagaatttgttacagttgctacctaggttgacacatgacatctttgcaaaagtgtagcattaaagctgatgatccttttccaaacttctagagtccagacacatgagggaagacatggagtacataggcctggactcaggtaccatgctcgacagcttttgctgctggacgtgtagttgggataggcattgctagagcaagcttctctgagcttcttacttggctctgccttttgggtaactctttagtattttagcttctagttcctcctctctgccctgttctgctggtactttcttccaagaaaaaggaactcttaagaggatgagagttggctaaaacaaaaaataatctttctttcaactgtggcactaccctgggttgcccgtctgtgttttattttccaaaggcaaaaaaaccattatgctatgttaagctaatttcaatacaaggcacacttacttgcttcagactctgctttgctgttgaacttgtttcccttttaattttgttttaaattgtacttttgcttttttagtagctaataacattcggctttttaattttttgaatgttactaactgttccctgttatcccttcccttgttttttaatttgcttaaagatggtactaccactaaagcggagggtaagcggtttgtttctgtgattgaggtgtgtctcactttctctggtcctctgttctcaccgagtgttgcccagtacccacttgtcctcaccaaggtccctgcatgagatgttgcacgctgtttctcctcctctcttttcattctgtcgccattgggtttttgccctacctctacctgagttctccttccctttcttgttcagtctttgttcttgtgaattttagcactaaagtatgctgcgtgtggtttttattgctgagtccacactctggggaggagcattgatgtcacactgtgtgctactgtcctcatggactgcctgtcttgggttttat

SEQ ID NO: 96036 - DNA, 1026 bp, Homo sapiens
tgaggttgagagaggataagtgacttgcccatagtctaaaagacagtaaaattgtgaggccaggattcgtaccaggtctcctttgtttaccctctcctcctgctactattagcggctaaactgaggcttccagtccttgaaaatcttctgtggtgtactccagagttcagcaaaagacctgtttggatccttgaattagaccaggattttgtgtgtttcctctagatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaagtaagagattcatctttgcttatcattcatgtgagaatttgtatttaaaagtttgtcacatgaaaacacaaattctagctatgtttttacatgggtgcttgttaaaacgcccccttacttgaggtagatcctggtgcaaagtaagataccaccatggagtggtgagaaataggttgctttggtctctaccgtactgtttttcagttaaatgtatacggcagtcctagaatacagttttagaataacataagtgaattatggagtagtgtgaactatacacaccagtgcttcagagtcttctcagaggatgtaagtgtgaacctggagacaagtttggaaatggaggtcattcaaactctgtgacttaatatattatcatctctgctctgtgtttctaatttctgtctgtagttactatttcactctctgtatttgaaaggcagtccaaaatagattgctaaagcttcgttgggaatcagggagtttacaacattgtggttcacattgcccaaaaaattctgaaaactctgaaataattcttcattgtaataatttcctgttgtagtttgtatttgtattaattcaggtacagtacatgtaataaataatatacatctttacttttagtcgtcc

SEQ ID NO: 96037 - DNA, 1561 bp, Homo sapiens
agctgaaacaataaagaagggaatacatgatgctgattccgaagcaagaatagaagccagaaagtaagtttttattgtacaccactttttaaattaacttcttctatatttcacatgaattataggattgccttattaaaaacttaagttacttgaacatatttgttaaccatgacttttaaacatgacccccaaaaggccattttggaatatttctctctttttttaataacatcactcaagcttgtaaataaacaggactgagggagacaaaagaatgctcgttttttacattcgtcacaaattatcacatagctctggaaggcagttgtatacatgctcaatgtattcttttactcattaagccatattgtaatccaaagctgctttaatgatttaccatgaaaaatcttggtcacagggaattctctccctgcagtcacttctttgcaagcatctgtggttccttggtgtgaatcatattaaggggagttggatcgactaatgcctgggattatcacagtgataacttgttgtttctgtctcaacaagtgaggtacttttgccattaggactgagtttcctccaattatgtggccatggcctctgtattcgttacctccttggaaatttttttttttttttgagatagagtctcattttgttgcccaggctggagtgcagtggtgcaatctcggctcactgcaagctccacctcccaggttctcgtcattctcctacctcagcctcccaagtagctgggactacaggcgcctgccctcacgcctggctaatgttttgtatttttagtagacacatggtttcaccgtgttagccaggatagtctcgatctcctgacctcgtgatccacccgcctcggcctcccaaagtgctggaattacaggtgtgagccactgtgtccagccttggaaataatttttgccagtgtgactgtaaataccagaattttgatattaagacattctctcttgggcagtgcattgataactactgccagtgttgcatctgtgattttttttgaatttactctcatagttgaccaactctcctaattgatatgtgctaaaatctaattgtactagcctgcaacgttacggttttacttagctgcattaatacatcctgatctagtacttattgctctttgactgccttcacagttaaattatatttcacttgtttctgagcttattataactatgaagtgtttgtgccaattttttctttgctagtttctaccaaaataagtgatataattaatcgttgctaaaaactattaggaatggatttgttaataatctgtttatgctgtttttatccttgtattggaccctccccacccccggcccattttttcttggtctttaattataatgtgatactgatttcaagtagctctgaacattttaaaatttttcttttgcacatgttacctaaggcaattttaaatactttgtgtcaagagatgtaaaattgcatgtataatagctgccattttaatgagcctatcctgtgttctaggtatggtcttagatgttta

SEQ ID NO: 96038 - DNA, 1033 bp, Homo sapiens
ccattttaagcactatttagggccttagcatgaaaatatggagagcacttagtttttcaaggtacttttaactttttttgtgcaaagcattctccgaaattaatgcaaagacctgattgtgtcatgtttgttgatcttctgtgcatgtgtacattctctattaacatattacttaggatagtataaaaatgaatgacagtggtaagtcctttcagtgatgttgccatgaagtgcaagcttctgattggagagaaatgcttggatcctgtccctgtgtccctgtggcactaataggtgcttaattactttcatttgctttggtttttagtcagttctgattcattctttatgttctgtttttctaatcataaaaatcagaagaaatgtactaattataaaaaatagtattgggtcacttaagaaaaatgccgttttcattttcactaaaatatgtattaataagttgtgtatttcttaatactttttaggcgctgttttgaatttttagatttgcttttacaagaatggcagacacattcactagaacggtgagcatctgatttgaaaccatttttccctctgaattgagcctttagagtgaatgctttggtgagtggtccagctggctttctgtaagaatggaggaatatatgcgtttgttttcatgactacgtctgttgttttactgatgttggccacataatattcacagacgcttttagtgaatttcattggttgaaatactactatgtccatgtgcattctgacagctgcagagccaatgtaaactgttactgactctggccctgctgcttgacattcctgtcagttcccatgaggtaacagtttaaagttgctgttagtagacaagtgttagatccttcaaggaatttcactcatttgaaagttttctttttctccctctgtatttgatgtagacagcctatttaatgttaaggtgattatttcacagtttccatagaaactagttctgatgtgaaaaacacaagcttttgttgtttgggttcgtaaa

SEQ ID NO: 96039 - DNA, 1041 bp, Homo sapiens
gcttcctcttgagagagctaattatagtctagttagtaggctgccacatttcttactcccttggaggagaatctcaattagcagggagtgggtgaatctgaaagcctgtcaggatagcagcttcttcaaagtgaccctgctgcagtgaagcagagagatagttgtcttttctttagaaaatgaggcattttctccccattgggcttctatccatcaaagcctgcctcagaagaagagaaggaaaagctttgtagtttaggttctggctttcctggcagataggcaatgagcagttatttcttagtttctgtgactttttgttggtcgttatagatgagtgtttaaattttccgagcgaacagtatggcccaaagcttctaattacaagttccagacaccagacttgaattcatgtttgtctttagattgatatctctgcccctcatagccaaacttgtagccacagtggtatattccttctgatctgtctgtggcttgttgcttggtatctcccctatgcagcctggttaaagttcagttctggggcagctgggctctgctggggctttcttagggacttcagtggaggctgctgaagggactggttctgacctcctagtgctggccctggctatccctcagcctctctgcagcatctggacctcagtagtagacctgttcagcttctggaagtctgctagtttgcttctaaggccatggatgattgtgtttgtaatctggctttatttttactgttttactgctatttttcccttcattatgtctacttatttggattgccaggggtggggtgattcagggttggatgaaaattatagtatcactctgtagaaatttcatgagtcatttttaagtggtttatcctgatgctgtagaaggtggaatggagctcaggtgatttttaaagaatcaaaggaggtgatgcttgctaggaactgaaggcttccatctgcttatttcagatttctacccgagactatcagatgagagaagtggccctcccatggcagtctgcagtgg

SEQ ID NO: 96040 - DNA, 1047 bp, Homo sapiens
ctggcctccatatttgtgagctggatggaagccctgtgatggggcccaagaccctggccctgcactatttgtgctcagaagttccctgcatggtggtgtttgtgcccagcaaggctgactttttggcatgcaggacaaaggggaccatgggatgtttgttggtgcttataaattgggtgtgaaatttctcacacaatggttgtctttggcataaattgggcaatgtgattattatgtgggcagttggcttgggagctggggaacacagagggaagctgaaggtagtggtgagcaggcttcagtggtgggccgagatgatggagatgtggtgtgtggcacactcacttgacctatttgggctagaaaatgagcatatgatcaaagtgtgaggacagttatcaaataggtacttttagtaatatatctataatttacaaaaatctctttaaagatatcctgtaccttacgtagaataactgcacttatctgcacttccttctcctaaaatacacttgcttgaaacctctcatgatgttgattcctcctaagctttgctttcttcctgtttttagcctgcagttgtgtggcctgtatacccggccatgcatcagaatgtctggataattctctagacaaataatagcagggaagctgagtgccatttgcatttaggtttgtaatactacccaaatgtaattaaaagaattttagaaagctaactactttgaaattttgaaacaagttatttttggtttatgttaattctttataattatgtaaatacagcaatgagaactctagattgctattgttttaagcatatgtatgctgtagttatccaaaggtgttattaaaatcattgaaaaccatcaactaaaatatgattttaacttttcaaattgtaggactggaattatttagatttgaatgaacattgcaccaaaaaaacagacatattaatattaattggagaaaataaacccaaattcttgtgtgtgtgtatatatgtatacacacatatatatacatacatatatatacacacac

SEQ ID NO: 96041 - DNA, 1034 bp, Homo sapiens
taggaccaactgaagtcaggaacctggaggggagagcaggttttgagggtaagatgattataggtgattatagttttggacacttggacatagaattttgtttgtacgtgagtttgattcaggtaggtttgtatcttggagtagacttgagattgctattagaggattaagtattattggaacatggctatttatgttaaattgtcatcttctttctctttgtcttcgtatgtagcggtatggtatttgcctctctagctaaagagggttctggagaaagagatcattaaagcagagatggaagatttgaaggattatttgcacaaatggcaaatagctcttagtgtaattactttaaagtatgagagaacattctggtaggaaaccttttccaaatttggctctaagtttttccaactgacttacttttgtgcctatgtagtgattgtcaaaaagaattgggtcaggattgctacagtgataattaaaatgacatttccaaaagagcacagggtgtagatctgatatctgtgggatttgggttctgacatttataactttcagggcaagttggaaggtaaaataagtactgtgatcaaagggagaaatgaacatttaatcaatgaaaggatatatggtgactcttatgtaatatgacactcagagattatctaaggtgttgaaattttagttgttgacttctggaagtctcagttttcagtcatcagtttgcaaactttattcacatcccttagtgttgcttaaaactttcccctttgccatgaaataataaaaatgtaagtcagaatatgcccacttaaggcctgcattgtaccttttcagttcctttttgagggataaatgatgatttcaatgtcctactattctctaacctattaccaggaagaagcttgtggttgtcattattactataattatagtcacccagtctcgttcattactgcctttgtgtctttgccattcctaccttgcccgtttcttgccccagggagcttgcacacattattctcact

SEQ ID NO: 96042 - DNA, 2117 bp, Homo sapiens
gtttaaaaatttttaataccacttttaaagaagactctcttaaatgagtagagttggatggagaaggctcacacctccccccagccaccaacccccaaccctttttacaaaatcattgttagtctaggcttttattttggaatagggtggcagttgtcattggtgctgccggatcacactgaacaagtgtgggtggagagtttgctgatgcttaagttgctgtgagtaggtatagctttcagagcagtgtttttatttggtaccaggattactgacaatcatgactactgggaaaggtaggctattctaatatattctgaaaagtgtttataattattgctgcttggctaggaaatgcttaaatattttataattcctgtggtaactaaaaatcatggatgaaacatgggaaagattgttatgaatgttgttggtatttaagcagtgaaaaattgtgaaacctacagggaaataaacatcaatgttaaccttctaagactaggagagaggaagtaggcacagtaggctgaggctagctgtgtttttatcttctgtttatttcatgggcttttaatttttctctgcttatgttcacagtatgagggttatgaacataaatctatttgcaattgcaaggtatttgttaataacgctaagtggtcttgaaaataatctactggctagaaatttctaagttttcccagtaggtatagaggaaaagcataaatgatagcagtgcaaggatgctgcttctgtcttaagtcattgtttatttttttcccctttaaaagatttgcatttttaaaatgcaaaaatgtacaggaaaactacaaaagaagtattgctcacaaaaaatcttcttgattaggtttcagtctttccacagagctttttctcaggtttggccaatatcgaagtgattttaaaagattctgtgtaaacagggtttgcatttaaaggtatagggtacagttgatgtgatgggaacaacctgtatcactgtcttgctttcctagtggttttgctggcagactcttaatttgttgtcttcaaagggtatttccagactcttctactgaaacaggtattgcacagagtaaaattgcatacagtaacaagtgtttatttgtctcctgctgtggggaattgggcacacatccaggacttctgctcagtgtttattttgtaatggattattaaaggtttgtatagctattttcttaaatttggttaagttgggctgaaagtactggaagatgccacatttctgctcatatttttaaattgagaatttaaagtatatttgtattctttaattgagaatttaaggtatacagtgataatatttttatttcatacctaagtatcatattctattttcaggttaaactgctgcaggaaatcaatacctgggcaggagagttaaataattcatgttctgaagtaacctctctcagagcctttcctttgaggatttgaaagtgtgtcacttacaagtagcatttgacttaagttgtgatattttcatttgtatttagcaacaggtcaaaataatatgagagtcagctttttcatgttaaaagccatggagatagcctcctgaatctgagtttaaaataaagacgattctttcacttgatatattttttcaaattgcctgcctccttagtcactatcacctggaattcaggcttacatgctttggtaacttttaccctcagtaactgcagtcgtgataggaaacaaggattaaaatactgtttcttatggaagtggtatgtctgaatcatgtattaattcatgaccattaaaaatctgcaaaatataacagcagcaggtctcccaaggtgtgtagagtactttagtgttttcagagcactttcctgcgttttttgttttatgaagttcacagcagccccatgaggagtaggtagggcagcttttgaacacagatactgaaggttttgggttttctataattgggttagttgcaggacaggggagagccctagtttttgctgtcttagacaagtctttattccagaaagccattttgtcaggccaagtgctctggaatccctcagactgggtatgagtgccacctctgcatgggcagt

SEQ ID NO: 96043 - DNA, 1003 bp, Homo sapiens
gaaataatagaaaattgatatcataattcagctattaccatcaaaaatcattttcgctatattttcttagttcattttcctgtaactgtataatttgtatataattttaactatggtgtaattttctctcctttaccctgtactttagcttacatactttcagcttttaaaaacatatcattggtagagctggggccagaattctggcatctgagtggtgcactcgtgatgagtggggttgctgggtgtccacaggcaggtcttcacaggcagttagttgctggacatgtggcttttacttttgtgtgggtgtatttgtgtcatttgtgtggtttctcagtttaaaaattgttggcactaggacagaacatgctgtgcaagtaagtaaaagcagtggcaggaaattgagtttgtgcttcataagccagtatgacagctatgaaacagaatctcattatagtgctggcattggggagaaagactgcatccacactggagatcttgcctaaaagagtgtgtacatataccctatgggatccagtgatgtgacaaataggatttcaccctcaggaatgccaaaactgtgtggcattggatatatcacaagcagcattttattctaagtggctaggtataaatattgcccccaaattccctttatgtgtgtgtgcacgtgcacacacataggtttagggttgaggatggaaacagttcttttaaacatctatgctaaaaatagcaaatggtaaggaagccttaacaaaatttcttggaggccgataatttcagctttttgctttgtatgtgtagtattactgttttaattgttagagccaaaatgttgaaggaaactgagtactatatagccatatgtataaaattttagaatttctaacctaaatgattttcatctctttacagtaaatttgagagaccagtaaaatgttcaattgctgtcaaaaaacaaaccacctgatttccttcattgaacatttagatggca

SEQ ID NO: 96044 - DNA, 1074 bp, Homo sapiens
atctcaacacttactccagtatacctgtgagaaagcctcttttttctttctttttttttttttgagacggagtttcgctcttgttgcccaggctggagtgcagtggcacggtctcggctcattgcagcctctgtctcccgggttcaagcaattctcctgcctcagcctccctagcagctgggattacaggcacccaccaccacacccagctaattttttgtatttttagtagagatgggatttcactatgttggccaggctggtctcaaactcctgacctcaggcgatccacctgcttcagcctcccaaagtgctgggattacagtaatgagccaccatgcccggctcaagaaagcctcttttttcttaactttttctactaattatgattgcattctcccaccttttcctttcatttttggtgtcactaggatggaatatttagactggttaaggaattttgctttaatttaaatgccaaggtgaaatgatccattaatagaaaataaatgtaatacagatttttttttaagctgaagattatccagtcacagcatttgtttctagagaaatcatttatagcatttttggattaagcatgaatcacagcaataagcacaagcctttgtaacgtactattagtgcattttgaaaagctccatcccaagttattgatagtctgcgctaagaaagaaagaggagaaacacacacttctcataagatacacattttgtgtagagtagtcagtaatgtcagagagcaggggctctggattactactctcagggctagaatctccaccccacacctgtgtcacctcaaggagattaaatgagatctttcagatagacttctaggcccattctttacccatagtaagtgctcagttattgttggctattgttaatgttattgattgagtcactgttttgttactaggtgggtctgtaccattgttttttttgatggggagtggggatcaacttcacattagcattttaatataattggctatgagcagtgatggttaatagtttgtttacatttttctttcatacaggttgaatgtaatt

SEQ ID NO: 96045 - DNA, 1061 bp, Homo sapiens
ggtgctggtgtgacctgttggtctaagtagaagactctcagaaggccaagttactcagtagtctcctcatcatctgagatggtcattttcatttgcagaaatcatgcacctaccatgtgccagtgggtttctgagaaactcagctgtatagtgctttaaatatatgaaaaaccttaattgcaggatagccttagtgtcttgagatgtatttgtgatattgacatagccatacttacaccaaacattggcagccctggagtagactatacacatactgccatataccagacactagtttcactaccaaaaatcaggtgctcctggactgattatggggaataataataataatacaaccgaaaaacaaaagtagtacatttaaatggattacatcttactgctgtataaatcataaatagattgtataattttaaaaatgatttatgaagaagcagagagatagttttttaaaataagatagaaaatgtgagacttgtctaaaatgtttcattaagccaaaaattcaagttagcacttcctgcctagtgtctttaatggcagttatactttttgtgccaggaagccctaggctttggtcaggagtttggagcctataatggttttgtgggctgagttctaggcctgtgtgtctgcttttgagaaacttcttattatttgttttgttttttcatttcccccacctcatccataagatgaggttggtactctacgggcagctttcagtattctgtagtagacaggatttacagctagagtattccaaattgagcactctgaaaataatccatatattcacatgtgccttaggaatgttttgtccgcacatatatttgcacacgtgcgcgcacacacacacatacacagacatacaatcaatccatgtctcccttctgccaggaagttctgccacctacctccccgatactaaccaagttaattattcctgcttctggggttcttgtgtagcttgcatgtgcttttgctgttgcctttattttaattttttcattaatctttcctactagtctctgaacctctag

SEQ ID NO: 96046 - DNA, 1056 bp, Homo sapiens
agacatttccggcccagacgcagtccgagagtccagacgcatgccgactggaggaccaaagagattagcacgaagaaggatgatcttccacaaaaagagctatgtacagctataatggaaaatactcggtgaggagaaacgaaataaaaggcaatacagcgtagccaaacccgggttagctgcgggtggagttcaagagcgcgccgcggtcccgcccccgccagccccgccccggcgagaaaagcgtatgcaaattttcgagcggccgacgcgcggtcttctgggtaaaaccgagccgccgcttttgcgacccttcgggagcctcagaaaacaaagaattggggtgtcgtcgaaagctgtggaggctggaggtaagctagctaccagaccgactagggcgaggctcacgaattaattaccacaaccctaccaggtattggcgcttcctgcttgcagcccagggactttctattataaccatccttttcttggggttgcgctactgtccaatgagcgcatagtgagggcagtactgctaacgcctgaacaacacacccgcatcaactagagcttttgctttattttggtgcaatttttggaaaaatgaaaacctgttttcatagacttatcagttcaaacagcagtaattcgtaaataaactagtactttgtggttaaaccagtagagggtgcacaagacgcgtggttttagtgtcgcaagtaaagttctttcagtttttgcggtgattaaacgggaaggatttcaacagaacttcacccctttaactttacgccgatcatcaactgttctgtaacttccttatgctgagtcagcccagtagtctaggtcaagtttcaataggagacgaagtttcagtaggtctttgcacctcacataaaatgtaatccaggtcgggcgcggtggctcacgcctgcaatcccagcactttgggaggccgaggggggcggatcacgaggtcaggagatcgagaccatcctggctaacacagtgaaactccgtctctcctaaaaatacaaaaaattagccgggcgaggt

SEQ ID NO: 96047 - DNA, 1026 bp, Homo sapiens
acaagtgcttttgagaaggtatttgtcaggatatgattaaagatgatacattatttatgttgtctgctacatgaagaaataaaagatttgttgtaaaaagtaatgcccttgttaggtatacagttgcagttctgaaattagggaagatcactggtacctcacagtgatttcttaatttttcttttggaattctgctcacaataaagtaactttgcatctttaatatatggacaatacccaagcaatattacagttaggatcagggatccactaaagcatattccactgcatcagtcccacttttttcccttaaattttaatctggttgctctaaaaagacaaaaataaaaatctgtagaaaatctcttactacatttaatacttgaactgtttcgatgaattttgccagtgaaatgagcaaacactggtatgaatttagcttgttttaatgacttcatttactactttttacatttagtttattttttcgtggtaattgctgcagattttctttttttgttatttttgcctcagacttttgagatagaagattatgaaatatgccatgccaaatgttcagagtttattagcaatgcagtcagagtaagccaaatctggcagtttggtttgatttctgctttatagtagaaggattaattcaagaggaagatgcttatttatcttcctcaatgcataatggtacatgtggagttaaagcatgttctttgtatattacaaacctcatagaatggagatcctttgactcaagaatgaatgtcttgcatcttcctctccccttcaccaacaaaacagccttagggagaatgagaattgcattagtggttgccagggactgagaggaggagggatcgggagcagctgctaatggataacggtttcttttgagatgatgaagatattttagaattagtggtgatggctgcacaacctgtgcatatactgtaaattacggagttgtacactttaaaaggatgaagtttatggtatgcacatgaaacaccaatt

SEQ ID NO: 96048 - DNA, 3147 bp, Homo sapiens
tttaatggctaccatttattccttacttagtttcaggtatgttctctgtcttatctcatgtagtctttataacaaccctgcagggtaaatagatagtggtatcctaatttttatacaggaagtaactgaggcttagaaataatgaggcaattttaactagtgattatggaactggatttaaatataggtctctgattttctggatagtgctgctttcataagaacagggtttagtaaacttttccttaaaacccagatagtacctattttgggctttgtgagaccatatgctctttgaaatattcaactaatatgaatcgttgtattgcaaaagcagtgacaggtaataggtaaatgaacaggcttggctgtgttccagtaaaacttgactaccttatgtgatatttcagaaaaacttgcctctctcactcagactcatattgggatcagtttgaattctgttagcttactgctaatcatctacagtgagctggccttgaactttctttggtagtagaagccatctgtgggttgagtaattggttatttaaataagcatacattcagaacagcactatgctacaccatggcggtgctgttcaacatggaaggatttgtgaaggttccctgttgtcatagtgaccatgggaatcctggaaggagacattaaataataaaaataaccccaaattttgaatatggctgtcctcattgatctggtctcctcttcctgtctgccttaaaacttgcagaaagggaaaagtggtggggataggttcttgcactcacttccagctgcttctgttcttccttcttccctcatcaggtgagaagggatgaaatgttaagaatgacctgtcttggagagaccgcctgggctatgcaactggagggaattggggggggacttatgctacgcagctttctcaggtcatcttgacagctttgattctgcgcagcagtgcagtaacatgcagcctcacatccacaccacaccagtgcaagtacctgtacctttactgggatcattggaaacaacgtttcttagcaggggcttggtgctttttgtgaatacagtcccacaggcctttctccgcagtttcaaaattcaaagcactctgaaagcctagtgtttttaattactaatttgccatttgacctgaagtgaactaacatgagactatttatagtctgtatgtacctggctaggctatgtttcactacaaaaatattaatgtgcttgattgtgagttgctgccccggattctattcaaggggctatattacacatacacacacacatacacactatctctctctccgtgcactattttatcttcctaaaaatctgaaaaattctttattccagaatatacctggcctctagagttttggataagcaattgtggacctgtatttaatactgtacaataataatgatagtctatggctgtggtgcatttactgtgagccagaaattgtgctaaatatgtgttcattttttaaattgtaattaccatatgaggtagacattatttttcccattttacaaatgagaagactgatgctcaaaaaattagctaacttgttcaaggtgataaaactagtaattaagatttctgagacttgaactcaagtccttatgcaacaaccagagttaattaaacacgtatgatgtgccagttgctgtacttacacagtagggaaaaactgggtacggtcccggcccagtgtctaagctgtctaggtctgtccagtctgtgtgggcttcatctccgtgtacatttgtctcaaggcccattccgtgctgccttatatttgaaatttgtgggttccctattaacccagagcttccttttcttctgccctgtggtctgattggaggaacggggagggcacatgagagggcggtgcacagtgtaggataggaaataagtcagtgctaaattgcatcataggaatttgtataaattctgtcatgcggagaaagaagaaacattagggtatgcttagttggagaggccttgacagagaagtgggattaaagagggttatgaagaaccaaaaggtgtaagctgcagagggttctgagaaagtctctcttcctttcctgtttctccctttctggttagcacttccttggtagactgtaaaagatgtagtctctcctaagctgctttacagagcacatgttaccgctagatcaagtgtgtttatgggcaggaggagactgtgttgacagataagggaggttcctctcatttcctttgcctatctccaaaaccttggctttcatcgaggtttttattttcccgcttgtgtccttgagaggagagccagaaaagattattggattcagattaagtgacttctgtttccttttctggcagtctcctcgctactgccaccaagtgacacatcttttcagagactgtccatttttttccaggttttccttgcagtgtttgtcctattggctgtaggaggtgaatttccatggtttaatctaaaaagacaggtgcctctgtcataagtagaaaagctacagttagcagcactaagcaaaagcaaaaaaccttaggaaaggttatgtcaagaaaatttatatggattgttggtaaaaatggtgtccttgatgtatgtaattagtggcatttcttcctaaatgtgtttacctatatgcaagggcaacaaagtgtactgaaagtattttagatttgagtgtgaattgtctggattcctcttctggctctgccactcatatatttgagcaggtagctttctctctagaatgtatttcctcatctgtaaaaggggtctgatgatatttactacatagaggattcagtaagcccatgtatataagcccatgtagtgcttttaatatgtagcatgtggtcagtaaaaggaagttgacgaaaatgtatattatgggaccaaatactcataaaatctgaggaaagttaacttttatgtgggactgaggttacatgttttcttgtggcctagtcagttagcctgtgctctggaacagaggccttgggtctcttgtaataagatatgaatccatcagttgttcagtgttgataataaagtccctgagtagagcagcagctggctgggaagtctgtgaagggtgagttaaaa

SEQ ID NO: 96049 - DNA, 2165 bp, Homo sapiens
tgactttgcgtgcccatcccagcaccactggaaaatgagtgtccgtgattgcctttgaatgccatgcttaacctattggtcttaagtgggggcctcccttgagtgaagcatgtgaccatgtgaaggagggtggatacttgaatagtatcagggtcctaataggaaaaggaggttggggatgggactggggtagcatggatgttaaattattagattggtgcaaaagtaattgtcttcaaggagctcatagtctatggagaggaaactgataaataaacaagttatacagtacagtgtagtgtgtgcagtaatgcaaatatacagagttctgtgggaagacagaagaagaaagtagtaacactgcctaaaggaattgagaattttgaagattggttagtttttccagaatgacatttgcagggttacaaaggaatgaaagattaagacttgactcttggtgaagtaattcctaaacaaggacagattagtgtgaaggaaagtcaggaagttggggtttaccactaacttgcttgtaaccatggacaactcagttaaacctgtttgtacaatgcagatattagactagataatctcttgggagccctcaagctctaatattttatattacttaatagaggtggtttttgcactcaagggctatgtcttatggtttgtaatttctctaagtgtagtggcagcctgcatgttcacatctggagcccagagtatggaacatcatgggtgctcaacaaatactggttccatgagtgatctcaggaacttagactcctcagccaggtattgctggttgctttactgaaacctggaaactaccttttagatcctgcttccctttttttcttaattataagtcaagatttttaaaattgaaaccctgaggtacagtttggctttatttggaatttttaaaatagataattcctttaatattttagattaaagggattagctttatattaaacaaaactttgaagcttggcttcttgaatttttttttttttttttttttgacagagtctcactctgccacccaggctggagtgcagtggtgtgatcttggctcaccgttacctttgcttcctggttcaaatgattcttgtgcctcagcctcctgagtagctgggattacaggtgcgtgccaccatgcctggctgatttttttctgtatttttagtagagatggggcttcgccatgttggccaggctggtctccaactcatgacctccagtgatccgactgcctcggcctctcaaaatgctgggattacaggcgtgagccaccatgcctgaccttgggaccttggcttcttgaatttttttttttttttttttttttttgagatggagtctcactctctcgcccaggctggagtgcagtggtgcaatctaggctcaatgcaacctccacctcctgggttcaagtgattcttctgcctcagcctcccgagtagctgggactacaggcatgcaccaccacacctggctaatttttgtatttttagtagagacagggttttaccatattggccaggctggtcttgaactcctgactgcctgatccaccagcctcggcctctcaaagtgctgggattacagttgtgagccaccgtgcccggctgttttttttttttctttaagggctgaaaagagaatggagaagtaattttggcttgcccaaacaatagtacttgcgtgttgttattccttttcttaacagggaaggtagatgaatgtcagctcaatggcttattaaaaaaaaatacggccaggtatagtgaatcacgcctgtaatcccagcactttgggaggccgaggtgggcggatcatgaggccaggagttcacgaccagcctggccaacatggtgaaaccccgtatctactaaaaatacaaaagtcagccgggcgtggtggcacgcacgtatagtcccagctacttggaggctgaggcaggagaattgcttgaacctgggaggcagagtttgcagtgagctgaggttgcaccactgcactctagcctgggcaatagagtgagactccgtctcaaaaaataaataaataaataaataaaaataaaaacgttggctggagcttgagtaactttgcatttaagtgtttctttacagacagatgtatatgtggtatca

SEQ ID NO: 96050 - DNA, 1584 bp, Homo sapiens
tgcgcccacctcctttctctttttgtgtctttcttttctttgttgtagggaggaggagatggaggctaccacttactccattgtaaagtagtgtgatgtaggtgctgcccttgactttgtttaatgtgaccaagccagccactttggtcaacagtgttttctatagagccttcctcatttcccatacttggtttttttttagaagactgagagtaaggcagtaagctgcagtacctacagtgattcagacacagagtggtgttagatttctggtgggaaatagaattgaagttacaaataaatatgctagctaaagcagaagattgctttcctgtctggtgcatttacaagctgggaaattctggaaaacatcaacctgccaactgtgtggctcattggctcttctttgggcttcgatgttcttcctgataaaaataataattatgttatttcgatatggttgccaagccgttcatgcttctcgctctgcttgtgattataaatgattctgcagcatgaattgctttgtctttgatttaatgtttcataacatttgggtgttatgttatctgtgctaatttgtcgttctcttctcttacttttcagaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtaagctgtgctttagaaggcacttttggaggtggctgggctgcactggtagatcaaaattggcccttataaaaatcccttgtgagcagtcagcatgcttccttggtttctagtaagacactcaatcagattgtggccttgggttatttcattctggagaaagtagagttttctttgatactcattgcagatcaaaaaattctcatcctttagcactttgacagaaggtcaagtgaacagataaggggaggcttttttgttggaaagttgacaagcatttgtagccttgaagttaatgtgtatattatgttttgcagcaaataggtcctgagaccttggtgagttgccctttataaataacaaatgtcttcactgattttctctgggggattgaattggtaataaggtgtggagcattttaccttcaggtcactgttgtgaagctggcccaggtacctggacagaaataggttgtcaaggacttttctgtgacctgtg

SEQ ID NO: 96051 - DNA, 1062 bp, Homo sapiens
ttccttggatttgccaacatggctgtcactggtgattctgacaagagctgctcttgtggagtgagcaagtgaagccagatcagagggtctgtggaggggacaggaagtgtgcatcagtggagctggctggtgtagacaacggcttaaagaagcttcactgttgatggtgtcattgatgaaaggcatgtgagctcaagagagggcctttgtaagatgagtgatttagaggacatttacaagctgctgggaatgagctagcggaggagagatcgctgattcctgggagcagacaactggaaggttataggtctgaggaggcagaaaggaggagttgttgtcatctgtgtgggtgctgaaaccattaaggaagctgagaggagatagggagggagtcagggagactggagtgtgagtctgcagtggaagacagggaaggacctgtgactgacaaatgaaagctggggctgccccggtgctgagctgcttggtgcttagcttagttggtaggtgcagtgccccatccttgcaattcccagttgaagcattactgagttccctcaggcagttttatcttccttcctcttctacctacagcattttctgcaaacttctggtttaagacttgtccccatactattttgactgtgtttgtctctttcttctttcaggcagtgaccttcttgaaggccttgatgaagtctctacaaagttttgtgatttttagtagttagcatagttcaatacctgtcagagtaaatgcttgctcactgagtgaatgtgtgggcctcaaaatgagtgggacagtgggagggagaaaaaagagaaggaaaggacagaaggaacaggtagactaagaacagacttcctgctggcagggcatggcagcgcgtctttcttcgttttcgatcatattgtaattgttgcagaaatcatcctaatacagaaaagattgtcttattgatagaaatatgctgacttagtgtgagtagatcctgctaatttctggctttaaactatcataccttctttctggcatgaaactaccataccttcttccagaac

SEQ ID NO: 96052 - DNA, 1029 bp, Homo sapiens
caagaccaacatgatcatctcaatagtggcaggaaaaacatttgattaaatccaacattgtttcatgataaaaaacattcaacaaattagaaatggaagggaacttcctcagtgtgataaaggccatctttgaaaacctacagctaatatcatacttaatgatgaaagacagaatgctgtcctaagattaggaacaagacatatagtctttaattttttaaaatttatatatatatagatattgtttatatagacggagttttactatgttgcccaggctggtctcgaactcctgagcttacgtgatccacccaccttggcctcccaaagtgctgggattataggtgtgagccactgcgcttgaccaaaacatgtatagtctctttgacacttagctttaacattgtattggaggttctagccgggacaattagggaagaaaaagaaagaaaaggcgttcatattggaaaggaagtaagataatctctatttgcagatggtatgatcttgtatataaaacatcctaaggaatgcactataaaactgttatgagctcctcaaagttgcagaatacgggatcaatatacagaaattaattttattgttacacatttacaatgaataattcaaaagtgaaaccaagggaacaattccattcacagtagcgtcaaaaagaataaaacatttgggaataaagttaacaaaagaaatgcagaacttagattcttttttttttttttgagacagggtctcactcgtcgcccacgctggagtgcagtggcatagtatcagctcactgcaacctctacctcctgggctcaagtgatccttccaccttagcctcctgagtagttggtaccacaggtgtataccaccacgcctggctaatttttgttttttttagagactaggtttctccatgttgcccaggttggtctcaaactcctgaattcaagtgatccacctgcctcgacctcccaaagtgctgggattacaggcgtgagccactgtgcctggccggaacttaca

SEQ ID NO: 96053 - DNA, 1107 bp, Homo sapiens
atttaacaagagtttaaactcccttagtaggaagcatgatttatgccagggagagtaggaaggagggatgcaaactatcttttgctatctccatccttctttatggagaagttgggctggtatgtatctgaatctatagctattgttctacttttgtgcatatattttgtctaaaaagcttgacagaagcagcattcttttcatttaataaattatcctccaggcatgggatcctattctgaggaagatggccctctaaaaaatgctctcaatatgagctgtctgggcttactgctgattgagcgtacctgttggcagtgattggcgtgccaggcagatttcctgtggtctgtgactgcgtttctaaagtaaacatagtgggaaaagcttgccattctgtctttcttttcagaacatgcagtggatttctgaagtggccaaaggaggatttgtttggacaaagggacagtatttagtttaattgtagagttactgattttatggagtcatgaaagaatgactaagcactgggagattagaaacatctcattgtaattatctggttactagacctcttttggggtggggtagggagactggaggtgatgcagaaagggtgtacacaaggcattaataagaaatgggcctaaaaacagagagtctttaaagaaactgctgacattaaaataaaagtgttattctagggtatatcctaggtaattactagagattgaacaaactgtgtaacttgatcaaaatcatcattcagcaaactttgctgttatgtttaagggcagagagaaaggctctcaagccttgttgccaaggagctccatgcctaagaaggaaggcagacaagtaatggttattattctgtgtattaagcgtgctactatgggaaaactgaagagggatgggatcctaagctggggttggggaaagagatgtggtcccttcctattttggcctgaaggatgtgaggctgtgaaccaggtgcacactctcctggtgggtactctggggtctggttttttttttttttttgagacggagtctcgctctgtcgcccaggctggagtgcagtggggctcactacaagctccgcct

SEQ ID NO: 96054 - DNA, 1108 bp, Homo sapiens
aaggatctgttagtcttaaaaacaaaaactaagcgaagtagaaatcatcgctgatacagtttttggtttgtaagatgtaatcttaaaaaatgaactaacttttttacccattgccagcggggcatcatcaacaaagtacgggtatatgtgtttgactaaatgacctctaaaatgctggcatttactgcttgtttctagcttgttcttcacctccccagggcttttctgccggctttatgcccagaccattactgccacacaatgattttcctccccaaattcttatgacagtcctcatcccacctcccctcatagatcctaaagatctagctcaggtgtgctcaaatggtgacatttcttccataacacctttgttaacttctgtcttgtttcctgcctggaagtttcctcactccttgctgcttcctgttgtatatatcaccttcctgcttacttagattcactcttgtgcatttactcttctctagatccttgatggcacagggagtttgtagaacacattgtgtgtcctctgttgcttactaagtgactaagtgacttgtataactaatggaaactgtagaatgtatgaaagaataaacaaatgtatcctaatgtagactaatataatttgagctttggaggagttgttagaggcccagtagtccagcatccttccttatgtttgctacattctgatcatcagtgtcacactgcaggcatctgtccctggacaggtcttggttgccagaaatgtttttagattactactacagtctgctccctccctttcacgtattgaccttagttatacttcctgaaggaacctgaattaagtctgtttcttcttcacataatagcacttcatatttcccatgacagatatcacacttctagaattattgattaatttacttattaaactctctcttgaattgagcatcaggtaccaagagggtacagttgaagagacatccatggcccctgcacttcaggggcttgcagtctagttagggagacaataacatgaatcgatggctgattatagtgaaggtatgcaaacagccctaaatggttagtcctttcctggtttgatatggctcaccat

SEQ ID NO: 96055 - DNA, 1098 bp, Homo sapiens
tgtcaccaggctggagtgcagtggcgtgatcttggcccactgcaacctccgcctcccgggttcacgcgattctcctgcctcagcctcccaagcagctgggactacaggtacctgccaccacgcccatttaatttttgtatttttagtagagatggggtttcaccatgttggccaggatggtcttgatatcttgacctcatgatccacccgcctcggcctcccaaaatactgggattacagaagcaagctaccgtgcctggcttcatttttaaaatttttttgtagaaagaggctctcatcatgttgcccaggctggtctccaactcctagccttaagtgatcctcctgcctcagcctcccaaagtgctgggattacaggcacaagctactacatctgatggcaatgtttttaatgagtctgaattcgttaatgaaggggaaaatttattatttttttttcccaatgactcccaagtcctactcgcaaacaaatacattgtagaaaaaagtttaattgctggttattgtttgaatcttgaaatacaattcttcactgatgatactggtataaaatggtggttattaattcatgctagcacaaccaaaactaatttaacattattggtaaaaatgagtcatttttgaatctctattaaaatctgaacacataaacaaatctgtgctaaaactggaactgccttctcactctacatataattaaacttccagcttcaaccatctgatgttgaaatctaaagcacctccatgagttaaatgtccccgacaaaccatgtagatggacaaacaagattggtggtctttaattgctggcgacagaaaaggctgcagtttagtacttaaacctgcagttagtggtcaactttctatccaggcagagtaaactaaggagagctatgaaatatcaaaagaaaactagaggccaggacaaagaggcaatgtcagccaagccactgcaagatggtatgcacccctgtatttcagccaagggcaggcaatccaaaattacacactgctttccttaacttgaccaaacagtgtatttttcctctgaaaatcttgtcaaaggttgtattccat

SEQ ID NO: 96056 - DNA, 1095 bp, Homo sapiens
agaccttttttgaaagtaggcgtgaacgtaattgtttcaggcactcttaagcgaagccagccggcgccccgacagccgagggtgcgggagctccccacggcccagccccagccccagaccccgctgccgcgcctcggcacgcccctgcgccccgcctccgcgcctcggcgctactcacgccccgccctccgctcctcgtcacgccccatgtcgcgcctccgcgcgactcacgcctctcccagtctctcggcacgacctcgtgccccgccctcgcccctggcgcaatttatgccccgccccgcgcctcgccacaccccgtgccccgcccccgcttctccgggcaactcctgctccaaccccgcgcccgactcatggccctccccgcccctcgccacgcctcgcctcgccttagcgcttcgccccgcccctgtcctgcctctacttccgcctcgggggagctgggagcccgacgtttccgggagcgccgcgtggttagcgtcggcggcttttggcatggcgactttttctggcccggctgggccaatcctgtcgcttaatccgcaggaagatgtcgagtttcaaaaggaggtggcgcaggttcgcaagcgcataacccaggtgagcaggcaccctggcccaggctgcgagcgggggcgatggaccgggtctagagggtatctggggttgcacggtttccggcccgggcgccccttgccttcgtgctcgccttcattacctccagggtctcccaagtggattcgaccgaatcagggaccgacctcttaagcttgcaggccacggtttccgagacgaaagggtttacgctgttcggtaaatgatggaggggtttggccgctgaggccctggagccttcatgtggagggtaacggggaagtattggggtgacagaagcagtagaaagaaccagctggagggaataggctcctataccacaggttatctccgggttagagctgtcacgcttccgcgtttcccccaaaaatgggagccccagacttaacacattcgggaagtttgtatgccgggttggtgatctgggagttattaaaatagagtatttgccaggttccactt

SEQ ID NO: 96057 - DNA, 1053 bp, Homo sapiens
atcactgttcttactgattaaatttagaaggcacaattgctcttgtcatctgtaatcttcagttttcttttttctgtctttttttttttttttttgagacggagtgtcgctctgtcgttcagggtggagtgcagtggtgtgatcttgcgcactgcaacctctgcctcccaggttcaagcagttctcctgcctcagcctcccgagtagctgggactatgggcgcctgccaccacgcctggctaatttttgtatttttagtagagagggggttttgccatgttggccaggctggtcttgaactccttacctcagattgatcaacctgcctctgcttctcaaagtgctgggattacaggcgtgagccatcgcacccggcgtaaattttcatactcatcaaaattagaccatatttgtcactgattaaacttaattgttataaattcgaacttgtaaaattaatgctaaatgtcatatttctctttatatattgggggtttgtgtaagattttatttgaaaaatgatcgcatttctaaaccgtttgaacatggctgtattaaacccatctttctgaaggtccctaaccttggaggctaaatgtgcttattttcatgcagatttcatgagcactggaggtttgtgttgcagcgcttggtcttcttggcagcatttgttgtgtatttggaaacagaaacactagtgactcgagaagcagttacagaaattcttggcagtaagtgtctttattagtgggatctgcagaatcaggcatggttgcttactttttggtggaaagggtggttgtactttgtttattaaaacaaacaagaattaactaaaaaccacttatagttgtagcttggtatctgaggatgatgcttccagagctcttccaatacccaaatctgaggatgttcaagtcccttatataactggtgtagtatttgcatataacctatacacattctcccacatactttaaatcatctctagatttcttaaaatatctaatacagtataagtgctatgtaaatatttttttttttttgagacag

SEQ ID NO: 96058 - DNA, 2682 bp, Homo sapiens
tttctctttcctggtacagtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcata

SEQ ID NO: 96059 - DNA, 1021 bp, Homo sapiens
caattacagcgcagaggcctgctaagaagtctgatgatttatgcaaaagtaatgtggcaagagcttgaagcaaatgtatttattaaagtaacccaaataatcagatcatagcaaatggagagaaaaaaaatccaaacctgtaattcctagccagtatttcattttcgtttacatttaaatgatacatcttgtggcaaattatttcagactttttctaccaggagaaaggggaagaaaaatgcactcattgaaggaaagctctgcaagaggcaaaagtgataaacttccccaagcctatttacaaatgcagtcaatgaaacagaattttaatgaattgtgccacataatccggcagttaatgagctgcaaaagcctttgtcaattgcagtgactgggaactaactctttcagtttcaagatcaataagagaattctctgctctgcgttacccaaaagggaactctggggagaaaggaagttgtcagaggaatgtcatctctacaggtcgcagcagcaaggccgccatctgttttgtgtgtctcctccatcccccctccccccctttatatttaaatccccacttcagactgaggagtaaaagacagtttggagatcaaacagcacaagtcctgtgaactgccaacacaaaatgacaacaaaaaggtttgaatgactctaaaaatatctcccaatattttagaaactgtattgagtccggacgctgttctggacctctgggagggggtaaaacccttggcattcactatttttgatagacaaaggcaatgagaagtgggttgttaaggattaaacaggcctgaggcatcctgctaatttgtccttccataacacttcttttatctgctgttttcattgctctgccgccaaataatcacattctttttcagaggtctgggatttgcaattatggtatgatccatctctatcacccagagttgttgctagggagatgtggttgtcgctatggtcctaatgccacaggacataagaaatcccaggt

SEQ ID NO: 96060 - DNA, 1052 bp, Homo sapiens
cagggcaaggctctcttaggtctttgaggacattgaagtgaaaaattcatgtgtatcttggattatgcagcaagtagcttcctaaaaactgtatgtgaatcatattttttaaaatagagtcccatttccccacggacgtggctatttgctcagagatgctttctcttcctttctgatttatctccaactggcagcagcaaactatgaccctagcttcacatttctctccttcccaagtggctcatcaatcaatcaacaaaattttcattcagagcctattatgtgtaagacattgttcatgatctgtaaagagaagagggaatgcaccgaatgcactaggggaacccgctctctgtgaatcctctataaaaccatgtgaatagtcaacctcttatttatctcttccgtaaattcagattttcttctatcatgttttcccaaagaggtgcccatgtgtactgaagagcctgtctaggttaccatagaaatagagagtcataaaaggatatttagaaatctaagcacttctataaatcgcaataatagcaatcacaattgtttggagccataattgagactattcgtggtgtgttccgaggaaaagcacaaataactcaccaatctgcaattcctggcaaagagagcgcaaactaggaaaaagttaataatgctttaaaaataagttgtgtcaggccaacataattttcctttgtgacagaagacagacttctacaactgcgggaaccacaggtcagccaccaccatctctagagcatggacttttcctattgtctgtggcacccaagacacttcaaggcctacctcagcagcttctactcagcttcagaagaaaatacccaaatttgtttcatatatttataattcacctggtccacaatggattctgaggcactttataaaagattgtgcagcaccaaaaggtaaatacaatcatccctccatatccacaggttgtgcatccccaggttcaaccaactgcagattgaaaataatcaggaaaaaaaaaaaacagtgaaaaataacaatacaat

SEQ ID NO: 96061 - DNA, 1043 bp, Homo sapiens
ggctgtttccgggcatgctgggacaaaggtggaagctggaagcaccacactgaccagtgaagaagcatcactggggtggtgctcgcaggaacaaaaggcaaagaggaaagagcaaggcctgtcctctcctgccctcctctctccctgtattaccccttagtgtggagcctaacaggaagcagctggcaatgcagaaatatagtctgtagaaatcctgccataggaccacagtgccaagagggtctggttttgaaagacagcagcttacagattggcacactcattatacgccaggccttccgccaagagctttcatatttcatctcagttaattgagtctttacaacaaaccagaggcaggtcttcctatccccattttaaatggagaaaatggaggctcagaggggttaagtaacttccccaacgtcacccagctggtaagtagcagggctgagtcccaaagccctcattttctctactgtatcacctggattcccaactatgagtgcactggcaagtcatctgggagaacacttgccagaaaagacacatcagagcaggaagggaagaaaagtcaccctaaatgaacaagatggttgctagcctcaaagtctgggccacacacctggaccctgtgtgtgacagcagacaccatccccatccatatccatcatgtgtccacctcccctgccctgagcagcctgttgcagaccccacccacaccaggctgttccgcagtggccgccatcaagaatcccaagtccttccagcagaagcaagccgctgcccagggctgggttcatggatgtgcctctcctgggtgatggcaagggatgcaaaccaaatagaagaaaattccaaatcactatgtcctgggaagattcctcaaagtctttgtaaaatgttcaggaagcattttcaatgttctttcatcgcagaagataggctgagtattcctatgagaagaggagagtggggctcaaagccctccagcccatgcagaagcagaatatgccctgtccttaaggaggatgcccacagag

SEQ ID NO: 96062 - DNA, 1024 bp, Homo sapiens
cacagtaatgcagagattcatgtgcgttaaaacagcagtcacttaggaatggtggtcattattttcaaggtagcagcaatgggaatcttctcctaaagtgatacatccatcccctgtcccagaaaccaaaagccagccctggtctcctgacagcagtgacaggagacagcatgctgcagccacccgagtgcctatgcccatgatggatcagtgggctgcaaaattaaactcctctttttagaggccatttgtgtgttaaggaagagaataaatgagataaccccacggccagttaaaaaaaaggcacccagacagaacttcatttgactctttcaggccaatgggggaaaatgagcttcgtaattgaaattgtaatggaataagttgggcctggtggcggtgaggacaacatgttcttggaggtcacgtcatgagaggtgacatgcaaaagtcatcaataggttggcaactcaaacgtttctgtgaaagaacaagagaaagctttctggatgccatgtgggggtttctggaccacagaagtggtctggactccagagcatagtgtgggactgggtcatagtggaattgttttgtaactaattacaaggcatgaccatcctttgtcatgtctgatttgtgcacagtcagaaccaggccccatctctcctgtccctcctaaatccacattaaggaggtacacatgccttgctttgactcttcctgggtgcaaggatatgagctggggtaatgttttctctcagttacacctttattgaaagctctctctgtgctggcactgggctggggacctcttggtgaatgacacagatagcttctgccatcagagcactcacagtgcacaatcataacaggctcctgtcaatcctagtggaagaatatcaggaccaattaattggaggcagagggcattttggaggaagcccctcaaattatcccatacagggtccagctgtgtagagtgggaagagaacttgctttaaaggccaagaggtatggaagtcag

SEQ ID NO: 96063 - DNA, 1529 bp, Homo sapiens
tttactggtgaggaaactgcagctgaaaggaatatcattcccatcttcttccatcagagcagcaggcatgtgggccccaaaggagagacagctcaatgcaaaagtacatcccccaaaagcttcaaaatcaccatgactaataccattatgattagttctcaaagaaaatgtggactgcttggggcgctccttacttttgcaagtaatatttatgacaatgttcatgtcttcaaaatcttgtcggaggccgaatgtatccatgcaatggcgctgggcccacaagacaatccaggtgttctttgttttctaaccactaaagccctaacctccaatcttccgttattgaacaaaccaatactcttgtactgaaagaagccagagcagcctggctaaagccatcccctgtaagaaggtggggcagactgctcccttggcccaaccctctctcaacacctgaacccagagaagccccaaccgaaagactttctacggtttgaattgagtgctttgtgtcatgggcctatctgggactctctgcctctttacagtgaaaaaaagaagagttttaaatattttttagcagaaagacagccctttctcattgggatttgagctgcaaagacatggccaaccaaacagaaacaggattatacctgaggaggatcttggagtaatcaccaaaatccacttctcttctccctctaggcaagaggaaggatttacagttaggcaagaccatgcaagcttgcaagatgtgagctgaagtgacctgtgttgcttccagcctaaagcatttaacccctgatgcaagaccctccagcgttctcctaccccaagcattctagcaagaagcccgtgtatcttagatggtgcagctgtatgatggtggaatctccatcagcctggatcctcaggagactgtgtggagcagggccttctatcagacatattgcacatgcaaagtgggaggtaaataaaggcttattatgttaagccttggcgatttgggaattgcttgttactatatcacaacctagcccagcctgactaacatattcatggtgtgagacccattccccaggagcagcagagctcaagggtgctcctctgttgtccttttatgttcactgccctttctgtaataacagtcaggacagtaggtgactcatgtttattatgctttggtaagtgcagtagatggcaaattgtactcaaacataagcagtgagagcagagagtaagctgtctactttttctgtactctcctccacacagagttaacattcatcaggcattcactctgcactagatatgttaagactattatttctcattccataatatccctgcaatgaaagtaggtatcgtgcatatatcaaaacatcatattgtggccggacatggtggctcacgcctgttttcccagcactttgggaggccaaagaggatggatcacctgaggtcaggagtttgagaccagcctggccgccatggtgaaaccccatctctactaaaaatacaaaaaatca

SEQ ID NO: 96064 - DNA, 1028 bp, Homo sapiens
cagggctgtgtcctattcacagctagagctcaaccttccaacgcctcatctatataaaagaatagtgaaagtttatccctcggggagttattattataaaatgagaaaattaatggagagcacatagcatggtatctggtgtataggtaaatacttaataaatttatttatttttattattgctcaacacattgttgaataaatgagtcaatggaaagattgatgtcattattacaatgtggcatatatgtgcccccaggaacagcctgtgggcaaaggcaggctactgactaaatgacttgtcaaggtcttttctatcccaataactttctgattttgaggcccatgaattacccaaacaccatcaaaactgaaaaatttacctccatcaagtggttgtcggccacagagattgataagagatgggaagtgctggtggtaaaactacatttctaattagctagaaaaattcgtcctgtgtgcgtgtgtaaaagggtctttagataaatgcctgtgttatctctccctcacagggcctgggtggccagccaagtgctgacttacttctgcatttcaacagaatctgttttgtaaatttgttaaattcttcagaatgaaactacttcctggtggaaactcattttctgccccctttcctgcctcttttctagttttccacctccggcatgacttgctggctctgtgggcagtgactgtcactctccaacatgttctctcccgtcccgtgaactggacttcccaatcccctcgctgacggtgtgggtggaagagagatggcttaagtggttctgataacagtggcaggaaaaaaatggtcaggatttttggaggacgagaggggagttacaagatgagaaccagctcaagatactggctctcggtggtgcagaaagtgagtctgagtcagggggattggggtgggaagagcatcattttcttttccctttttttttttttttttttttttgagacggagtctcactgttgcccaggatggagtgcagtgg

SEQ ID NO: 96065 - DNA, 1047 bp, Homo sapiens
gagcctggtgcagaatctacaagctggcctgcactgagatgcctctacgtggagcaaaatgtctaggttttgcttaatttgaacccatcaagaaagaaaatggcactattctggggtcaatagttctccatattgtgtgaatattgcttttccttttctactttaaaagtgacaccagagtggttttcgccagttaaaaatactatagctgtctgttcagtagggaatcttttgtaaagaggatcaaatatttaagacagggcatttttcccccttagagcagagctaagcggaggataaaaacgtgctatcttcctcatccgtatgcaagaaggagagtttggatccacattcttgtaaacctggaggagtcagataacaagcgtttctcaatccagtggctcaaatttcaaccaaatataacttttctatcttgcaagacagatgtggcaatccagaaatattatgatgagaatgtaggggaaggagaaagcacagtttgtagttacatggcaatgaagggatatcaaactgtgcaccataataccatgaattacgagaccaatgggacaagaatttttttcctgggaggatggatgggtgacactaatactcctgtgactgaagaaagccagcatgtgccctgatgttacagaaggaaacacagacataaaagtctaatataaacattcttgggcccagactgaagtgaagatagaaaggttaccatcgacaatatggatataaaaatatcaatctgcagtataattataaataaaacggttgttaacttttacaacgcctacatatatttatgtaatgtcaaagcttacacatcaccaatctttatatcaacttttatattggcattctgagaaaaacaccatatttcctggagttttttgtaaaataacagagaggctatggccataaacattcttcaaatgcatagatctcatctctgcgtgtgtaaatggtatgtgtgctgtgtacattgacatgctaatgaaagcataaataactcaccagagactccagaaatggcca

SEQ ID NO: 96066 - DNA, 1041 bp, Homo sapiens
ttgttgacatgaactggccatattgttatatatcttcctatttaataaataaaatacaaacctgtttaaaccttgattctgtttatgaagaaatatacattgggtattcaaagatggtcaagtaataaagatgaattatttgaggaatatgtgtagaggatgacttcatgaattataaaagtaagatataaatgtgaaatgtactgatatttatttttaagtttactaagtgaaatgcacattagataccttatcttttgttctgataatgaataattgccaaaattcatttcccgatgtagaaatttcccttcattcaccaaagggctaattcctctgatgtgcaatcagtctaccatcagtggatgtattgatatattactccatactgcagcatgctaccaatatttccttacttttcttaattcacaaattatttaattatttcactttctgcatgcttttctgtactagcaacagcatcgttttttttaatgactataacatccatgcaattccacctagtactctgactcatcaggtcttcaaactcttcaagtctacttttccacttctgaaatgttgatttccattatcttgttttctaaacatgatatcttacctttaaaacttacttatgattttatccaaactccaacatattctcagccgtatagtggcatgaggctgagtgatccaactgcttttcactgctaacatcttctttgtgttatttctcatctaatctaacttagattcaatagtctgatgccagtgctgcttttcacagagtctgaacaccttcgaatgacatatatgaccaaaatcaagtctagtaaaactgactaatctaacctcatacaaacttaactgttgaatgagattactatatattttatatagctaatatatattatataatatataaggtgcattatatatattaccatatattatatatttatatatagtaatatataaatatgttaaatgtatatgtaaatttaagtttatatatataaataaataaaatctgtcaat

SEQ ID NO: 96067 - DNA, 1038 bp, Homo sapiens
aaagcacggagatgctggagttccaatggaagttacgggtctgaagcttggagaatttgttgattattataccatcagagtgattgacatgttggctatgccataggtgtcagtgtggaggcatttgatctaatgttccaagctaaaacgtgaatatattgaatcagacaggaaagcctgagatggttactggttgtcatcacagtcacttggcttggttgctggggtttctggggtggatatcagtactcagccgagttttgaaggcttgtcagagggagctttgacggtggttgtggattccattcggagtgtaaaagggaaggttgttagtgatgccttcaggttaatcaatgctaatatgatggtcttggtacatgaaccaagactaacaacttcaaatatgagtcacttaaacaagccatctatccaggcaataattgatggatgaaacagacattattactctattactgttaactatcagaaaaataaactggaatagaagatgttgctaaatttgcataagaagagttgaatggaaggtttgacacttcaggattacaatgaacattataaatgcaatgatttagtattaaaatagatgctggaattggccaagaattacaaaaaggctgtagatgaagaagatgagatgacacctaaacagctggcaatagggtgttggctagcagaacactaatgtcacttggaggaacaagtggatttagtcatgacttcaaatattgtttagcaactatgttgaatactgttgtatttaagtgaagcaacaaaagatttattagtgatgatttcagtagacatttctctgttgttcctaatgctcaaagttaagggatgtatttggttaaatgtaagacatttggcatcatttgtagcactgtaaccttcagtctcacctatgcaattacttttgtttctttagttagggtctttgcaggttctaaagttatacaataattcataaaagtggacacattttgttaatatcccatttaatatttgaaaaaatcagta

SEQ ID NO: 96068 - DNA, 1041 bp, Homo sapiens
tgtgaataagtgtaggaaaatgattgcttattagcagtcaagaataatggtgataccaaacaatcacagatttttcagatgagtggctgagatagtgacaatttaaatttttgaaggttcaatctacataagcattgtttcatatacaaaattatttaaaatattatataaaattactttcaggttatatgtataaggcatatataaaacgtaagtgaattttatatatagacttagttctcattcccaagatatctcattatatatgtgcaaatatttcaaaacaaaagaaaaagaaaaacaagtttgaaacacttctggtcccaagcatttcaaataagggatactcaacctatatttaggtcatttgatgttgggtgcatatatatttacgattattataagttcctttagaattgaccattttattattatacagtgaccttcttgtcgcttgtgactgtttttgacttaaagtctattttggtctgatagaagtgtggccactcttcgttctttttggttatcacttgcaagtatacattcctccatctcttcactttcatcttatgtgtgcccctaaatctatcattaagtctttttattcagtaaacagttggatctcagtttttaatccattcagccacactacatcttttttttttttttgagtttagttcatttatatttaaaatcatgattactatgtaaggaattactcttacaagtagtgaattgttttgtcttttgtgtagttctcttactctttttctcccttgtcattctttaggtcctgatggttttttgtattgatgggcttggattattttatctttatattttgtgtatctattgtatttttatggttttcataagatttgcattgaacatttcatagttacaatagtgtgttgcatgctgataacaacttatcttaaatcacagaaactctagacttgacttcctctctttcccagtttacatagtcaatgtcagattttacttctttctgtactgtatttccattaaaaatttgtggtc

SEQ ID NO: 96069 - DNA, 1015 bp, Homo sapiens
agaaggtcatctaataacagaggcataatggccacttaagtacattatgaactcaaagctcatgatacagctgacctttggcagaccccacattcttcctgaggaggaagaaggagagactcttgctgaactcctcggatccaagtaagcatctgaatgctgaacattaatatttaccatggaaactgccaactctcatactgtacttagcttttcttatcgaatctctcagggggacaatgaggactttggttcactgtgaatgtttcagcgaaactccattccccatataggccctttcaaagcagaaacatagctcctggagggaatcgtgcaacttccttaaaagacgcatctaaacttgctaatacagatgcttgtacaaaagggttgggagtgaaaaggtcactcattaaagcattaaatgtctgacctttactttttgttctaaattatcctgtgattgtacagtacagttcagcaatacaaaaagcacttattgtgagcctattagaatgcctacggatggaatcttgcccagtgctacagcagcaggtagctacatttaatgtttttatctgcattttatttggcattaccactgggaaatgaaatgctagaaatataatttgctgaaagatcattttattcaagattttagtaatggtacctatataaatatctttctcttaaggaaaagaaaataacgcaggcagtgaggagaagggacttttcactaggccaccagatttgtttgccctggattctggtgttaactcatttattaataaccaactgaattcatcttcttaaagttttaaaatcatctgctttttaagatttcattctaaaagtttctttacccattgatttaacctgaaaatctttgtatcttcctgattcttctccacgtgatggttatgtctcttgaaacccatgaaaccctaaattaggcctccctggttcagaaccaaaagatttaattaccaagactttgtaattaaactcaaaaatt

SEQ ID NO: 96070 - DNA, 1435 bp, Homo sapiens
aaatcagattcacatctgtcttcaaagtttgctgttgttgattgttggggccaccatagttattaatttgtttagtgacttcttcaaactattttttgaaataaaagactgtatttcttgtcatctgtggtcactgaaatctctacttcgttatcttagcagtcaagcaatgatctggcaaaaatttccttaaacaccttgagcaaaaagacctccccccacaaatctttggagatctctgagccaaaatgcaccttcagtgctaagcctgttcacctacacctctgccttcaccttcaatttctgcttatgcagagtccagagttagctaaaggcataagcctagcctcctctcacagttctcctgagcatgtgtttggccctggggatgtgcatcgcactctggattccctagcatctgcggcaccccttcaaaggccttaattcccttaagaatattcctctagagtctcagcctcgccgctgctgccgccgccgcccagagactgctgagcccctgttcgtccacagccaccacccactccggacacagaacatccagtcacggataaaaatgagctggttcagaaggccaaactggccgagcaggctgagcaatatgatgacatggcagcctgcatgaagtctgtaactaagcaaggagctgaattatccaatgaggagaggaatcttctctcagttgcttataaaaatgttgtaggagcccgtaagtcatcttggagggtcgtctcaagtattgaacaaaaaacggaaggtgctgagaaaaaacagcagatggctcgagaacacagagagaaaattgagacggagctaagagatatctgtaatgatgtattgtctcttttggaaaagttcttgatccccaatgcttcacaagcagagagcaaagtcttctatttgaaaatgaaaggagattactaccgttacttgactgaggttactgctggtgatgacaagatagggattgtggatcagtcacaacaagcataccaagaagcttttgaaatcagcaaaaaagaaatgcaaccaacacatcctgtcagattgggtctggcccttaacttctgtgttctattatgagattctgaactccccagagaaagcctgctgtcttgcaaagaccgcttttgatgaagccattgctgaacttgatacattaagtgaagagtcatacaaagacagcatgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttatgatttatgacaggtttatgttacttctatttggatttctatatt

SEQ ID NO: 96071 - DNA, 1054 bp, Homo sapiens
ctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccaggtcagccgcggccgccgcggcccagctctcctctcttcctgccctctcagggcgtgcatggccttcatcctctatgcttctgtctcaagagccaggaatctggccagagagagtgtcagtttccctctctcaccctttgttccctccatccatcatcctccatcatcctccatcacccatctctgagcatgtactaaggccagatgcagggccacagaggggaaggtgccgcctctcccggcgcagcagttacatcagcagcgccctcgcgacgcagtgggtgctatggcagaggggatcggggagtgtggaggacgtgtggctgtcagggaaggcttccagggccagggagagttggaaggtcctggaatggctgaagcacctggacttcagctcccacagctgctgtcagcccctcgagggcgggggcagcggccaggctgcagggcagaactgccgtgtgcacactccctaagaggcgtggaatgcccagatacagcagggagccacccaggggggcttgggtctctcccgacgggcccttggctcagcaaggagccacgcagagggtcttgggtctctcccagtgggctcttggctcagccgtggaggtgcctctggggagcctggcccacagccccaggtcttacgtccttcatggtggaggtcgggctggagtacctgtgctggaagcgcatcttgccagtgctggagtgggctgacgtgttgtcagatttgcccagaggtggccggccttccccgcactccccgagagctgactgcctcctcaagtccagccctcaagg

SEQ ID NO: 96072 - DNA, 1037 bp, Homo sapiens
tggccctcagaaatggggagggagcactcaggggcgggggcaattgggggcagcgacagatgctgccctgagagccagaaggcagtggcagggctggcacctagcctgaggaggttcattgtggaagtgggcagggtccccacttggctgggtctggggtctgcctctgtgcatgtcccgtgtccagctcgccaagccccaggcttgcccctcttgttgtgccctactccacgctcactgccctcccggccacgtgggcctctctttggcaacggctgctcagccctccctttcccagatgtcctcagggtcctggagggctgcagggggaggtcgccagcatgggtgtccacatccagttcagcctctgtcttgcccggagccctggtcccagcgcactggccaagaggggtgggcaggaggtgggaggactggccatggggctgggctggctgggacgcccaacagaggggaatgacccgtgctgccccccaggccgaggaggagctcatcaaagcccagaaggtgtttgaggagatgaatgtggatctgcaggaggagctgccgtccctgtggaacaggtgaggcccagcacggtgcccagcctgcgtggggcagtgtccagtctgcgtgctgcggtgcccagtctgcgtgctgtggtgcccagcctgcgtgctgcggtgtccagtctgcgtgctgcggtgcccagcctgtgtgctgcagtgtccagcctgagtgctgcggtgcctgggccctctctggtttgtgcctctgatgagcgtgtgtggtcgctcgtgggtgggtatttctgagttgctgtcctgacctgcctgttcacctggcccccatccttccgcccttctgtagccgcgtaggtttctacgtcaacacgttccagagcatcgcgggcctggaggaaaacttccacaaggagatgagcaaggtaggccatggggacccctctgaggggccacaccccaccctggccgagggtcagagtcagagtcgtgggaggggcagcctgaactcctccttcc

SEQ ID NO: 96073 - DNA, 1615 bp, Homo sapiens
gagaaggcattccaggaggtgcaggcatggtccaaggtgtggagagaggtgtgaggacattgaggatgccagctctctgaagagaaggggtgcctgggtggtagattccctccatatttcatgaagttgtgaaggccaggaagatctatggatcgcaaggattcttggagaagctgaggcttgaactctctgcgccctcttcaagatcaccacatcggggctcccttctcactggcatctgaccaggtccttgtccctggactcagcgtccagcccagctggtcccttacaagctgtgtgactgtccctgaggttctagaatccctgagtcctacccttggaggtaggccctctgtcctcatatctctgtaaggaacagcatgcacaggcgtgcacaggctctgggtttccctgacatgctgcggacccttcctgagccctgtttcttcatgtatcaaatagggaataagaacagttcctcttcacacatgtgttgtgggaagtaaagccccaggcaggtgcttggggcatagcaagtgctcattgaatgccagctctgtggcagagcggcaccttgagcccacatgtggcaccttcttcctgcatggccccgcttcctagcccctgtccccagagtgtccattacaggcctctatagacagctaatccctcctgagcctggggttgatcaggcttatgacgttcacagacccggggcagtgagtgtatgtgcatgcatgtgtgtgggtgcagtgtacaggggtggagggtttgggcttgggaatcagagagctttagagtgaatcttgactactcccaccataaactataagtttttttctgtctctgggcttaacttttcaccactggcatatgatgaagtttgtgtgttcattcctttattcatgcaacaaatattgagcaccaccatatactgggcactgttctagggagtggggacccaggagtcagcagaaccaagcccctgctctcctggagctgacattctcaccaggggagatggtgaagaaaccaccaagtatagtggcaggtgcttagaggggtggtgaggcagggactcacctgccctcaggactttctgcatgtgtcccgtgcgggaggagtgtgctaggttgaggattgagatgtggacgtgactgtgggagctcacacagcaagtggattgggtggagagagtcaggtgggcagctcccgtcccaggtgaggggcacccacgggaggatggcttccttttggatgccaccctggtttgttgtgttttcctaaagctgcctgtttggcaagcctccttttaggattaagagtgcagatgtgcagcctcgctgggtgtttgtgcagggcaggtgggcaggggtacctgtccaggatggaggatgggggaggcaggaggggctgctaaaggagaggaggagggtgtcaaagatggcctctgctgcccagggccacttgtaagattctcatgccaggcagcaactctgggtgcggtagaaagctctagacagctgagtttgagtctatccccaccccccgcacattcctacccttgggcaagtctcactgaattcttggaatcccggtttcctcatctgaaaca

SEQ ID NO: 96074 - DNA, 1046 bp, Homo sapiens
tcgagaccctgtttctctcttaaaaaaaaaaagtttgttcagaagttgttattaagtgaggtagtgtggcattatggttaagaacagtctgaagccaggctacctgggtgttcaaatcccatctccttaagagctatgtgatcttggataggttagttaatctctctgtgtctcagtttcctcttctttcaggtgtggattatagtagttttgaggattagaggagataatgcatgtaaaatgcttagaacaatgcctgagacagtaagcgatctgtaaacattattaaaaatgatgtattaaatttatgtaagtcttataaaatttgctgtgattataagtattataaaaggagtatcttttcttctggagactaacatgggctggttcccccttcccggcaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagtcttcattgtacaagtgtttttatgcttcgtcctgggcatgggttatgtctggatgaccaacctccatcaaggccctactttgtagcaagcacagatgagtaagatggagcccatccccagggagctaccagagagatgtaccctgagatagaagaaacgttggcaggaaaggcctggggaacggggagggtgatccagccagag

SEQ ID NO: 96075 - DNA, 1023 bp, Homo sapiens
tttggaaatagcagtggtttctttgcacctctctttgggcttcatgaaatgtggagatgctccttgtatagactctgtgctgagagtaagagatgttgaagcaggaaaaagcatagtccaaaaagaaaacgaaaaatggaaaggagggaatcccgaagagaatggtgggcctaaacctagaatcagtggggaaggctgggaggtgcatctgtagccagtcatttttttgggtgtaacgatattcctacatgacgagggctttctacttgagaagagctagcctgagctcctttttccctctgatgtgttttcaagataactgaggcattattctgtggtctaacacagcttcattcttctctagaccctatatctacggacctacgtctcagggggaaaggatgcaaattctccagaatttcaagcacaaccccaaaattaacaccatcttcatatccaaggtttgtgtggcatatggggtggaggtgaggcccctagcactctggggacctggggggtacactatgattcctggacagtgaattcatgtctgctgaaggaacttctcctgcatgttttcatttccgacatgtccagggatagggggcactgcctggggttagtggaaggagcagactgaggatttgcatgcatcatggataatctataaaggctatttgaggtttttccagttcttttggggatgtagaagttttaagttgtatttccttatttataaaaggaaaaaaagttcatttcctactctggcaaaagtaggcatttagatgaagttctctttacaagttggagatcctgtgtgtcgcggcagcctttgtcctggttcctggtgtcccttgatgatgggtggtggatgtcagcacagacttccgcaggcccagctcagggatggtttactctgcaatcagaagctgtagccccacagtttagaatagtcattcagattaagacagacccaaagcccaaaagaaatgagattttacaaccgggcgcggtggctcacat

SEQ ID NO: 96076 - DNA, 1050 bp, Homo sapiens
tcaccctcttgttctccttttcattttcttttggacaggtctaaaagtgatggtgaagcatttgcctagtcattcttgtctagagccagcttctgtggtcctgaaacccaagggttagttcaggtggtgtcataagccagtgttaagttgcacagctatgagcatttgaaaaagtgacagtgtaggctgggtgcagtgggtcacgtctgtaatcccagcactttgggaggcgaaggcagggggattgcttgaggccaggagttcaagaccagcctgggcaatataatgagaccccatctctacaaaaaatattttaaaataaataaataaaaaataagaaagaaaagtgacagtgtgaatgctcccattgtttcctcagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtagctgggcctgggctgggggcgtctgggaaagggcctcctcctatgggcaggggagtgatcagatcgattcctcatgggcagacacaggtcaggacttaggctcacctgctaccacttcatacaggatcctcagtcaccctgtggttgggtggtactagacccacttgctgcatatcttctgtcttgtcacatatctcacatacccctgaatttgtgatgattctttttcctagccatggggtttaccagtcatggatttctgtgggtgaggattagcattcagggcacagggatgaatgaaggcccctgataccacagtgctgcctgggagcctggcagcaaagggctttgctctgatagccccaagcgcctaactgatatgctcccagccctgctgggaagtgtgtgaagaggtggcggtactcagtagcagtgctgactcgtgtgtggaagtgtggcttaaatggaagaattgctgacact

SEQ ID NO: 96077 - DNA, 1022 bp, Homo sapiens
ttggaagctgtgttcagggcttgaggcattctgtctgactatatgtttggtacacgttcatgtttttctttaacccaagccccaggtcccaggttccaggggacaacagcacagatttgggattggttatctgatgaacaagtacaaaaaggtgcatctcacactcacatatgtctgtgagtttgtctgtctctcgtctagttcactggatgagttagtctttggttgagttgcggagtgaaaccaacaaactctaagggatttttgagtacaggccccataagcccagtggcctggccatgctcattgtcccagagagcaaatgttaaataagggaatgctaggaagtcacagtaagtctcctgactgtcttaacgtctgctgtgttgggttaggtggagtgatcaatctttgagatttatctcaaaggataaagattgctgtgctgttttacagatttttcaaaaggagctctgttatgcctttttattaatgattcatattatggtacttgtgtatattaagtgcttcctgtgtgctaggtactgtgccagtttcattatttctacaggtatttattgagaacctactaagtttaggcactgtacttggcactggagacaaagtggaagggacagccaagtaaccacacaaataaatgccaaatgacaaccatgacataatgttgagtgatacaagccacacacaaaagtgcatactatgatttcattcatgcaaagttcagaaaggaggcagacccctctcagaagtcagaggagtgtttccctcaaggaagagtgctagttattgacagaaggggtcaggggagagacctctgggtgcctggttctctatatcctgatctaggtggttccacagctgcatgtctgtaaaaatatattgagtagtatgctgtgagttattcacctgtgacagctgtcagggctgtaggagagtgtaatagaggggtgtgatggggtcacgggtgtccaggcagagtcctacctgccttatccttgtct

SEQ ID NO: 96078 - DNA, 1006 bp, Homo sapiens
caccatgcccagctaattttatatttttagtagagacagggtttctccgtgttggtcaggctggtctcaaactcctgacttcaggtgatccgcccacctcagcctcaccctgggattacaggcgtaaagtaccacacctggccaaatttttgtatttttagtagagaaagggtttcgccatgttagccaggctggtcttgaagtccagactttaagtgatctgcctgcttgggcctcccaaagtactgggattatagacgtgagccactgcattcggccaccatgatccagttttagatttcctttgtactcatttgcagtcaatctttgtttctctatctagcttcagatgactactgaactgctgtcactatagatttgctttttatggaaaatttatataaacacaatcatacaatatatattatgtctggcttctttcacttcccataatgattcatctgtgccttagcatttatcagtagtttgttccttttattgctgtatagttttttgggcgaatcttttttgataaaaacagattaagggattaagattaacaaattaggagtgggcatggtggctgacacctgtagtctcctagcactttgggaggccagggcaggaggattgcttgagcccaggagcttaagattagcctgggtaacatagtgagacatgtctctacaaaaaaaaatttttttaattagccaagtgtggtggtgtgcacctgtggtctcagctgctgaggaggctgaggtgggaggatcacttgaacctgggaggttgaggctgcagtgaaccatgattgtgcaactgtactccagcatgggtgacagagtgtgagactctgtctcaaaaaaaaaaaataaagatgaacagattagggtaaattaaggagtctaatagaggttactatgaacaaaatgaaatctgaggcattttcacaggtagtgttcaaaatgtcaaaatggccccagcatctggttctttctgtgcatgagag

SEQ ID NO: 96079 - DNA, 1183 bp, Homo sapiens
cctcagcctcccaagtagctgggattataggcgcccgtcaccatgcccggctaatttttatatttttagtagagatggggtttcaccatgttggccaggctggtctcgaactcctgacctcaggtgatccacctggctcggcctcccaaagtgctaggattacaggtgtgagccaccgtgcctggcctgagtggcaaatttttattgttgccacacagcctctactgtattccttcctaaaggtggttgggaacctgggaggatttaagctgtattctctgccatcaagatgcttacattctatttggggaaataggagcattggtgaagaggctttgcattttatttaagccgcaattactgtgcacatactctgtggagttgtagtaatactggtgtggtcttctctagactagggtgggggctgtgggaatagagaggaaaggcagaatgcaagattttaagcagcgttttataacttaatggatatgcatcagaattacccaggcaagaggaagattttgttctcagaaagcagaggccaatggaaaaagctcagtttaggcacatctgaccactttaggattgcaagttgggtttccctaaagtaaaatgaacttttcacttggttggtaggtgtaagatgtgaccagtaatgaatgtgttctgagttagctgcacatttacctgttggatgttatctgtatttgcagttgtgtactgtcagctatggaaaagtcaagctggtcttgaagcacaacaggtaagagattccatgacaggcctgtcccaaggcactgtcactttctgcgcaccagcaggaataaagggatatgggaaggacctgatgtttatgctgtcttttctgtgaagcacagataagagaagagaaacaagagatgtggcccagactggaaactcatccactggccactgtatttcctctagcagtggagctgggctcaggcccctgcctacttgacctcaaagtcacaaccctcatatgttaaatcatggccggcagctcatggtacagatttggcgaagggttgtggggagagtcatgaggcttgtatttccagaccatctaattgaatgagcagtggaatctccaggaggtacctgctggtcagtagaccccttcttcctcccctgcttgcagatacttcgttgaaagttgcca

SEQ ID NO: 96080 - DNA, 1097 bp, Homo sapiens
agcaattccacctgccctgctaatgtaacaataggcataggtgctccatgttgtcagcctgtggcagccatgagaatgtgccattcagatttcctgtggggagcataacgactgattaccccagccgctacactctggatccagcattgtgttctgggtgaggccatgcttctcatgagccgctacactctggatccagcattgtgttctgggtgaggccacgcttctcatgagccgctcccagctgtgggtattaacacagaggggctactaattcaggcccattgtagccagggagaatttggaaatgcagcccaaagtgagtgtgctggggactgaattgtgtgtgttcccctcaaattttgtcttcaaaacctaatatccaatggtaatgtatttggagtaagaaagtagttaagactaaatgaggtcgtgatccgctatgattagtgtcctcctaagaagagacaccggagcatgctttctctcacctgcccttcttgtcatgtgagtacacaatgggaaggtggtccatagacaagagccttcaccagaaactgaatcggctgataccttgatcatagactttcagcctccacagctctgagaaaatacagttctaatgttgaagccacccagtctggaattttattatggcagcccaagctgactaacacaggtggtaaactctgtctaaagctaagtatctgcaggagaccaatagtcaacaagttccatgagggaaagtcaaaaacaacttcagatgtttttgacaaaacaaagagggttccatgtgattaatagttgaacatgctaggtttcttctgcgagatgggtgaatgccatttaaaagagatggacagtggctttcattgcctttggctgatccaaaaggagtcagattcagaccttgggatctggagtggcagaagagtgccacaggaattcagtatggtactgcagccagtcccagagaagctgcaggagtcctggagagaactctcttttcctgtgatgtgaaagcgtgcccggccaggtgcagtggctcactcctgtaatcccagcactttgggtggctgaggtgggtggaccacctg

SEQ ID NO: 96081 - DNA, 1533 bp, Homo sapiens
ctcgaactcctgacctcaagtgatccacccacctcagcctcccaaagtgctggaattacaggcgtgagccaccgtgctcagccaaattttttttaattaaaaaaaagaattcttccttacccatggactcaggtcacattctctctctctctctctcacacacacatttattgcccacatggcttcattaaaatttaagttccagaaggatgaggcctttaattcgcgcactacacaggtgctcaacacacagtattttccttcagttgtagagaaatgaacagtggaggacccccgccgctgggtcgcacgagctaacagatcggcggtcgctggctctccgctcttccagccacccacatcacggcgcctagaggcgggacatcctgtgtggacaacagggagcttccggattgagccggaagtccccccagagcggatgccgcggcgggcctgtgggagcggggtcatcttctctctgctgctgtagctgccatgggcaaaagagaccgagcggaccgcggtgagacgttgcgcgggcacgctcagccacgactgcccttgccggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacgggtgaggggcgcaacgcctgcgggatgcaggtggctcttagctaggagtttgcggcggcgcaggtgaaatgctgccaagcggtgcggagggaaccctgaaggctcctgctgggcttacttctgtgttggtatcttgcagacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggtaagcatgcccttagcttgggcagggcccaggagtgtgcggagcggcagctaaatcttgggcatcctcagagtcaaaactgacattcaggatactgcccctagaactggccgggagagaattttcatccacacacgttggaacagcccaaggcaacagcgagcagttgcgcacacgtgtggcggccggacctgggcttccaacagctctaacccctcggtttactctcactccttccccagccctaccccatgtagtgaatccttttatctgccgaataaatagcatttatcatgtaacagtttgtttcctcaaataatggaagacatgttcggtagcaagcttttgctctactttaaataattaatgttatacatttagttgaaatctagccaaaaggtaacttgaggatagccagtaagatgggctttctctgtgcagaatagtaggaaacagctgttgactttgg

SEQ ID NO: 96082 - DNA, 1937 bp, Homo sapiens
tagacatccagaagttacttccactattgaggaactatgtagacatgaatttaagcttgtacatgtgccaatcttgttaatgtcacttgaccactgattcacatagacagacattaacgtctgatgcctcaggttgatggcgaactttcttcctagtgtcttaacatttatgaacttatgtttgacttgaggggcatttcagcaaagctgtgaggaaaagtaggttctggactgatgtctgctttgtgccatagacattttggaacataaggaagtatctgcttctactatatgtacaggacttgtccccaaataatttctgaatcccttaatgcagttgagaatcccttaatgcagttgagaacagtaaagttcatgaccataccgaaaagcacttttaagttcacttctttttaaatatttttttagaatttattttttaaaagcatatgtaactagtgatgattttagcattagctttacttggaggggagaagaaacaaaattacaccttaaactctattagatagactacaaaatggatttgatgtattcttacttttccaaagaattttttccacctggaataagaagagaggactagttgaaacatttgagctggagaggcttatgggcaatatgaagtgggccaaattcttgcaatacaccctattcaattgaaagtacagtgtctaaggataagaatacttctttaaagaccaacaattgttttaatgcaatcttaattagtaaatggtttacattttttctattgttattggttttaaaatttgctaccctgaattctgaaatattataagagttaataccaaaaatacttttaatgtctgacatctcttacatttcacatggttctttttattcattgtaaataaaagtaaacttggataaatttgagaataaactttgaattgttgcaaactatgattatcaatttgtaaatttaccctttgacataataatgtacatttttaaatgtagccattaaattctctatatttaacctattggtttctctctaaatgtttttaatctcagttgaatgctgggcagtttataattatgtacaaagggtttttttcctattaagattgacatttttgcacatttttggaaatgtttaatttgtacactgatttactactctgaccaataattgttgatgagtgtatgagcatcatgaatgcgtgcattgaactactgtctgtgtctttatgttttaacttctttcaagatgtagccatcagttactgcactgctattactgacttaaatggacctttttgcttttacaaactatacttatctatggttctttgttgaagaactcaggagttcgacattaatagaaattagaaaattttataatgtattataaaatccattactaagttgaaagtatgcttttaactgtgtatcaggggatgtatgtttgtgtggagatgtttttttctgtctgtaggcacatgtatatatcccagtaagttcttattttcatttcatttctacatttttatgaacttgttttataagggtactgtttagttgtgataattaaatatatataaaagctttctgagagattatttactatatgaatatattttcagctggctgatcaaaagtatttttaaaattttgtttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgt

SEQ ID NO: 96083 - DNA, 1040 bp, Homo sapiens
cattcacatggtttacaaatgttaaggcaatgagataggacagtgagtaggaaatccagggatagcagattctagtccttaattctcagctaacattttgggtaatactcacagaaaagttacttttctgtgaagtgtgtgcatgtgtgcatgtatgtgtgcgtttgcatgcatgtgtgtgtgtgtgtgtgtgtggttagagttggaggcagggatgggaaggaagaaggggaaaggtatgagtgttcaattaggtcagtttctggttttggaagaacaactcaaatgtatgacctactgatgacatacagtgagtgtagtcatccttgggtaggaacaccagtacattttccagaagtagctagtacaaatgattgtataataatattgattgtaaattgccatactcttggttgctaaaggtagattaaaattcaatttgtgtatatgtaaaataatcttatatataattcttaaatagaaagtaattgattttacatagttcttcctgaactttttggaactgaaattctgccaaacattatcaaaataagcttccttagcttaccaagtattcacaaggaaattctcttgtacctctttttggttggctaggggaagcatgctgtgaagcagctattcctacttatagttgtctttggcttggctttgacttctgccatggtttggacaggatgccatggtaggtgtgggaagtatcagggcctcccatcttcccatactcaccttccagagctgttgatggaaatgagctcttgggggagcctagagattcttttttcagtggtcctgtaagcattcaaggttgagcttcagaaagatgagggaggagtcatagctacagtaaagaaaagaatagattttatctgttgcctgtatacagtctcatagaattcttatttttcataattgtgcattttaattgatagtcatatggtatttttgttaataacagcaaaggcattaaatcagtaccattgttccttctgcctgatgacttcttgtttgtaacacaatct

SEQ ID NO: 96084 - DNA, 3554 bp, Homo sapiens
tggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtaacatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagtaaatgcaagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaaaaaaagcatatcaaaacaaaattttaactactaatgggaaggttaaaaagctgccacgtatttctagtacaatgtatccaataagagcaaggacattgttaaatggaacaagacagctgggaaaggccccactatctctaatagaattgtgctactataaaacatgaagatatcagcaatttggccacttgcagtttttttcagcatgttaaagcaagtgctaagtactttattagtactttatttagtactttattttaaaggtctagaaaacaacagtcttcctggaggccccagaatccctttcatgggattcataagggactcaggtattcttattttctgccaaaaggtgtgcttatttagggactcttttacgatactttgtttctgaagttaggtagatcttggtttactgtgccaaggtcctacctagcattccctgtaggaatatttgaaattccactagctagtctaagaagtcaaagcacaaaattaattgtcaacgcttctctcatattcttaaaattgaagcagtttgcagggaagaacaagaatgaggtgtccctgccttggtaaagcaactgccaaattttgttctagaaagaatccccaagtgtgtggatctattataatttctttatcttttatgaatgagggcatcttttctacttgagcaagatcatggtccttgaccagtgggcttttccttcatatctgtcttgtgtagttgtgcttttcctttggctcgtttttggtctgtcagggtaaccagcagtgcacaatatgagacaaatgctctttagagagaaatctggtgagactgtagaacccagagcaaaactgtttttttttcagtctctgttttcttttctaaatgctatagaaaataaaggcacctgaaaagaaactactactttaacactgctgtggaaggcctttgctttataagaaaaatattattagctatgggaaagtaatgttctttatgtaaagacttaaaaatagactaatagtttacagagttattatataaaatacgatgtgaatttatttcaaacaagttgtgaaggtaccaaaaaccacaataaaagttaatatatataaaaactactagaacaaaaaagcttgaaggtgtgggggtggagggtatggaagaccaaaagtaaatttaaaaaagaaatttttgaaaggaaacagctttatcaggggaagttaaatataacactccgtttttttcttctttctaataatgatatggatcaacaaatgcaatttgaactttttaagataactctaaatgtgttttgtttcttaaatgcacaattgattcttctatactgtaatgcttctttgctgacgctggaaaatggtcagactgctgactttgtgcctttaaaatgcattctgctttgacagtggcagactttttggtgctggagaagattcactagcagtcttatatgtgcttttcaggaaatatctttctacttaaggccttgagagattcaaagtggcatgacttaggcttggaccaaatataagatcttttacattgcaaacaaaatgttgtattgaataaaagggttaaaaaaatcataatgactagtggaaattttgatgggttgttaattatttaaaatgtatttgaaagtatacagactgaaaatttcagtatgaatatcttgaaaattttcagcacttttccttgtttacaaaacatctttctaacttaaaaaaatgactattgccttagaaagttttaaaaggcacagttacccttacataacatatataaggaattaaaatattaatgcatttgctgaactgtaaaagaaaattttaaaccttgatttcagagtgaattggattggctttcacttgagagagtctttaccttattcccaaagaaactgcattaaaaagatgaaactatttctttagactaagtctctgctactccagctcatatatatgtcagatctgctctgtagtatttctgacatggagttgttataagatatgtgaaatcacttagaaaataaaatcagatgtgaatagtttagcaggatgaccaagccagatgcagactccttggcctatggcaaagttctgtgccagtgattttatttggagtctgggaactgatagcttgatataaaatcacctggtgtcaattaaatatacaaatctatcttttttaatagaatgaatcttctttgtttgttcaataattgtaacttattatgtcaggtactaaattaacatccttaaggaggtcacaatctaggaggaacatgggcaaacagttacttattttatggcatacgctaactctgaaagttcagcaatgatgttttaaaatgttattttttattaagggaaaagcaattttaggtaatcattggctgttataaacggaaatgtcactgacaacagggattagagtaaaagtatctccaaactagagggatcccctccccaaccaggtcacatagcatctctctcaggaccccctcttactgcaaaacccagcctctactcaacagttctggtgatggggagcatttattccataacagtgtttttttgttcttttttttttttttccccagtgtctcttttaaagaaaacatactttattttggtctaaattgtgaaaatacccaaaacatttgatagaaattgaactctgtcaacagtgttatttatactaagatcaggacagttccttgagatcatactgttttattactaagtttggcctttgttttacaaatgtaatgttcatatttatttgaattttaagattggttaaatgttaatgaaaagcaatccaat

SEQ ID NO: 96085 - DNA, 1027 bp, Homo sapiens
ggctatggaagaaaagcagacatctggtaggttttgatacgaagtttgcttgaaaaccacctgccgcctatgtatttccacctgggattgaattactgaggcagatgtaaataatcttttgtacttccaaaataggacgtaagaattgcgaagattaacactatattaattgtgccttattgaggcttataattgactaaatagttagaatccttgaacctgtcctccattctttaggaaggattttgtcgtgagcaaacctcagcattaaaaagctttttgctattacagaagtaaataaatagttactttgtttgtctaaagacctttaaaagtacttcatctttgttgtcagtgtcttataattcatttaatctttaattcttttataattttaagttagaacatgaaatggccattttctacttcccacccagaaaagactttaatagacattcattttaggcacctgaaggcaattgatttctaatgcttatattctttgtaagataaagacaaaaattatttttaaaatcaggttagaaattatataaaacaaaaataataagatgaataatgttctttgcccaaccgtttgaattaagtgatagtcattaaatttattttaattgatttttatgtttaaattagttttacgaaattagaactttttaatgaaactttgaacttgaaattaagtcatatttaaatatatatggacttaatgcctgtttctcattttctagctaactagctttctttcatgttgttgtttgtgtaatgtatttctttttgtttcttttcaggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatc

SEQ ID NO: 96086 - DNA, 1050 bp, Homo sapiens
ataggcaaacaacttagtttcttcataagttgcaaagaaaaaagaaaaggagattggagggaactttaggaaagacttagaagatttatcagtgactcccaatgtatggacttcatttggattctagttttttttaatgtaacaaattgaacaccgactatatatttgataatattaacaatttattgttcatcctcttgggtgtgataagagtccttatctttgaaagatatgtactgaaccatttgttgatcatgacatcttgaatttgcttcaaatcctagagaggggagggggagtggttggcagtatggctggggcaggattgtccagatggatgttgaggctgggtgatggctgcgcatgctgctctacctttgtgtatgtctgaaaagtctccttaataacttatttttaacatgtccaaaataagtttttagaaacttctgttggagcctggctacccgttttctcctccgcccttcttgtggataagcattggttcaatattggtgattccgccccagagacagcttcccctgtctgtgacctgccttggactgttccttcccctatcagagccctgcttgtagccagtaaaaaatgggctttgttgtccttccactggttaagtattctagagacggtggcttttttgacattccttcttaaagtactggatggtaggaaatgttagacagtgctctttcagaagatcactaatgtcatggcatgtttacacttaaggtgtgcagagaatggaccctggactctcctctggagagaggctttagggaaccatcattgactagactggggaatttgctggtagaacagaaagacaggtacagaagccccgtgataggggtggggtctctttatcctctccagtctgtaaggtagcttttctccactattcagtctccttcttagagaccgttttttaagaaaagggtaagagaaccaagaaaatgaatctttgtaatataaaatatggttaaggttatggaagagttaaaaataagaattgaagtaaaattttaaaattag

SEQ ID NO: 96087 - DNA, 1050 bp, Homo sapiens
aaatataggaaaatgcccattaatttacatgtgcctgtataaagaaagctggaatacagctggttttatattgctcaataagtgaatgaatgagagtgagtgaatgataatgcatttgctttgtaatttaacagccagattttttttttaaacatttgaaagatagaatgaaactacaaatatttacctttgtgaaactgaggtttgtgaactttctgaaacatttaaaaaatacttcaattttatagtattaaaatgttttcatggagttgctgttattcccttaacattgcattgcatcgcattatatgttcacactattatagtagtttacattttctaataatgtaatagtcatagtgtcattagtctcagtttgggtggggccattgttcagttttcagtaagcaaaatagtgtgaaatattgtagcttttaattatttagtcaatagtctatagagaaagaatatttttctcttaggaaattttgaagtcgtggcttgcttacaagggacatttgaaaatgagtaactctggagagtgaccactattgagtatggaattgttctaaaattgtgagtgagggttgcacaactctcagtattctaaaagccttgacttgtatactttaaatgggtgaattttatgttacatgaagtatgtctaattaaggcaggtttttttaataagcaacttttggttatatcaaattgaatcatggtggaactcctttttttcctagatgctggatccattatctttaagcagccctgaaaattctggctcaggaagttgtccatcacttgatagtcctttggatgggtaatgtttatcgtagtttttggagggtttatttgtttatttgagacagagttttgctgtcacccaggctggagcgcagtggcgtgaatgcggcttactgcagccttgacctccttggctccatcagtcctcccacctctgacccccgaggaactaggaccaaaggcatttgctattaataccacatctggctattttgtttgtattatttgtagagatgggggtct

SEQ ID NO: 96088 - DNA, 1003 bp, Homo sapiens
aatggaggaaaaaaattaaaagaagtaattataatgtattaaaattaatagagtgtaaattcacaagcctttctctagggttttagtgattgccaagaatgctctcaaaataaagatactaagaatttttatattatgctttattattactttattagtattcattttcatttgccattaatttattgttataattaagattatgatataaagaaataaagatcttgcatgctgtagtttaaggaggctttattcgtgcaacatgagtttgacacaggtactctcaactccccattctgtctgttcttcaatttgtataaaacattgataatctacatttttatttgataaaagcattaacattgtttcaaaaaaccgctggtataaatgttctttgagagagggcagtgagtatggccattaaagatggcatgaaaacatgtatgaggggcggatttaaaagagaaaagttaaagaggaggaaaaacaaatgtggttgggaatctaaaaaagattggtaacagaagaggattgttgataatcaaagaaaaaattgaattggcatgtggaccatcaaaaaaatagacattattcatgttctcttttggtccccagaagaagctattttatgaccattctcttcgaagtgtctgtcttaaataagtcctactttgggtttcaggaatgcagaaatgcgagcagcagaggtgatacacaagcaaaatacaaatggcttgtcttttgcattcagatatatttcgatatagttttaaaatttggtgaaagaacatttgaaacacccaaattcaaattccagctctctgatgaacctgagaccagtaaatgtgtcttcatctttaaatcatgggattgttgtagcattaaattgagagaacacttgtacattttacttttcaaactagaaagcttattgtacatttatacattttgtacattgtacaaagctcagatgttcattgtacatttctttctttatccccat

SEQ ID NO: 96089 - DNA, 1030 bp, Homo sapiens
ccactctagtattctctccattaaatattgctttttgcaaatgggaggatcaagtagtgagatacgacttttttggaatgagggttacttgttccttggaagcaaaggaggacagtgcagaactgataaaacaaggtttgtttggaagcagtcaaattggagaccaaatgatgtagattttgttatatatgcaagaagatctcagagggaaagctgcagagatttcttggtcagtagattgggaggaagcttgagtacttgaatcatttaagggctcaatcaagaaaacagagctactatgatattatggaataagggatttaggaaaggaataggacttcatacagctgtgggagaaactccagaagtcagagtctgtagggcaggtcagagaaaagctactattcagcctctttgaagcagttgtgcagtggtcagctcagcgtttacaggtgaatctgagaagccaggtatgcccagctactggagtgggaccacacactggagctggtgaaaagtctgtggagagttgtcacctctgtgtagctgcctcttttgtggtcctcagtcaagcttttggtggtgaacctggggttgctgtttggtcagcagggttggcaatcaagaagaggagctgtatacagagcagaggagagctgcgcagtcggctggcaactgcagctctatctaaccatactcttcagaaagtcttttgctctttgggccacctaccctatggaaagaggattctgggaaatgtagtttggatgtaaccaggttgacacagtataaactgccacagcagttaaggatgaaaagaaacacagtgggggatgttaaagttgtgggagtccatagtgatgttttatggatcaaggctcataggaatgtgagagagcaagttgcttaagctctctaagcccacttcctcctctgtgaaacagggaaatgataactaccttatgggattgttgtaaggatgaaatcaaatgtaaaacacttagagtgtctgctcagtgcaagccattat

SEQ ID NO: 96090 - DNA, 1050 bp, Homo sapiens
tcgatttgtcagattccacccccctccccccgtcatagcattgtttagcttgttcctgtattcccccataccagttgttaagtgtaaactagatttaaagggtcgattagttttaatttcaacattttggacaagaatacctaataagtgatttaatatattttatatgcctcccattaggagacgtacactgtgcagtcccattatttgtgatactaagtttgattgcttggttgagaggagtaaggtgaggtatatttttctcactgcagtcagcaagtaatctgtggcatgataaattagcactgtaatgctagcctgttctccagtgatcttttacctaatagttgtggtatcttttgctgatccttgtcaggctaacttttaaatttcagtgttaataaatgtttgttggtctatagatggaaacaaatcacaggaattaaaaaatatccagctaggttaatcagaatctgattttgtggattttaaagattttaacaaagtattcaaagtatcgtttgttacgaattttataagaaacctggcttgaaaaatgggaataactcaatgctggtcttctgtactcttaagaagtgcatttaaatttttcttagataacatctactgcacaagaataacccagaaatacaatataaaggaagggtggatctactaaaatacattttgagaaaattgtctattttctgatgtaatgggaggaacactggattgagagtcagaagatcattcctaccattatatgaagtttaagaattacaaatttttgagctgggctgtgtggtgcatgcctcaactactcaggaggttaaggcaggagaatccctttagcccaggagttggagggcatcctgggcaacatagcaagaccctgtatcaaaaatcaggaaaaaaagaaggataaatttttaaactttactgcatgttcttatttcatagtgattgctttagtaaacatttatgaataaagaatgaatttctgatgagatatgtttgtagtgaacttcatttttatgaagccagttataa

SEQ ID NO: 96091 - DNA, 2231 bp, Homo sapiens
tggaggactgacctcttaaacccgtggagtctgatgccagctctgggtgtgtcgtatcagaattgaattgcagtacctcagttggggtggaaatggaataccaacaaaatcttattaatgtgtttctcttatttgggataattattttgattttcatttttctctgggatgggggcttataacagagaaaagatcaagaaatactactgtcttcaaggaaatatggatataactgaaaatcactatgccgaaagcttagagcagttgagcagttagaggagagagaaaaattatagcttgtagctatgtttcttgttgctctatttttgtgataatagtctctatagacttaattatgagaggtctcttaaggtcaagatgacgaggcccaagaacgttttatcaactagattattttaatttcagaaatcctattctgatacggattggcaccttgatcttcagaaacacataaaactacttttggccaaaaaagcctttgaacagctaaaataatgaagtttagatactaaaacactgctcacaagaaactctcaaactatttacttccagcaaacgcagaagcacagtgggatatagtgctttgtaaaaagcaggtgcataaaggcattagaaggtaatagctagccactagatggagacaaaaacctaagcttttctgcaatgtttcatacaaataccctcaaaaacacttgagaaggaaaaagcagaggcatctagtgaagccttacactgatcattaaaaaataaatttgaaacaaagacaacaaaggttgtatttaagaaagatttttaagttacacaattttgtcatttaatggggtaagctccaattacctgaaaatttcactattacagggtaaaactttaacgatgttggcaagtaaaaagttttaaaccatacccggggaattcaaaatggtaagagattctcctgtactgtgtttgaaggaaaaaattagtttctatataaatgatccttggtgttggttttatggcagctcaaacctagctggccagaaaaacctttaattttgaagatatttccaatttatagtagttgcaaaaatagtaaataaactccggtatactcactgatatttaccaagtgttaacgttttgccacgtcattgactctgtcatcttgtatatgcatagagctatttttgcagactcagagtaacttgccgacaacttgccccttgagccccaaatacttcagcatatttcttccaagaacatagactttagttttgtcccagaattgatgatactaactttgacaacttggctatgatgatacagagttgtgggggattttgtttgttttttaagagatgggttcttactgtgtcgcccaggctgaagtgcagtggtgtgatcctagctccctgcagccttgaactcccaggctcaagcaatcttcctgcctcagtctcctcccaagtggctgggactataggcatgcactctcatgcttggctttttttcttccccttccggttttaagatttactatcttaaacagttttaccgctcagtggcattgagtatgttcacaatgtatcgccatcaccaccattcatcttcagaaatcttctcatcttgcaaaattttaactctacctatcaaagaactctccttcctcccccaagctcttggcaaccaccattctactttctgtctcttacgagttgtctgttctaggtacctcatataagtggaatcatacatttgtctttttgcgactgtcttatttcacttggtataatgtcctcaaggtttgtccatgtgtccaaatttccttgcattttaaggttgcataatattccagtgtgtgtatataccacattttgtttgtccattcatctgtcaatggacacttgggttgcctccacctttggctattgtgaataacgctgctgtgatcatgggtgtacaagtatttgttcaagacctttttttcttcacttttagagatattaaaaaacaaccatttttttttccaattcttttggttatatacctagaagtagaattgctagatcatatggtaattccattttaaatttgtttagaaagtgccatacatacactttccataaggggctacacaattttatattcccaccaatagtacacaagagttccaatttctccatatgcttgctaacacttgttatttttattttttgatggtagccatccta

SEQ ID NO: 96092 - DNA, 1751 bp, Homo sapiens
ggggagaagaattagaaaaacccatctctttttaagcagtcatcattcttaaacatctgaattgttttacaacagagtcagcaaacctttctagcatttctaaaagatggcagtttcttggagaccacatctttgcaaggcagtattttcaaaatataaaatagcccccaaaccaaacctttaaacatgaagggcaaatgggtaaagacttaatattctttttgtgtcaagtatacttaatgtaaatctagttgcttgtgaagtagtaaaatagtaatagctcctattattttgagcactgactatatgtgctcagcctctgtgcttggatctgacatcactatctcatttccttctctcagcagttctggaaggagtacctaccctgggtatgctttgcccagggtcacagaagttactgaattagagcagggattcaccccaagtgtaaaaactcaagagctcctgcacttaggggtttacttcactaatcatctaacctcatttattatgcttaaggctttttctcagctgacctgactttgctttaggtcattcttttttatgccagcactgtttgaaagtgcatgtcaagcggctagctccacatttggtcttcgaaagggaaacgcatgcagttaaaacgtaatgtacatgatggaattgggaggatcatagtctcagtttccccccccctttctcccatctaggagacctccatggactgcagcaaaattaaaaataaagcacagacaacagaattattcttcactgagagagtttaatatgcgtttctaacaccatctatacttgctttgttgttcttgaggtcatcaacacacattctggttattccagagctagaagctcttctggttgctaactcagttataagaagatgaaagacataactagacttacgtatttcagtagtttgctctttaatttttcccttactcttagtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtttttggggggctgtctcttcatttcttagaggatacattcttaataggggcaaagattgtttcttgttgtgtgggaaaaaatcttatgatattataggggtttgtgacccttagaggttcaatcctccctcattgtggtataatgaggaatttgtgtggcctttgcccctggttgctgacaaggaatgtctaaaacacttgtggtttcctgagtgatagagcgtctcttgttatgctaacgaggtgactgtatggtgggctttagggtggaggctggtaaccagaaacagctactacagagggttgggccagcaggacccgggagattgagacgcagtcagtgacctgtttgatttaatcaaccatgcctgccaaatgggacctgatgaagagctctggaccccacagctcaatgacgcttcttg

SEQ ID NO: 96093 - DNA, 1916 bp, Homo sapiens
tcatgtgttaataacccttgtagctcttgaagtttgtctgattcagagaggactgttttctggtcgcttatctagccaaaccacaaattgagcaatagagaaaggaaaagtattacccaggattaaagtttattgctgatgaatttttcttcagtcttaattcaacattatcaggtagggaagtttcttcttattaatccctttacttcaagcaaggcttgaaattgaaacctggagtattctgatacagtgaatttttttttttaataaccatgagaaacagagcttacgtgcttcagcagacctacctctccctttctcttcaacggtttaagcaattccattgcaaatgattagggtagacacttattctgttatcattgtaaatactgctcagtggatcttcagtgtttctcagtaatctctttttattctccaatcaaactactacttctagcctggtattcttaaaaagggcctaagccgattggaaaagcataagaggcgatttgcagaacagaaacgactcagcaaagtgcatcgtgctgtcaagttcagcattgaaggcaacaggatgcccctataggcctggccctaccagagtatatacacgagaggtattcccaaggaagcatgtactgtgcatgggcttgaattgtcaacagtcagagtgaaaagtgtgtgtgtgtgtgctttcttaatcagaagaggccaggtctgcttttagtttcaaaataatgaccctaacaggcaccttgggatattcaaggcctcttgaatatttagaaattgacatggaagtcccttcctttatcagtatcctagagagtaatagataattacttccctaatatgcatttgggtcttcctgactggtacccgtttttatgaaaaaggtttttgttaggacccagaattacagtgatatgtgttacaggcatataaactagttagtggtttcctggtgggaggtagcttgtttcctgctgtcagtggctcagcaacatgcatttgagaactcattacataaagccttatactaaatatttaggagatgaatttgattaacacatactcaaaatgtggtcagaagtggaaaagacttgggaacattcataagcccaactcactgatccactatgctttgagactaatggcacctttgttgcggagcacacacagtgtgtgtgtgttgcctgcctatggttcttctccatgacccctgctttggcagctgtttccactgactccactctcctacctgccagttcatgttgctattaagtgactatcaaaacaaaacgtactttcttatttcttgagaataaatcgagggtagagaaggactagttctgtgccaagaacttcctcctctctctctccctcctctttcttgtgcccatatccgtgtccctgaccacctctccatgtcccctgtacctgtttcttttttgcccttctgtcctttttctttttctttttctttttctttttgagacggagtcttgctctgtcgcccaggttggagtgcagtggtgcgatctccactcactgcaagttccgcctcctgggttcacaccattctcctgcctcagcctcccagttagctgggactacaggctcctgccaccatgctcggctaattttttgtatttttagtagagacggggtttcatcctgttagccatgatggtcttgatctcctgacctcgtgatccacccgcctcggcctcccaaagggattacaggcatgagccatctcctttttcattgtttcttctctctttttagccgtctttcatatttctcttaacatttttatttttgagaattgggaactacaatatggcaaagaaaataggtaataaaaactcttagtggccaatctgctttgaaagcagaggttgtgtttccag

SEQ ID NO: 96094 - DNA, 1048 bp, Homo sapiens
ctttcattttaacgtttagtatctacaaagcattgtattgggtactctggggatgtaaggaaaattgagaaaataattcattcaataaagattttattgctgtttgctaagtgctagactccttgttgtgctctgagaatataaaaacaaattaaaaatagtctatgctctcaaaagtgtaagtctttacaaggatgataggcaaagggaggtctttggtaaagccatgggctaagtgtgccaggtctgtgtttggaatggcaagtagactgaaggggttggacagtagtatggggcctgaggtggtagaagataaggttggaaataatagaccggtgaagggctttgaatcaagatgaggaattttcacgtcttgtgattccacaggaagtttttgaggctggatgtgaagccatctggtttgatttgatttagggtgctgatgccaatggcatcatgtaggatggattggagggcagtgggactgaggcagtgatacagctaaacagaggtggtagttgggaaacagaggggtgagaagacattgcagaggcaaagctgtcatatgttggtgacttagtgggagagaagatggctagagttgaagacctcagccaaaattttaacctgagtgctgagacagtgtttattacctttcaccaaaatggagggagaagtagatttgagggaccaggcaagttctcttttgagcatattaaatgtgacatgcctaatgagatagccctataaatattatgggtctagaacttgtaaagagatgtttgggctagagacctagatttgatggttctctccatagaaaagattgttcaatcaagagagtatagagtaagaaacgaactaaacaattttgaaagggggcatagccaggcagagcagccagcgaaggggaatgagcacctgtggtcctgtgcgttggagcagagcctggaggggaatgaggctgagctggaggtggcaatgacaaaagcatgggccagtggcaggtgctgcagagggctttgtgcaggtgtgttggtagtcaggc

SEQ ID NO: 96095 - DNA, 1050 bp, Homo sapiens
ttaaaggtacagaccattttgtaaggtagttgtaaaggagtttgttctgggttaggataagaaagcagaatttcaagacttttttatttccagtagcgtaaacttagaaattagtctgccttttaaaataaataaataaaaattttaaataaatgtcttttatgaaatgtcaatccagctaattgttgactattaaagtgtatcacatgttactttctttaaatctctgtggtgatcttttacattaaattttctgaatcagccagagtcagtcagtacactggcattatgctttgtttatcctataaattactctgaaataatggactcttcaaggaaagaatattctaaatgtctagaatatcccctcacactggggtgcaattatttgaaaaaaatggaaatgcaattttatggacaaaataattgatttttttcttactacagatgagtggtctaggcctatatttggtcttacctcaaactacaaaggaatgacaagagaagaaagggagcagagagatctagaacagatgcctcaacgacgaagaatgaacaggtatgagggaacaggtatgagtaagtggaatacacgttattgttgcagtaactcagttttaagtaagatcattaggaagcctgcaagatgataggatttcctttcctctcagcttgatatgtgtacataattcataatatccttttagtttaaatgtgatagtgtatagtgagggtcctgtcctcctaaccagacctttctgggtcagtttgttggaacagggcctgtttcaggatactgattgcttgtgttgttccatccacttgagaaaacaactttctgggtcccgtttccgagttcctagaagaaaaaatgttatagttttagtttgtattgataatagtggatacagttgcatccaggaggacagggtcattagttacaaatgtggcaattacggctcatccacaaggaaacctgttatgcaaatgaatactaaaatgagtagtactttttaaagattaggaattattttccctgatccatcgtaa

SEQ ID NO: 96096 - DNA, 1050 bp, Homo sapiens
agaatttttaaaaattattgttactgcaggcaggaccttaaagaaacattcattgacagtggtgtgatgtctgccatcaaagaatggctctcacctctaccagataggagtttgcctgcactcaagatccgggaggagctgctgaagatcctgcaagaggttagaggcagataatctgactgttctttattaattatctaatgtggtctgtatggtcataacctgtgtagtttacagtgtttttatatgttatctctgctacagcctgccagaagaggggttggaaaaaaggaacatatctaataaaatgagcgtgaaagggaagaccttataaaacttcatgtaactatcgcattgaagggaaaaaatcttagagtagctgtaatgtgtctgagaagagtagtacagtagtgggcaagttccagggagaaatgtgacgcagaatgaacaccaaattcagaatcatatgaacttgcatttgaatcttgagctgggccaccttacgtagttgtgacaccttgggtaagctatttaacttctgaaggaattcccaaggaaacctcctatgccacgcactgtgccaggtgctttatatatgtattgattcgttttttcctcacagtaaactgagaaggtaggtgtattatttccattttacagatgagggaattaagatgcagagaagttaaacgactcgtcaaggtcacatagctagaaggtggctgtgcttgggttcagtcttaggtctattggattctgaggcctgtgctggctcctgtattaaactgctaacctctgagtacgcttggttcatactttctcacattgttaggttttacttcaactcagctgtaatactgagctctcaacctctttttgttttttttttttttgagacggagttttgcttctggtgcccaggctggagtgcagtggcaccacctcggctcacttcaacctccgcttcctaggttcaagcgattctcctgcctcagcctcccgagtagctgggattacaggcgcctgcctccacacctggctaatttttgt

SEQ ID NO: 96097 - DNA, 2052 bp, Homo sapiens
tgctggagagataattggtataacctctgtggaatacagtttggcaagtatttcgcaatttcatatacataaaactaaatgtgactaggcaaataagtaaacaaattgtggttgcagccatattgtgaaatagtctaaagccttgaaaaaaatgacaagacttaatactgacatggattggcctctagattcttttcttaaatttggaagatgcagagcattatcctgtacccactctgaatagtatgcttcagtttgtgtaataagagaggatatgaagtatgtgtagaagtgcttatataaacagactatttctggaaggaaacacaagaaacctagtaacactagtggctggagagggaccttttgttatgtaccttttgatatctattgaatttttgttctttgtgaatgaattactttaaaaatgcaaaatattaagaacacttaatacagaagaaaatctgtaaggaggttgtgataattttgcatttagggttttaaccaagaagatctggaagaagaaaaaggtgaaacacaggtaaaagaagcagaagattcagattctgatgataacataaagagaggaaaacagtaagtttgtttttaaggaatttgttaaagagaagtttaaaaatcaaggtagagactattaaactctcttttgtttttcattttggttcctgattaagtttaggagtgggtctattcctgtttttctccatttacggtgttgtcagtgaattacctgctgttgttacttgtctttcatttaccctgtgctcagatgtcttactttgtggagttgtatttatatggcaccagacttaatttatggctcaccaagtaaactcttatgaaaaataacctaattttaaaaatacctttttgagagacaagctgatgttgtggggcaggggaaatagtctaacatcttaactacaaaatattacttgaccatatttcacttactttagttgagctagttggaatctatgttcagaaaaatctgatatcttaaaagatgtcatacggtaatagaaggattagttactgttttcagtcgtaaagatgcttttaaaaaatagtttcatttttaattcctagtggcatgcagtaattaaactgaatgagtttggcagtacttttggaaattgaattgataggatagtggcagacaataacttaactccctcttttttaagtgtaatgattctgatgaaagccataaaggtttgaggcgcttagcaagcctgtagttttccatgtgtatctctcattatgttttgagagttatacttcctatcactgaaaagcagcagtttatttttcattttttctactcatgctatataagaccacaacattcaaataattgaacaccttcctagtccaagaaagggcagtgccactaaagctgaatgaatcccctgcattggaacttaaaatgtactttctcaaactgatagatgcaagtgtgaatatagtgcatgaaaagttccgggctattagcgatttatatgtgtatatataacagggtagtacaggaattgaaataaagtctaggatcaaccgttcttttaatagcaggttctaagtacagtcatgcgtcgcttaacaacagggatatattctgaaaaatgtgtcattaggtgattttgttgttgtatcaatatcatagtattatacaaacctacatggtattgcctactacccacctaggctgtatggtaaaacctatcgcacctagggtacaaacctgtgcagcatgttattgtactgaatgctgtaggcagtggtaacacaatggtatttgtgtatctaaacatagaaaagttgcagttaaaatacaatatagttggacgtggtggcttatgcctgtaatctcaacagtttgggaggctgaggcagggggatcacttgaggccaggagttcaagacaagcctgggtgacatatagtgaggccctccctgtctctacaaaacatttaaaaaattagccaggcatgttgtgtgggcctgtagtctcaactattcaggaggctaaggtgg

SEQ ID NO: 96098 - DNA, 3230 bp, Homo sapiens
atgtatgagaaaattcgccttttaaaaaagaaaaaatctagctcttcacggtcagttttctgtagtaatctgagggcatgctttacaaatctgttttgatgaaggctggttatatttccccatttggggatccaaataaaaccatttcactgattggctttctgtgggggtgtttctatatgggtataggacaagaattctccatttaggtgcacataatcctgtattttaaaaaaatcacagaaaaaatttaatgttttattattaatggtttttttttttttgcactttcctaattttttctcactttatttttcagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatgtaaggagttaccttgggctgtttatcaatggctttattcattgtctaagcttgtaactgtggaacattgtatcctcttggtatgtcagatctgtgttctgttattcagcttaatattctaaaatatcagtaggacactcatttcccctggttatcattagctaagcttaatagtaagtttccttggagttctattagcacatattaatctctgactgcctcaaagtgataaaccacatgtcaataggaatataaaatactgttttttttttttaaaactggaagaggtaatgtttcaaagaaatacgtttacataaaaacccctaactgtattaattgttagctgtgggtctctttgacacttagttcactagatcccatccaaacagtaacagctcccacaggtacatctcttcatttgttaaacattgttgaatattcagatacagggaagctttgagaggattctatttagagacaccatctctctccagagtgtttcagtctctgctatctaagactccatttgcacagatagtattacttgtctacttttttatgaaacttatcttttttggaaaagacatatttcattataacctcacagttcttataggagaaggaaaaggtaccagacatgctgtcaatttgttaagggagatgagaaatttcaaactgaccagcaatgatagaggaacatggagactattcctagaaagaaatatgtagtcctttttagttcagttactactaggcaacatagaaaggatgccagttttgcccatcaatctagttttaattttctcgatttcccaaaaggaaaggtggctgcttttatattgatgatatctttcttcatcttttggccagtttttcttaagcaaaataacagataatttgtaagatgactctgaatgagccatttagttattttaaaaattctaaaccatgtgtcaggaggccctctgattttattttatttatttatttatttatttatttatttatttatttttgctgtatactgccatcttaaagcacctgttatgcttagtaatacaatggctgtgataaaataaaattaatgatgattttctttttcaacagcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagagtaagtgacagtataacatgagttttcaggggttcttaattaggcagtagagaggggtctgtgttataatacaatatgtcctgcctaattgcatgtctttggggatttagtattttagttcctgaactgaacacactacaatgtgggtgaatctcagaattcatctcagaattaacatgttaagtgaaagaaagcaaagaggacatatatgattccatttacatgaagttcagtaggcaaaatttatctgtggtgttggaagtcaaggtggcagttgtttctaggatgttgatattggggaccagctagaaggggccatgagaggactttctggggaggctacatgagtgtatagggtgctggttacatgagtgtatatatttgttaaaactcattgaactgaacactgaagatctgcacattttactgtacataaattctattttttaaaaaatggttcctatgcaaatgaggataaagcaaatgaatgtttttacatttgtctactttctagaaatcttattgcagacatatttggagaatct

SEQ ID NO: 96099 - DNA, 1045 bp, Homo sapiens
cactgcaacctccgcttcctgggttcaagtgattctcctgcctcagcctctcaagtagctgggactacaggagtgcgccaccacactcagctaattttttgcatttttcgtagagacagggtttcaccatgttaggcaggatggtctcaatctcctgacctcgtgatctgcccacctcggcctcccaaagtgctgggattacaggcgtgagccactgcgcccggcggcattatagatgtttctaaagcatctaaggaccttctgagtgctcaatttcttttaccattacaactaggaaatgtgttacattattttagaaatgacattaaatgtcagtttcaactgttggtttgttgtactcatctgacttttaaaaaactgtcttttggattttttttaagcttgcaatttaattgccaaaaccactctaaaaactttggatattgttttgataacttttaagcttaactgtataatttccagcatactcgtcccaaattctgtggtggtgttgtctaagtgtattctttagctcgagtctattaaactagtacttctttactgtagtgatttctccccttttttgccctgtcatgccatacataatgctatgttttcgtgaaactcataaaaaattcatgaggattcctaaattttacaatcattgtcttatgcagtgtccttgtaagggtttgttttggaatgctacaccatgtgtcaggaaatctggggtagagtgtagcgggtgagttttggatgactgcccagtgtctctcacttctttgggagtgactcccagtgctgtgccccgatccagctgtaactgattgagtcacagtttctaatattgccttggccagttaagtcatctctcttggggatttataatttaggttctagacagggtatagctgagtcatgttactgatggtactctagtaaaatgatccttgagttcccttttctaagctctctgtgctgcgttggtacttaaccttcccaagtgtttagtcattcaactgactttgatcctgagaagattgtt

SEQ ID NO: 96100 - DNA, 1715 bp, Homo sapiens
agtttgagaccagcctggccaacgtggtgaagcccatctctactaaaaatacaaaaaattagccaggcgtggtggcgggcacctgtaatcccagctactcaggaggctgaggcaggagaatcacttgttgaacccgggggggtggaggttgcagtgagctgagatcacaccattgcactccagcctgggccaaaagagcaaaactgtgtctccaaaaaaaaaaaaagtaattatatgtaatacatgtatataggttaaaatacgattttactctgtattttttaaagtattggggctgggtgtaatcccagcactttaggaggcaaaggcaggaggattgcttgaggccaggagtttgagaccagcctgggcaacatagcaagaccccatctctacaaaaatataaaagaaagttaggtaacagtttgtatttaccattttatatatgcttttcttgaatggattttcactagttttggactggagttccttgtgttcttcatttgtaaacaaatacttactgtatatcaggtactaggcagtgttctgggctccagagatttagcagtgaaccaaaatccctattcttgtggcattttctttcaggtgaagaagacccacgttaaacaaaataacttcaggtagtatattagaaggtgataaatgccatggagagaaagacccaattttaacatgaagttgaaataaattgttgacttggtgtttagtgttgtttcttaagctacaaattgtttttatggtgtagttttgctgccacgtatttcacagtacatgttatgcttgttggtgtttgtatgagtattgtattaccttattcaaaatattagcaactttagttaatgcttcctcagtggtaacttttgcacttacgttattcttgattcagtgtgttcatttcactgtagatgtcattcatcttacaccataagttggtttttgttttgtttttaatcagatgatggtggtgctaccccagtacaggatgaacgggattcagggtcagacggtgaggatgatgtaaatgagcaacactccggatcagacactggaagtgtagaacgtcattcagaggtattggctaaccaacatctttgggagggcttttcccttgcgttctgtgagatctgttatattataggagttacagaatctctgtgacagagtttagggtttaatctctgagagtaaaggagcataagttaatagaaaaccgcttgaaaaataaatagggatggtctggttactgttgaaatcacagtgaaatatgttctgattgggtcacatttcaaatgttaggcagttttcaactgtgcatattgattcagaaaatgggcccggcctttgatatttgactaagtttccctattctgcaataatgtcatagtggggcattgagcatttgcaatctgaagaaacaccacttgaaatagaaagttatgggggttatcacctgtcaacatttatgtcagcatttgcccttctgattttgaactgttacggtgtatataatgtatgtaataataatgcttttttttttgagacagggtctgactctgtaacacaggctggagtacagtggtgagacctcggctcactgcagcctctgcctctgggctcaagctatcctcccacctcatagcctcccgagtagctgggactacaggcacaggccaccacgtccagctatttttgtt

SEQ ID NO: 96101 - DNA, 1026 bp, Homo sapiens
cgtggctgtgggtgagtcgagcatctaggacaggtcataggcctctgtggaggtggcaggtgggcatgtgtggcctcggggagggcctgtggtggcagcgccatggccaggtggtggcagtttcctttgcattagcgccactccatccctggcccgagccctctcccaggcatctggctcctctatgggtcaaggctgcctaatggttaggggcagcggtgctgtcattgcagcctggactgccggcaagccacttcccctctgcaagcccccatcagagggacgaaacaccgctttgtgggctgctgtgaattcagactgtggtcagccttcgatgcacaggtcagaccatcaccaaagagatgggacgagacaggctgctgcctgtctccctgggcagggctccccgctgagtgtttcctctgcttagccctgggctcccagtccaccccacccagcctgccccttacctctagctgctggtccgggaggaagggacaggggtctgcggggcagcaggtgatctccgcccgtgggtgtcggtggtggcagggggctccttgccgctgtgggtggaacgctggctatttaaggagaggaagggagaccacagcccctctggccctgaaaggctgcttcattcctgaggggtcccttgttgtgtcgggctgctcctctggctgctgctgctgctgccaccggagcgtgaatattctagtgtgtccctagcccatgccccccgcccccagcttggccacatagtctgagtgtgtgactgtctcagagactcagagcaggcgggggctgggtggggggcttgggctggagctgagggacacaacaggacgtttcagaaggggatgatttcctactgatggggggcagggaggggccggctgtcatggcaacaggcggcgctcccaggcctgcgcccgcagacggcggagggggcctgtgaacggagggtgggaggccgaggagtcttgctcacggagtgagaggcgactctttgaggacacttgctgt

SEQ ID NO: 96102 - DNA, 1010 bp, Homo sapiens
tccatgcccaggtgcctcccacggctccccctcagacttgccacagctcttcaagcactccacaaccacaccaagcatgccatccacccccacctgtcatcacaggaggggcatcctcccgagccccaccctctgtggcccacctcacagccagtcagttgggtcctgtccactccacctcccagaaccctgagtcagcctcctctcctccacccgctcagccacccaggagaggcctccctagtggctgccttctgtctccttccccatctccttcccagcagccctttctccacacagcacccatgggttcatctgcagacagcatggccacacatgccactccaggtcactttggtggctccccacagccctccctctgctcttgcctggtgaggtcctagggagagctggcagggagaagccctgaaggtatgcgagcagagagggtgtttcccaaaagcagcctggctctgggcagcatgggggatcccgagagaaccaggatccaggcacgaggagctgcccgggatcacatgggaacagtggacgtggggaagggcacccagcatgaaacggtggaaatgaaactccactgcttctgggacaggaaaactctcgcccactccgaaggccgggttggatgtctgttcctcacagactggcccggcccaatccctgtgtatggaaggcagggaagccagtggggcaccagcactgcgggcagcagggtcacctttgaaggagcgggtgcattacactcagatcgctcacagctgcgtcaaacaaactccaggagaaaggactgcggggagccaccgaactgcataaagggaggctcttgggagtggaactgtggcagtttccttctctttatgtttctgttatcttttatgtttccaggtttctccttattctctaagacgagtagtattgcctggacgaggaacgccctacacagtgcctgccaaaggctgactgtcatccctgtgtcatttgagggtaagagt

SEQ ID NO: 96103 - DNA, 1002 bp, Homo sapiens
gagagaataatttccaagtcttagtatagccaaaacaaaaaactaccgtcgctaagctacatctaccactggattttaaaatgacaaaacagcctgagaaaaatcacaagagcagctaactcgaagaaaaatcctttttctttactcagccgaacctaagaccacagttacttcgaaagcaacttctaataaccgtctcacatcctgtcaccagttcaatgacaaaatctcagttttcagagcgtgtgccaagtccagcacaaaaagctgacatcgaggagctcccaacgctgctgtcgcctccgctggcagcagccgctcccggattagactcgcaggctgttagggcagggccttcgccacgggcttccgcacagcggcgtgcagtcctcagctcggccggcgcggtctccgacggcgctggctccgcgtacttccccagcggcgagggcgcgaggtcctcacacgggcagcaccttggcgaggccggcgccgcggcccaggcgacccagtgcgaggcgcagcgcggtgccgccgccccagggcagcagcccaaccagcgcggccagcagcgcggccacctgcgcgcccgcgcccagcaccgtgagcagcgtgctgcgaaggcccagcgcggcgaacagcgtggcgcccagcgctgccatgtagagcagcgcgggccgggacggcgcttcttcgcagcgcagcaggcgtccgcacgccgcgccgccccgcagcagcgcgcttcccgccaacgccagcgccgagcccagtgaccagagcagcgcgaacttgcgcgcgcgcagcagcaacaccggtgcgtagagcgcggctaggccgaaacacagtgcagccagcagcaggcacccgccgcccgccgccagccgctgcccgcgcgtcacgctcgggaggcacgtcaggccggccgctgccgactccgcagggctccgcgcccacgtccagcgcaagcccgcgcggcccagccactcctccgccggccggtcc

SEQ ID NO: 96104 - DNA, 1040 bp, Homo sapiens
tttatttctgactaacatcaagttcctctcctcatcataacaaggcgattcaaacctaaactgtgattcttaggagatgcttccaaggggaagctccctcgttggacatccagaagattgcattttctcttcagagtacaattttccatctgtcagagcatgtctgaataaaaatttgaacctactacaaactacattagaataattttcaagtatttttctgtcacaaaaatggtgtgacagaatgtgttgaaaaacacaaagttcacagctgagattaatttagataacctagtggttaatatgctcatgaacatcagcaacaaccgtgcattccttggcagatgggatgcgatggaaaccaaaggtttccttaaggcaagcacttcacaactagttttctgtcaattcttgcgtaaatcacattctgtattcatacaaaaactttgtttttctctgacaaactgtacacatagaaacaaatttccaaatggacaggaacttaaatttgtggagatgccccatgtcttgtgagacttaaaaaaaagaaaaagatcccagcttttatcttcacaaaacaacatgggagttggggcaatgagggtggacaggacagggccagccaggctggtagctggcagcagtctcttcatcttgaagacctcattgagggttcctgggattcaggtgcccagaaaagagttcagggctacaatggtgcaggcttccttttgtttctcttggtgagtccacaagaagttcttacatactgtccagagaggcctcagggtactcagttccagcttctaccgaccccttccaccaccccgtgaagctcctcgcctcggcgggccagagttcatgttactccctctaccccagttactgccactccggccccctcgagaaggggtgccactgcctggagggcccccaaaaggttcatctctgtggtatccatcgtggtgctctccgtctaaggagctggaacgcccagatttgggcactctctgagcaggtcctgggccccctcggcctga

SEQ ID NO: 96105 - DNA, 1033 bp, Homo sapiens
tctgctgcacatgcccttgcagcctgggctgtgcagaggcacatgctcctaaatgtggtgccagtgccacacgagctgtcatctggtggactgcaactcagccctgcacaggactccacttgcctccgggaatccctgttcacttgaggttttcacttcagccctctgccaagatgccccagcactctctgctcggcttgctgtctgggagccctgctctccttggcagtctgccctccacaaggctgcttggaaccctcaagggctctcagtgggaggggaagagttgtcctctcctgggtggtctgttggtttttttagcctgggtctagaggaacactgcttgtgctcaaagtcacagagactttgggaaacatggtctatgggcagtgtttccaggggcacagtagattatctcctcaactgggaactgtggagctttatgttataggcagcactaactttagccaggagtagttgcctctgaaggctgactatacaactctggttgcaaggcagcgggggaggtgcataggtggtgtggctcggaagcttctgggaaggctgctccccgcatgccccagcttgtgctctgctcctgaagttggcctgtctgtatggacggtccttccagtacagagttctgccatttggtctttttgggtttttttctgtcgcccaggctggagtgcagtggtgtgatcttggcttactgcaagcaacccccgcctcccaggttcaagtgattcttgtgcctcagtctccccagtagctggaactacaggtgtgcgccaccatgcttttgtgtttttagagagatgggcttttgccatgttggctaggctggtctcgaactcctggcctcaagtgatccacctgccttggcctctcatgagccaccatgcctggcctgccatttgatcttgatagttgtttgtctcaacaaaaccctcagaaattaccttatgtatcatcaatagatcaccctgcataaacacattgtactactagccagtgtgctgtgaccttggct

SEQ ID NO: 96106 - DNA, 1008 bp, Homo sapiens
gtttttgcctctgatagtattaataggattatataatgtatcctttcaaaaatatatagttttattttgttttcctcccaattaacattgtatcatgctttctcatatcatatgcttctttgaaacatgaacttagagtggcaaggtgttctctgagatggacattctgctgttttctctttacagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggtgagcgagttactaaagacacctggtctggaaggatagggtgcagaatacactggttgtgaatacaccaggaacagtctgagtgcagcattgtttgctctgttgtgtaggaggaaggaagggtttacttcccactcctgacgagttccctcgctttgaaggagggcggaagccagattcctgggatggaaacagagagcctggtaaggaaaagaaccgcttgttgggtaactctagactgcagttcacaaagtgagttctgagggccctctctggggtgcaccgggtctcctctttccagctcatgtctcccggggggctgggctgtctcctgtcctgcagccgcagcacttgatctcagcaggtggaatgcagagcagaggaatccgccagacattacagggatctatctgagtataaaacgggactgctctttccactaaattgcttttggagaataaagttaagtgaattaaaatttccccagtctcaattgctaatatggtaaatattcgcagttacaactctcattaacaaaatctcttaggagtcctcagtaatttgagactgtaaagacgtcttgatactacaatgcctgagaacgagttctctggatcttacctgcccctcttacatgaggaggcaccctgatgtctgg

SEQ ID NO: 96107 - DNA, 1054 bp, Homo sapiens
taccaaaatgatttatgttgagaaatgttgataaaaattatataaatgacataatacttaaaatctattcttccaataatgtgttcattgatcaagtggccaatttcttttatttaagaggcaaaccacttttctttacggttacagggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggtaagtaaaagtgactccacctcatccacgcagagaggttttggttggttagtttgaggtttctcttggattatctcactgttgaaggtgtttctgtactggagcatttttcccatgttcacgtactcttagacatggttctcatctactgctttgcagttgtattgagtttgttatcagtcttctctgttctgtcctcacctgcttattatcatccatgctatgagaggaaatagaagaaagaggcatggagcagagggagtatgggagtatgttgcttctcttctccattgtttatctatcttgtgctttaattgtcccctcaacacaaagtgcatgtaccctgtgaagaggctggcaagctttgcattcttaataacatgcagtgtcttgcagcttttatcaccatagtaatttctacctagtaatatgtcagtaagaattagcatgagtcatgtacttgagtcatggagaaaaggtaaaaagaaataaaatcggttcagaggttagattgagcagatgacattgtagagtggttttctcattctatcattgtaattttcatacttagcgtacattttaatattctcttctttcccaaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggaggtgtgtgaagct

SEQ ID NO: 96108 - DNA, 3153 bp, Homo sapiens
taagtgctcattacactgcctaaaatatagcaggcctgcagtaggatagctgttattattacctcatctaactgtcacaacatgtgcgaatcaagcagagtgtatttctcctgcatttcagtaaacaggagctgaaagctggcttttcctgtcattccatctagaaagtggtgtcctaaattcctaaatggtggtcccaaagtcctaaattcaggttgaatcaagttcgtctgtaagaactatcacaaagtgggacaactgaagtgagtgacagggattgtgccctataatcagggtaatcgggaacaacatgagacacttcaaaatctttacataatggggtcttgaggggtgcagcctccaaaagcctcgactgacctcccggcaagtaggtgagaagatgcacttgggtccaggagaggactggctcctgtgtgtcttgacataggaggagaggatactgtatctgaaaaatttccagacacacagaggccaaagagtcttcacaaaacaagttttaagttgactgagcactgagagcaaaacatttactaggtttctctactttggtttaaattgctttaaatgcatgtaactaattaggttttaatcctaacttgtttccgacagggcatggtgctgatgtgaaatgtgtagactggcatccaaccaaagggttagttgtttcaggaagtaaagatagtcaacagccaatcaagttctgggatcccaagactgggcagagtcttgcaacactgtaagtgacaggaaccccaccttggcccctgaacaaaggggagcaaagcagtgtgtcctttaacttttagctttgttttctcttatgtatttctggaagagtcatttaggcaacagatggacttggatctatagacttcttatgaattaaatatgattcatctctgaactcttaatgaagtaaggcttgtttttgtcctgccacatagacctaagtttaatttggttgttatatacgggtggggaggaggatgaggagggaggtggttactattctagcctattgcctgtcatcagaataccttgtggcactgtgaggagttgacgtgtgtgccccttactagacacggcccagccttctccatctcacaacatctgtttcgagagggttttcttctggttttgaaccacttctcattttttgtctgatgggcttacttacgatgcagctatgtaatctagttttctctttcagttatttgtgaacattcacagctacatgcatatgttaacatttttttgaccaagcatccatttcctggtctttctgattgggaagagaaccatattcagagtgaattggttggagcaaggctgctttgttgtacaaccccaatgaccatgccaacctggaatgccttgtgaatgctcccttggagatatccattgtgcaggccaggggttgttgcattgtctttagttcaaattaactttcagactttccagtccatttttatgctttgtcttaattagagaaactttatggaagtttcaaaatgtaatgagctttattgaatattaatttctgtgttcatgtgcttcccctgcttcacggataaattttactgttcagtggaagctctgctactgtattattattattattattattattattattattattattattattttgagacagagtctcgctctgtcacccagactagagtgcattggtgcaatctcggctcactgcaacctctgcctcctgggttcaagtgattctcctgcctcagcctcctgagtagctgggactacaggcatgcgccatcacgcctggctaatttttgtatttttagtagagtctgggtttcaccatgttggccaggctggtcttgaactgacctcaggtgatccactcgcctaggcttcccaaagtgctgggattacaggcgtgagccatcacgcccagcctctgctgcttttttaactggttgatgagagctgtctttgtctgggcagtgcatattatttctgtcgttgacttgtttctttcaagtgtgtttataactgtgatcctttaatgttacaggctttattgcttctaggccaaacctcttgccatcttgattaattcgcttttcaacaaaaatggccattgtatttatacttgttttgaattctgacatttttttttgatactttgtttctagtcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacaggtcagtggctgtgatatgcttctcattgaccactgttacctgtaacattctcagatcctgataattgtgtcttttcccatgtttttgttctgcagctgtggcctggcatcctgttcatgaaggactttttgccagtggagggtctgatggttctttgttattctggcatgttgggtatgtaagatttatgtgaaaaagtagtgtattttgtgaagagagcacgtgaatgtgtgcagacatgatagttttgtagcttttctaagtgttcatatatcctatatcagagactgcttgcagttttcagttctgtaaatccagcttggaatagaaaatgtacctctgtttgtggatatggaagtcattaaggaggaataaaatagattttctagtttctaaatgcttgcagccttttcccctgtgaagtgctctttggatgaaagggtaactgtcctttggcaatgacaagccaataccccgagacatgtggaattcaccagagtccaagtccaggctttggtagcttcattttaagagtaacagaaaatgtcttttttgagggggagggagaagctgggtaacttttgtgaacaaatcttctctctttggtgctgttgcagggtagagaaggaagtgggtgggatggagatggctcacgaagggatgatctggagtctggcttggcatcctcttgggcatattctctgctcaggctcaaatgaccatactaggtaagctttatattgaaatagcaaagctttatatggagcaacaggaaataaatactgtatgtgtttatttttattggt

SEQ ID NO: 96109 - DNA, 1062 bp, Homo sapiens
taatcccaaatttgattgattaatgcatacatagctatacataatatttatttttaggtgacaatggcccatagagttttaaaattccctaccttttcaggggcaaatagttaattaaaatttcttaaggcaaacaaggggcaagggggactgaagtatttttatatttcaattattccatcttcagttatttttctttttaaaagacaaagcaacagcaaaacctctcttcccccttcccacccagttacaaaatatgttcattgtagaaaatataaaaatatagaataaacatggggagagagaatcaataccaccttccagcttaatattatttctgttaacaattcggtgtctagacttcttggcttttttctttaatttagataagctcacacagtcactcatgttattgactgtttgccttttacagtgatggtatacactggtgtatttttttaaaataaattatgaacattttaatcatgccattaaatcatctatagggtcatttataataggtgcatcacattcctttaagtacatatgccacactgcaatttattttgtaatatatttgtgttctattaaaaacaaattgtgtcagtaaatgtccttgcagataaatccctttgcacatccattatttcctaatgataaaatctaagacatgagattattgggttgtaggagatgtactttctcatacttttgatacatacagccaaactgttctccagattgttgtcacctccctacatgcttgccagtacggggtattgtgttgggataaacctatgtccatttgagacccaaattgtctccccttatgaacgggtacaaatcactgtcggtgcctctaccccgtctcttctttcccacttcacttccctttgtctgtattcttctgtatccttccttgtttccacctcagaacttcacagaagctggatttgatccagggtagagaaggaagctctgaatgttcttcctcactcctcatctgcttcttagtttatttgttatgtaaaatatccttggggctttgtacagcatccagtt

SEQ ID NO: 96110 - DNA, 1080 bp, Homo sapiens
gcaggtcttctcaagctctggtatcattgaaagataattttttgttgttgctgttcattgtacaactgagataaataaaaataagattgtggaaatttaaagggacactttctttagggccagttattgtccaatagggtttttttgttttttgttttttgttttgtgacgacggaagtattctatatctctcctgtctgatattcttagccactagtcacgtgtgactattaagcccttgaaatgtcactgatatgactgagaaactaaaattttaaccctaaaacaaatttaaacagccgtatatggctaataggtgccatatgggacagtgcaggttaaattcttaagtatttgtgttcagagggaattccacacagatttataatggtctttttctttatatagtgatctacaactggaatgtcttaattttagaattttgcaattgtacctccaagtccaagtcgtactgctgaatctttcatgtgcccatatcactggcttctttaagctctgccatcctactgaggattctgcatgtccaccacagtctacctatagactcctgtcagtcccctgcagggccacactttgtgcctgtagtggactttgtagtgtctggagcagatttggtgctgttcggaattttatcttccttttttttgttgtcaggggcttgattctgagaagtttaattacttgaaaaactgcctggtctttcatcagcaagaaattttcagtactaaaatctttagcctttagggagatgtttttagtactataacgtctagtcaccaggctacaaaaactctcgttacctgggtgaattttccattaagtctgtattcttgcagtattacaaacactacattcttggaattttcacatttggggaatcacaaagagcctggaatgattgtatcatgaaattctgtacctcagaaatgaaatgatcaaatttagtatagaggcattctttaggcttaatgtttgaaattaataaaccatgtgtttggtacttaatcatttttttctatgaaataataatttagataagattaagtttctatgtacggt

SEQ ID NO: 96111 - DNA, 1020 bp, Homo sapiens
tttctagaatctcctttttaacacattaggcatttttttcattaggaaaattatcttgtttgcattctgcactttgctatttcaagtgtggttacatagcatattttaaaagggggagagagttttctgtttttattttgtggagaaaggtctttaaaagtgcattcatgtttttttaaagcttaatttcaatcttgatccagaagacttttattctaagtattaactttcttaaaaagctgttgttctagcactatgtaaccctacaaatactccccagtattcaggtcttgttttgtttggtgaccacatatttgagaggttgagcaccaataacaggagctcaataaacgttggcatcatgcacatttattttgaattaatgagtggaagtggaagagtacataaatgaatatgtgaaagaacgagtagaataagtgaaatcgtttacttcctgtttgctgtacattttaatgctattaatggtcactttctgcaaataattattacaaagtagtaagtcaaacatttctggcatattagacacaggttaatctacaaagcagcatcacctgtctccaggagatgctaattctgtcactggtcatttagctaggactctgaaggaacgtttagctggatagctagctaaggaatgatgcaaactcactgttctcaatgcttaatatctaaaaataactcagtgtgattaatttggaatttcttttggtggagttagtttatggttgtcacattccttcattccgaacaagactctggtcttcagaatcaatatgtttacttattaaatagtcaaaagaattatgtatttatccctaaattattttcttatatagttctgagaggtggaaaggagtatagaagttgtcatatacaagctcttcagttacagttgagaaagtgaaagttgatttgtaattggaacagaagggactatccacttcatctggatgttatatttagtgagatgaagacaggattggatgaggaggaagaaaa

SEQ ID NO: 96112 - DNA, 2427 bp, Homo sapiens
attgttactgaattgtgaatatctgcagaaatgtttactagagaacctgtgactgttgaataacatgtgcccgaacatacacacacacatatgtacacacacacctcagagtactctttcttacagcggactttgctgctgctttctgcatgtgtgggacactggtatctcccgtctcagacaaatggctgatgttctctatgatattggtgttaatatcaaagaattgaatgaatacaacagaattgaggttgaaaaatatttgattgccacattcctttaagcatctttgatgaatactctgcaaagtagcctttaaaaaaatgtaaattttttaaaaagtccacagaggagaatttgctggttagcacaaaacatactgcaaaattgcttctttctggttattataactgaagaatatagaagattgacacacattttatacaccctcaggcagtgttttggaataatattgtaccttttcaaattgttatcaattaactgtttttctccatttcataattctcaagatttttctaaatacagcctttaaatttgactcaaatggaaattgtgcactttcctgtttatacccttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggcccctttacatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaataaattgcatattccttgaccagagcacagattacttatgcttcttaattttttaaaatcttaaatcctctgtccaactggagtatctggctatgggccatgggtactcatataccctttgtcttaaactgatctgttacattttatgttcttgtggctagaagtagcctgagtttgctgttaatgtttaacacattttcttgagtaacagttctgttaatattgtacaagatggtacttgaattctttgtttgccttttttcttcctgtattagaaaatcttggtgctttttataagttttgtataaaagaattttttttaagatttgttcataaaatggtctgatccaggaaaaataaaatgggaacatggacaccatttctgaccttcaaataaaacttattatgtattggttttcagactgttcaccgagctttgggatcctatggactgtctcaagacaggttatttaggggcttggggtaacaggttccttaggatctgatgaggtggaggaggggtgatcaggtggaggaggggtgagggcctgagaaaaatgcacagggcacaaagtttacatccagtttcacagaagccagggaacctcctcctttaagggaatagtcaaaaagcagaccttctgcccttactggttctagccttcactgcactacactttacggttctgggacagggaataatgaacaagaagtcttcactatctacaaagcaagtctagaatgtctgttcaccaaatatctaatacctaatc

SEQ ID NO: 96113 - DNA, 1033 bp, Homo sapiens
ttgagatggagtttcgctcttgttgcccaggctggagtgcaatggcacgatctcagctcactgcaacctctgcctcccaagttcatcctgggttcaagtgtttctcctgcctcagcctctggagtggctgggattacagacacccaccaccacacctggctaattttttgtatttttagtagagacagagtttcattatgttggccaggctgatcttgaactcctgacttcaggtgatccacccgcctcggcctcccaaagtgctgggattacaggtgtgagccaccgtgcccagccggaaagtgttatttttatcaactgcatgtttacttttcaagaatttctagtggttctctaatcttttcatttttcaaggaagcctgttttgtagttggtttgtttttaaggaatataccccttaaaacctttaacatagtaattggggtgtttgtgtggatgtctggtttgatctgttgttcctgtttgttttccctaaagtcatataatctgtatttttctctttcctggtacttgctttttctcaaataacgcagtgacccttggttgtccagagatttgaatggtggtttgtattggttagtataagtagctatcttgcatttttttgcagttaagttcgcttacctacaagggtcctctcctggatggaagatctcactgtggattcgtgtgtctgtgtgtgtgcttgtacatgtgtacacacgtgcatgtttgtgtgtgtttaatgaagtgagtggagaagcacaggccactgccacatttatcaagtaagtgggttgtggtttgtactctgaggtggagtgcttaagtttattccactcttaagtggaactgccatctttctctcctccctcccttctcttttctctttttctcctcctctcccattctctctttgccctccacttctttccattttcagtgtcatccgtggcatttctgcagactttgtgctgctttactcttcagcctcaaatcctgctctagggtttcttcccagactgaaatgtgc

SEQ ID NO: 96114 - DNA, 1057 bp, Homo sapiens
ttacaatatcttgaaaaaatatgaagcccataaagtggtatgtctgtggtatgagctgtttatttggacatttttaatagtcattttaagttggatcaaaatcagatacttcattgttagaaatatttatataaccagcactttggttgcttcacaagtcctcatttaatctgtttttcttcagtctttgattttctttgttgctgtttctgtaaaggaatcatgaaagaaaaaccattgtttaaatacagttaagggtgagaaaccttcactccgccatatttctttgattttgtgttcagtatgttggttgaagatgagaagtacagaccagacactgggaacttcgtggtcccatgtattccaacatcacactggtcccaaagagcacagaggcagtaatgctgctgcagatatctgattaaccagaattctctctgggaaggatcgatagcacagttatgtgatttttatatgcttgactgggttgaacaaataaactctgggtcgtacatttacacaaatgtgttcttcagaatacaacaactatgccactgaaggccgctctcagtatgcgttttaaagaagtgtttccactagttaaaatggatttacattgatccttctatatctggtcctgtgatcaggaagatgataagtacaaaggcaagctgactgcataacaataactgatgtatatggggatctcgcaacctggcttcgttagcagtgccattctctaaccaatcaagccgaagaccaaatgcaacactgagatgcatttttttcatcagtcatgcatggtgaaaggtatattctatgaattgcatggaagtaagaattggagacagtactttttggtaggtttacaatatcttgaaaaaatatgaagtgcaggatgaaggtgtattcacacctacacaatatgccatatggaagcctgagatctgtggtggaagagtactggggaatgtaagggtggaaaggtaaggaaagaattgggtgggattaagagttgtttttcttgagaacttctgccttttacaaaggtaataaa

SEQ ID NO: 96115 - DNA, 1273 bp, Homo sapiens
ctaaattgtgtagatgccagaattaattttcatataatttagacacatagatttgtggtgtattctcttggttaaagtgccttgaaaataaggctttgtattttgaaactaaatctgtttgggcgaaactcactttggtgatctccacaaaattcactggttttgatcatcttctataatcgtatatttacatttttttaaataacatccatttaccagaattgatgctgaatagtaccagtttactgtgtcttttcataggcaatgatgagtgcaagtctatttgtaataagtattttttctataaaaagaagggtaactattgtgtattgttaactttaaaatgtaatgatagaagaatatagtgtaattactgtttacagtggttaagtgacaaagaagaaattattaatgttgttaaacctcctctttagctgctccaaaattctagttacagtggtagtttctgcttggcacaatctccgtatttcctctggggaactttaaacatcactcagctgagagtcagcaagtttggctttgaatccccgctttgccactgggcaagtcaagtctttctcagcttgcctctcctcgtctgtaaaggagagctaatgatacctacctcacagggctgttgtgaggaccacagacatactctgcacagtgcaggatgaagcaaatgtttgttgctaaagtcataaatatcaaggaaagatgctaaaagacaagataggagtaaagaaaataacatattttacttaatttgatttaagaggagattggaattgagtaggaaaggtattaaaagagaggtattaaaggtattaaggaaaggtatttatgggaggagattattggatcaaaaattagtattggaatatgattatcttttcagtagtgatttttaggtttagaagtgtgattgataaagttgtaagccacatttaaatagataacattatattgaaatagaactatgacttctttttaaagctttatttatgtaagtcctcatattttatttccactatcatctcagaaccacaggagtgccagaaggcaatccttcacaccctgcattagagttgttctcttcattgcctttgcttgcttacctttttttttttttttttttaattattttatgttttagagacagagtctcgctctgtctcccaggctggcatgcaatggtatgatcatagttcactgcaaccttgaactccagggctcaagtaattctcctgcctcagcctcctgagtagctggg

SEQ ID NO: 96116 - DNA, 1417 bp, Homo sapiens
gatgtgctgccgccaattgaaatgatccttgattaactcctgcttattctcttgatcaatttggctgtaaaagcttctcctctgctttaacagtttttaatgctttttactttacctgagccatttaaaacattttaccatggtcttgacattaaaagcaaaactgaagaaatcttacaccagcatcatccaaagctgccctccctgtgaattatagttttagagtcattttctaagcctagaacatttagtctattttcatttcactgttagtatttacaagtgtgaatacccttcagttaaagaccactaggagtacacctgtcatagagcaggttggatttattgctcattgcagcaaagaacacagaccgcagggaaccatggggtgtcctagtaacagggtgttataatgtattataggatttgggctttggataattttggggggaaggtctaaggacatgagggcttgctctagatagggtgctgtcggaaaacagaggcaattctatgattgggtatcaacagatcttatagagggggtcaagtagattgaggttaaagctgtaattggtgaagaaatagctgtcactcattcagcaagaaagagaattttgtattttgtgggttgtacagtgacctagttttttctcactttgccatggtcttggagtgactacttttgatattgacgttcagtgagattgtccaacaggagcgtggaatgtttaagctgtacatgtcagaacagtttgtagtaacaccaaggcttagcttgaacatcagattagttctcagaggtcaggggctgctgctttttactttcttgaacatattgaaatccagacagacttgaggtcaggatttagtagcagcgacatgctcggcaggcacaggttggaaccagctgaaatgatgccagcagtatgtttttacaaaacggagcaattggggagaatttggtggcatgttaaccagcattagacaagcaggatacattataggcaaaagcagcctcttcagatagtaccactagttttgccactggcgtatagaattttcccatagaaatagagaatgtcatcatgtatcatcattgaaatcttcatagttgcttttatgctaacgttgagtgctcatgggaacctcaaaatctttaaataaaggttttagattgtaaaagtttttacttttttttttttttcggtagagcagcggtagccctaaaatattgttgatttggaccaaactgaggataaaatgttttcagaataagatttttctcctaaagactatttcacacagaaatatttgttcattttaggttttaaacactgtatgttaaactgttgtttgtattttatttattaggtacagtacataatttcgtatggaaaaaacagcatattccaga

SEQ ID NO: 96117 - DNA, 1041 bp, Homo sapiens
actttttaattgtatatatacagtaaatgcacaagtcttaaatgtacagtataatggattttttgtatttatacacttgcctaactacctctagataagaaatggaataattttaggagtcaaagatttcttcatgcccctttcccaccttagctttttactaggtaggttaggctttgaaagatactttcattaagttatttttctttttctttactgttctttacattttgtgatttttgtggtttttatctcaccttcctctgtgtagagttgtcttaattacctttcgttgatttgagtctatattcttttttaaaaaatagatgcagtcctgaatctagatgcctccatattcttttaaaaatgctgttttattactttttctgatcagtttcttctgctagtctcctgctactaaaaccaattctttggaagtatataaagagacactattgcatatgattacaatcacaaactctagaagctgaatgttagtcacagtttcagctcttagcagccatgtgacactggggcaagttacaatattttgtgtcctcatctgtgaagtgaggtgttgaactcattgatatgtcatttccaaagtgaatttcagagcctgcttccaaatctctggactattttaggataaaagtggttatttcagaacttttctcatttgaatatttttcagccactgttatgacagtagtatatataggcttttatatttataagcaatctataaatatgactacttgtttaaacaaagctgtcatgattttttagtgtttttagatgtaaaaaattcaacagatatgaacttagaattggtctttttgaagtcctttaaaagggctatgcgtggtggctcatgcctgtaatcccagcactttgggaggccaaggcaggtggatcacttgaggtcaggcatttgagaccagcctggccaacatggtgaaaccccgtctctactaaaaatacaaaaattagctgggcgtggtggcacatgcctgtaatcccagcttctcgggaggctga

SEQ ID NO: 96118 - DNA, 1218 bp, Homo sapiens
aggggagtatcagaacaaatactgggtttggtttttttttttcatagtaatttttttcccctttaattacctttttttttttttttggagttggaatcttgctctgttgcccaggctggagtgcagtggcatgatctcagctcattgcaacctctgcctcccgggttcaagcaattctcgtgtctcagcctcctgagtagctgggactacaggcatgcaccacaagacccagctaatttttgtatttttagtggagacagcgtttcaccatgtcagccaggctggtctcgaactcctgacctcaagtgatccgctcgtctcagcctcccaaagtgtagtcattacgggtgtgagccactgtgcctggccacttttttatggtataccagaaaactgtagctcagcaatttctgagaagcacctatgatctctttagttgtaaagagaccagagtgaggatttctgtttgttttgtcacgaatggaaattgtaagtattctaccatattgaaacattagaaaatactgaaggaagtcagcatgaatatagaaacaaggagtaaaagggtgggttttaggaactccttgtcaggaagctcaatattttgtctccaacagacatttttaatgttattaaacaaaagtagtttgtgatgccatgagtcatcaaagattagattagtagttcttaatcccatcaggccagataactgcttttttgaataaataatttgtagtctgtacacttctgaagtgaacttcattgatgactgccacacacaaatttctaaaaaaggcaccaccacaggtacgcacacatgcatgcacgcgcaggcttggagaaagccttactgcttccattgagaaatagtggtctggaataaatcatgctaaaataatcctatttttttaataggattgctggagtggtcaaggacattgtagccagaacaatacaggcaaccttttgagctaatttgtggatcatggtagaggaacatggctttttagctgcatgagtgaaaggtcattcccaaagtaagttttccctggatgtttgttacctgtgagacaagtatgcagagagtgctgtaagattctttacttggccccgtcctatttaacagtttatattaatgtagatggtcttgctttgtaatttatagctgattcaaaacgacaagtagaagttcactagatttcaggatttgagaagata

SEQ ID NO: 96119 - DNA, 7137 bp, Homo sapiens
cctgggaggtggaggttgcagtgagcctagattgtgccactgcactctagcctgggcgacaagatcgaaactctgtttcaaaaaaaaaaaagaaacattgttatgtgagtagaagcaaccagtgtgtagtctaattttttttttaatcagggaatttggttaaaggggtatgatgtgcagctaattttaatatcctcttagcatagcatggaaaacctttttgaaaagaataaaatccgagcatccatatcttataaggtgggtaaatgttctcatttggggattacgctataaggtttgaggaagaatttgcacatagtagaggcacagtcaaaatcaaaaggtattaaggtataaagactgtgggctctgtgtctacagtttggttgtctgtagtattgaccgggttaggatccataccagataacagaaactagaaagaggggaggcttttaatctgataatcaaaactgtgacttacaggtaagcaatgaaaagccaaattgtcatatatatttgtgtaatttaagaaataaccttcattttatatatccttactgtttctataagcacatatgtatttgtatttttcaactttgtcggagtttttggaaaataggattgttgtattgccattttgtatatttacatcttttaaggaaaatgagtgtgtgatccatcatagaaacttgaaaataaaaagtaaaaacaaaaaatttgaatgtttcaaattaaccagcacatatgccacagatttcctttagtatgcaaattgtgacatcaaaatactgatgtaaaaatatttaaagggccttaagtgcaaaaagtaataaaggactttaggtttaatttaaaaagagaaaaggtgcacttaaaagtgcaaaaaaagttattggcatagtcattccctgaaaatatatacatctatgtgtatccattagaattaaaacttttggtgtagtgttaattagtcatggcactattatggttttttttgagagtagatcagcgtaagagttatcactgcttggtactttgaatggaggagagcttacttttttttttttttttaaatatgtttagctgcaggaagagtttgaaagcctcagtgtccttaaatcggtacttattattatcttgtttttttaattaaacactggtaacttttctttctgaatttgtcctctcttacttgtaagcaccatatcctttattcagtctttgagttgttctggtgactgatcaccttatttatgttagtctatcgtatagcctagggaaatgaggtctttgcatattctgttttgaaatggtctttagcatgcatacgtgtgtgtaatttagtgagtaggtgcgtatactcataatgtacttactgtctttaatttagctaataaaccaaaggactagagctttccttgcacagtgttaagttgttttctgacaaagtacttctgataaagctgagctacatttaagtgaaagtcagtatcattatttaatgtcagttattgcatgttttacaaatacctttaatatgtttttcaaaattagtgaagttggaggatgtataacctgtctttttttctcccttagtggactccagaaggaagacgcttggtcactggagcttctagtggggagtttaccctgtggaatggactcactttcaattttgaaacaatattacaggtaatgataatcaccagatggtatcatcatcctgtggtactgtaaagaacttgagatatagtcatttcattggcattgttaaacttagaattgggacgaattattacctcgagtcagttatatgctcttgtaagcctttagtcatatattctttgaagcagcaccttactaattaatgttttctgctttcacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgaggtacgtgtactaacagtactgattggaatatttaaatagggaagacatttgtggttaaatcatcacaaaaccacaatactggcttacacctccattcaattttttttacatatacacaccgtctcaggctcttcaaaaaaacccagcactttctctgactcacagtcattttgtaggtttttactaccagtgttatctttgaatttttcagctgtaaattaaatacaagagtgcctcccccttacttgcttatctgtatgcatcttttagggctgtattccttttccttccttgtagccagggtacttgttcccaacatattgacactgtggtttgatttagatagccgtcattctcctggcagtccttttacaatatgaattaaccgacaagatagaggtatcaaagctacacttcttagtgttactatttttgaaagcagttggtttttcagtacaccacatttgtactacatggccggcttgttactaagttcgggtggcattgctgcttgtttacttttgttgattttataattaataaacctctatgaaattacttcattccgtaactgaagtccatattctcacttcgattattttagattatgcattagaatattggactttataaagtgggactgttgaaatattaacagtacatcaatgtgagttacgtgaattcagtggtggtagagttaaggaatttgttgtatatatgcaatacaaacatcacaacaaagacacttctaactggatcctgttagtttattaagtaggaaggtagttttctccagtgcttaatttgaaccttttgaatgtactgtttaacaaacagtaccttctactccgtacccttgattccaggatgccacaaaagtaccatctttctctgacacataaatacagggtgggaggatgggtgctacgggtgttgggtgtcaaattattattcagagcttttcccttatgttcaagagtcagcagagatcgttgtcttggttgaatcgttaagtttctcacagtttttcagagctttagctgtagcatataatgttgatgttttgtagacaggaaagactcttgagatactttaatgtgtatttcagcccatatttcaagccagtatcttccatcacatttgcttcaacactcctgacttggcacattttgtttgggtttatccacagtactgtatgactgtagcttttgtaagaatagggaacctgtcacattgagggagtttactcactataaaggtcataatattgtataacttcagaacgagacagagactttgagatgatcatgtctgagttattttatggatgagctccatgatgccaagggtggaagtgacatgttcaaagcaaaataggttcagagccaggactagaatcttatcatttgactcccagcctaatgccacacttatgttgaatctttcctcactattagtcttggctgttaaacagaaataagtgaaacattttctaagtttttaaaatcctggaaacttagagaaaatgaaataattttatttattaaaagtaattctagagtagctgggcgcggtggctcacgcctgtaatcccagcactttgggaggccgaggtgggcggatcacgaggtcaggagatcaagaccatcctggctaacaccatgaaactctgtctctactgaaaatacaaaaaattagctgggtgtcgtggtgggcgcctgtagtcccagctactcgggaggctgaggcaggagactggtgtgaatccaggtggcggagcttgcagtgagcggagtttgcaccactgcacttcagcctgggcaacagagtgagactctgtctcaaaaaaaaaagtaattctagagtattaaaacaactaattttacagtggactgtattaactgaagtctgatctaaaaccactttgctgcttggattttaaaaagaaggaaatctatgtgataacgtttttgagtcccatgatccagtgaagcattattcaattttggtaatgaatgtgtttcattaagaactttcctttgaaatttagagtgtgcaggggatattaactagcagttaagtattttcagataagtccaggtaaatttagatgaagttaagtagatgctgaatcataaatgagagttgagatttttgtatgaggtctctttattttaggtttttactatggaaatttcaaacatgtacaaaggtataatgagccttcaggtacttttagggtttacattctagctttttaatatcttttgattctttttaaaaaaattctacttactttacagtaacaatatttttagtaccccaagacacttcagtatatgagacatgaatatattgaattaagttgattataccacccaagcagtaattctgatagcaggtctgctgtaggagaagagttattagattccagttgtctgttttctgtcatttctcacttttccaaattttatgcatctaagagcttcccatcctccccttagtgagttgtggggtcagagggttggtggattggtagtggtttcaagggatgatgagagttctttaaataaaatgtgaagtgaacttacttagctctactcagagaaaactggatcacaaagtcaaacaaatagggacaggatagtctaacctctaaaatatcagttgccctttattaaggatgatgttcatgtaacacgcatagactctatggcatcaggtagataagcatactcctttgcattgttagtgttgtgtatcaagtcattacttttggagttaagtattcagaaaatccaaaataattctatttaaggggagtttgtgatcatacagtcaaactcttatcaaatacttttctacaacattcctaaaaactagccttctactcacagacattctcagtgatgtaatattccttacttcacatgaattccttaaatagctctaattttcaggaaattctttctttatatcagaaacctgcttccttacaacttgtcttgcctacgggaataccaaaaattaagtctgcacttaattcacatggcaggccgttaagtatgaagagacagctgttgggtcttcttgactgagtttttcagctttaagcatacagtgttcctgtacataacagaagtcatgatactatacttcttaatttttaattttttttaaaaaaatagagtcaggctctccctgtgttgcccaggctggtctcaaactcctgggctcaagggatcctcctgcctcggcctcccaaagtgctaggattatactgtgagccaccacactggacttgtacttttgaatgcagaatttatagttgct

SEQ ID NO: 96120 - DNA, 1441 bp, Homo sapiens
atttggggcttaaagcagtgtccaaaaagaagttgagtaatctaaagtcttgtaattggaaagttaattttaaatttcttaaaacttaaatttgaacttaattagctttatgtggacatgtttaaatatgttgactttaagtactaactgggttagtacttgtactaacttgtactgggttagtactggtacttgattttcttgtttgtttagtaataatgggtatttaactttcctgtatctcacttttcttcacttaattaatagactaattgtaatactttataatagtttttatgggaaagttctatatggtcccaaatttgtctttaaatgttgaaataattaccttgccgtgtttctggtttctgccttgtatgtaatcaggagctctaagaacccaattttccttttttgtagctggtcccacctataggaatgttgaataatcctatgaatgcagtaacaacaaaatttgttcggacatcaacaaataaagtaaagtgtcctgtatttgttgttagggtaagtaatctgttggatattttgggggaaaattaatcctgcgttatatagcaaatgtatttgacagggcaaagaaaattaaacattattttaaaagtatatctgggcttataattggtttattgctagtaattttattttggaatatccagttgtttatctactttatcaccattgagtgagataccacttttggattgtttttcttcatgtggcaatttctgtagaattctctctgaatagatggatacatgttgtagcaggtctcagagttgcgtttgagtaggaatgcttttattaactatttagaaagcagcatcccaaggtaaatgaaaaatacttaggagttaacagacaggaaaacatctgagagctgaagaactgtggtgtaccgtaatttttagctctatgaaggtacctagtaggcacttaatacatttaaactgaaattttattttatttttttattttttttagacagagtctcactcggtcacccaggctggagtgcagtggcgtgatctcggctcactgcaagctccgccccccgggttcacgccattctcctgcctcagcctccctagtagctgggactacaggcgcctgccaccatgcccggctacttttttttgtatttttagtagagacggggtttcaccgtgttagccaggatagtctcaatctcttgacctcgtgatctgcccacctcagcctcccaaagtgctgggattacaggcatgagccaccgtgcccggccttaaactgaaactaattttaaaactgaaactaaatttaaaaaatataatttttagttataaccccgattttcatagatgataatgtaatcattttcttctttgtgtttcgattattccatttcctagctaatgcacttgttggttaacagtcttaagtt

SEQ ID NO: 96121 - DNA, 1838 bp, Homo sapiens
taaagtaacatgctgtgcaggtttgtaacctaagagcattaggctgtaccgtgtagcctacgtgtgtagtaggctgtatataccatctaggtttgtgtaagtacaactctgtgaagtttgtacagtgatgaaattgcctaaggatgcatctctgagaacatacgcccgttgttaagtgactcatgactgtagttcattgtgtaagtggaaatgatgcacgttagataagggaaaagaaatgtaaaaagtgttcatttaaaaatgttttcaggcagtgttgcagtgctgatatttgtagtgaaagtactttttccttatcctagtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggaggtaagcctgatttatgtgcttcagatgaccaaactttggttatttatttatttatttatttatttatttatttatttatttattttgagatggagtttctttcttgttgcccaggccagagtgcagtggtgtggttttggctcactgcaacctctgcctcccgggttcaagtgattctcctgcctcagcttcccaagtagctgggattataggcacctgctaccatgcccggctaatttttgtagttttagtagagacgtaatttcaaccatgttggccaggctggtctcaaactcctaacctcaggtgatccacctgcctcagtctcccaaagtgctgggattacaggcatgagccactgcgcccggcctggttatttaaaagaagatgattttctagatgtagtgtagtaagtatgtatacctgtgttagttgaattagtgggacacggtggaatttcaaattggctaatttaggaagaacctcaaaccactaatactttataaaattctgtgcctgtatcatcttctaaaaaattattaaagttagactccattttagaaataggatttgctctaaaagttcacaaattagaagggagtactttaatcgctaggccagtcttaaaacacttgttaaacctgcagtgtatatgaaatcataaaagactaccaacataggaatatttttgtgagacactggcttggagaacatggattctcccacttccaagccctggtggtaggtatttcttagagtcaggaaaagggctttacgttcttgaggattgaacgcctactgcagtcctacagggtaaaagcaacttagatagtaagtaaaggcaaggcaggggtctacctgcagtttcccgttagagttctttatttacttgtgttaatgtaggaattagccttattactaatattacctattaggttcattgggtttaggtctggcctcctatgaaaatttgtctgtttttcattaccttagatctgtggttaaagacctatttgcatattgggcctagttaatatgttgcaggcatacaggagaaagagattcagagataaagacagattttgatttttctgggaatttcaattgggaaagtaggctaggagagagtttgagaggaattaagaccaagggcaagatatgaggaattgttttgtgctgagggctttgaaggaattggggatgtctttctaccctctctgctgtttccttttcttaaggtagcatcagggagactgtgttggagtcgacagtatcttggatgagtggg

SEQ ID NO: 96122 - DNA, 1007 bp, Homo sapiens
cacacatgtgtagtcccacatacttgggaggctgagacaggagaatcacttgagctgcagtgagctgtggtagtgccactgtattccatcctgagcaacacagcaagaccctgtctcaaaaaagcagaattataacgttggtatagacttgtgcatacaaacattgacacactaagtctgagtgttccattctgttcaatagtatagtcaccacattgttgaaagatacaaatttaatgcaaaataatatttttgaggcatggaactcattttacaggttgagaaaataatggagaaattgactggccttcctggttttcttgagcagttgaaagcctaaggctaaggatgcgatgcaaacttttgtgtactcaggatctttatatatgctaaaaatagagagggggccaggcaccacaaagtctgaaaactactgttctgcgaaattaggagtgatatttagtgaatcagaattgtgcgctgtacctgaggcagtgtatgcatgtaaagtaggctcttgataaaactgtgctgattgcttgaaacattgaaggtttatgtataggagaaaggcatgatgaattcagtgtttcacacagattcttgtccttagcaatttggttgtattgttagtgtatactgaattcaacaataggcaaattatttgtcttttctctacctcagttcctctctcttgcaccctcctttcccaaactctttgtctctcctccctctccaccctggatgtaagatgagtatgttttggggactaagtactttaaattgtgttgttctgttagcatacctcaagtcaatactgcagtgagtacaaatcacattaattacctttataaaggacaaagctctgctttctctgtgtttggtcataaatctagatctttggagtataatcccaagtaaagcgtagaggatagttgtaatgacttgtttgaggattggttctttctgtcgtggtcaataacttttcagcctcacatgtcaagttt

SEQ ID NO: 96123 - DNA, 1045 bp, Homo sapiens
tgagacaagagtttcgctctgtcgcccaggctggagtgcagtggcgcgatctttggctcgctgcaagctccgcctcccgggttcacgccattctcctgcctgagcctcccgagtagctgggactataggcgcccgccaccgcgtccggctaattttttgtatttttagtagagacgggatttcaccgtgttagctaggatggtctcgatctcctgacctcgtgatccgcccatctcggcctcccaaagtgctgggattacaggcgtgagccaccgcacctggccaatttttgtattttttagtagaggcggggtttcaccatgttggccaggctggtctcaaactcctgacctcaaatgatccacctgtctgggcctcccaaagtgctgggattacaggcatgagccaccgcgctctgctgaaaatgatttttctttggtaacatttatctccccatttcaaaccatttacattagtcctagagactgaagctcttcagtgtattggaaaatctgagcagtgctactctcatctgtctggcccttaaacattttactaattttctggtagtgactgactttctaaagttgtattgtatcttgtactcatgatttgtgtgcttataaattcccagagctaggtagtattggaaagggcatgtatgggtttcagcagcaaatggacctaggtttgaatgccaggctcaccattaactaccttttttatattgggtcagttaattaaactctctaagcttcagtttctttgtatataagaatgttaactataaaacctaaaggtaaaaagtgcctcatatatagtaggcattctttaaatgttaacattttttttctttctgtgatgaatttaattggtgacatcattttcagttttaaacattaactcaaatatctttgttgaaatttactgacaatctcattcctctgataagttaatcactcctttctctgctattaaagcattttgtatatatctttaatgtattttgactataccttctccactacttgtgaatactttggtt

SEQ ID NO: 96124 - DNA, 1500 bp, Homo sapiens
ggcgacgagaagacgtaagtcaggccacagttaagacgtgaagtttggagggaaatgcattttaactgaggtttggggcgggagtggaaagaagtgggccgagttgaagtagttggttgaaagggtcaagggaagttaacgtgaaatctgcaaaacagctgaagacttagccgtgatgttatcgtggcttgaaatcggtgcttattataaggatgaggctacagcttgacaggcaaagccctgcttttttggaatagttgtatttctatttggtttgtgctagatccctgtttctgattttaagttgtcttctggcaactaagtagtgaggatcttagcatgccttcttaaaagaaatgacaatgaatgtttgtacttggttgtaacccttgggattagtggccccttccggagtaaggaggaggcggcggcggcaggtcggtagggaattccgtaattggatctatttaaatcaaatcagaaaaatacgggctacttgtagaaagcctgtcaagaatgttttaaagtagtttctacacacatgatcttaagttgactgttcaggaactttggaagacattagaatatgaacaaaaagcctgcactgaaaggaacaactctggggagcgtagactttacttttttagtacactctggagagctaatgcatgctatatatacatatatatgtgtatatatgtgtgtgtgtatgtatatatagcctgtgaatatggtgcagtggtaaacctacttaattcaaaccttttagtgacagttatgctagttgtacctcttgtggcatttttcatttcctcgccttaattgcattttacccattttttattactgtaagatacttttgctttttttgtctccttgaccgggagaagataaaatattgtatagatttgagtttttgctgagacttgaagttccatatttagactatcttcttgaaacttggggagaaattttaacttgtctttcctgtactcctaggaagaattttggtagaaagttggcttatggccgggcgcggtggctcacgcctgtaatcccagcactttgggacgccagggtgggcggatcacctgaggtcaggagttcgagaccagcctgaccaacatggcggaaccccgtctctactaaaaatacaaaaattagctgggtgtggtggtgggcgcctgtaatcccagctactcgggaggctgaggcaagagaatcacttgaaccccggaggcagaggttgcagtgagccaagatcgcgccattgcactctagcctgggcaacagagcgagactccgtctcaaaaaaaaaaaaaaaaaaaaaaaaaggaatttggcttacatatattacaatggtttagacaaaaataaatgtttatctgtgaagctgatggcttaacttggataattttctttggttggtgaaaaatactaaacagattttgccatcacggttttatattgacgtaaggctttaattatatttttactaag

SEQ ID NO: 96125 - DNA, 1080 bp, Homo sapiens
gggtgacagattgagactctgtctcaaaaaaaaaaataaaagaacgaaatcatatcttttgcagcaacatggatggagctggaggccattcacttaagcaattaacacaggaacaaaagaccaagcacctcacattcttataagtgggagttaaaccttgagtacatatggacagaagggaacaacagacactgaggcctagttgagggggtgggtggtgcagattgaaaaactatgtatcagtactatgcttatcacttggatgacaaaatagtctgttcgccaaaccttcacaacacccattttccctgtagtacagacctgcacatgcactctgaacctaaaataaaagttcaaaaaaaagcagatgtggagtaggaaacccctcgatttctgcaggggcagagaaatgttcaaatgcacagtgaacatttagaagcaaacttttgaaggagtattttcagctgccatttatgcttcttacaaatagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtaggtgagtgctaaaagaaagtttttattaatccaaaccattggacaactgcatgtagaatgctgtcccctccccctttcccaggtgtcacttgtgaatttaagtaaaataatgttaggctgggcatggtggctcacacccagcactttggaaggttgaggcagcagatcacttgaggccaggtgttcaagaccagcctggtcgatatagcaaaaacccgtctctgctaaaaatgcaaaaaattagctggtggtacacaccattaatcctagctgctcaggaggccgaggcgggagaatcgcttgaatctgtaggccaaggttgcagtgagccgagattgcgcaactgcactccaacctgggcaacttagaagaccagaatttcagccaggtgtggtggcttacacctgtaa

SEQ ID NO: 96126 - DNA, 1044 bp, Homo sapiens
ttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcc

SEQ ID NO: 96127 - DNA, 1081 bp, Homo sapiens
gcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggat

SEQ ID NO: 96128 - DNA, 1082 bp, Homo sapiens
agctgcttggtgcctgcctccatccatggtagtcatctggaaattttatggaaaataaaaattctcttttaggaaaaggttaggggtttcttctcctggtctgtgacctggaggttgagtgggagaaagaatttgacagctcttagctggtcaatgcagactctctatctttgatgttttttcctctccttttaactaaccagtcaaattaatgcttaacttctcattttggttagggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctagtgagtaaatcatgtgctgggggcactgaggaaggcatggtgacatctttctggggtgattctcttgagagggtctgctacttggaagtctttattatcatttgaggaaagggtaatgggaagagaatgataagaaatgtccagagaatatttaaaacattcagtggattcagtaatggaagggagcagttcacatttggaggaggctgtaggcttgttgttaaagtaatgttctggaaatcaagtgagttcattcttggctcttctgttggttcacatggcagtgggtatggcatttaacctctcaagtggggaagtcacgccataccattggggacacccatagtgttgaagtccaggtgagttggaagtctgagggccaggctggagactaggagctc

SEQ ID NO: 96129 - DNA, 1140 bp, Homo sapiens
aggctcggctcccgctcctggtccttgtctgcactccctccaggaagcaggctcgctcgctgtaaagtttggtggtctccggcgccgcctggtggcccccacccaccgtcccgccgccccgccgccccctcccccgcccggcgtctggattccacccccgcggctcggcccaagctgctctacccgtcgctccatcgtctccccaactccccagcgccccggaccctctttcctcataccctcgtttctcacctttcaccctgtccctcggcccgcttttcccctccccgctctgtcctgtcgttttcttaacactcttcacacgcgcactttctcctcctcctcttctctttttcgcacccctactcttgggccctccttccttaacctccgctggccccccattccatgatccgtccacctgacacgctgggtttcatgcctctctttcccaggctgtgggttgtgcccttcactccttgccctcctacattccctgtcctgatctgaactcctctccttgccatgctccctcacccttatccctctgggccttatcctctttcactgccctctcctaggatagagtgggtggggcctctcccacccacaggagatgtaaacagtctcctgtttacttacatctttgggagtagctcaattctctagtagtggggagagttggtgaagagatcaggaagagatttcttcgagactaaggatggatgacccttagcaacagtgaccgtctcctcccggcatagcaagatggcctgccctcaggtccctgcctctggcgtgctgtccagtaattcttcagttctgtctttgcagaggattgggaaatttatttgtgttctgaaaccggcggagagcttttaaatggtctcttctggcctgagagcaacttttgctctgcatctgtggtggggaagttttaatgtgcgtctcatgctcgagttcaataaataaaacctttgattctcagtgtcctcccttcttgctgatgacgctaaggatgagatgattcagggcatgggacttcacggctgcctcagatttagagtttgcaaggttttgaaataaggagagcctgttctctagctatttgctgtgccccccacccccccgaaattgctc

SEQ ID NO: 96130 - DNA, 1694 bp, Homo sapiens
tacaaaggtgattgaaggtgggttcatttgcctggggttgacatagaaaaatatttccgagcttatgataccctcccttttgtgtgttgcagacgaatctagaacatgatgtctatgaaagacttactaacctgcaggaagggattatcccaaagaaaaaagcagcaacagatgatgatctccaccgaataaacgaactgatacaggtttgagtgcgccccttcccttctgatcatctactttatgaagttgctttctgtaaagccctacttctcccgtttccccccgtctccctcatatcttcagtaaaaacatacgtgcttcagcctgcactcctgagaaacaaaaagacattttctctgttgtggaagcctcaacatggcctctgcccaaaggcaagcagttttttaaaagctgtactatcctcatggtcactgattgatgatgcaatgtcttctgtttcagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgtacttgcgcagtttgcatctttttgtaaagtgaatcagtgccatactgaccctcactgaaatgtttaccctgcttcagtttttcacacattgttgggagcctactttgtttgttgaagttatgctgttcgcatagagttcctcttagagggtagtctaaatatgctacagtggtgaaacctgttggatcttggctcccttaaatacgagcctgtattgtggcccagtgcggataaaaattggtccgattacaggactattaaggctgcagtactgggggcggagcttt

SEQ ID NO: 96131 - DNA, 1078 bp, Homo sapiens
cttggagtggtctaaggtaagccctcaatgaatgttctgttgttctggtggaacctgagaataacattttaataaacccacatatgattgaaaatgctgatagtactttgcaaatacctgcaaatatttctacggatggactttaagtgccattaatctcaaatataatatatgtacaaagaaatgtgagcctctagataattggtcacatttcccattctcttacataaatcccatttggaaactgctctaagggttttcttgaaggctcaagatgagtctaacttggatggagtactgactaagtaagcagaggtggacatgctaacagttcagtttctgaatggaattacagaggcggctacatttcccagcttttcttcctcacaagtgtactctgaggtttggaaagagggtgagatttccagaggtcaaggagtgttgccttttagtggaagtaggatatgaaccactaaacatctcttcatgccacaagaattccatagaaaaaatatttaggaatttgcctggtagcatttcaagccacactacaagagtctaaatgcttattgggactcgctcttcaaaaactatctcaagaaagataacttgacagctgaaaggtttatgatccctaaatcttctgtttcaatatattcatactaacctcctttacacagtgcctcttgactatgaaactttagtgcagctattttgcctcacctataaaataacataaattatatataaatacatcaagatagactaaaactcacaggaggccaggcgcggtgattcacgcctgtaatcccagcactttgtgaggccgaggcgggcggatcactggaggtcaggagttcaaaatcagcctggccaacatggtaaaaccctgtctctactaaaaacacaaaaaaattagccaggcatgatggcgggtgcctgtaatcccagctactcaggaggctgaggcaggagaatctcttgaacccgggaggcaaaggttgcagtgagccaagatcgcaccaccgctaccacactccatcctgggtgaccgagcaagactctgtctcaaaaaaaa

SEQ ID NO: 96132 - DNA, 1473 bp, Homo sapiens
ccactacgctccagcctgggcaacatagcaagaccctgtctctaaaaaaataaaaataaattggatcccattttttctttccattgtttctgaagcagtttgaatgaaattgggattatttgttttatgtatttttaatgaaattggccagtaaaaccaatttgagttgagtgtagttcatgaggaattgagcagggaagatttgattactgagattttgtgaactggttttcagacttactctcaaaaatcacccatagaatattatctatgtttttacatttattgatataggtatttatagtatccactttttttttttttaattttgcattcttggtgtgtgtcctgtgatgtaagagtttgtttgggacacaatttgagcaaagcttgtttgacagttctgaaggacacaaagaggaactggggtataggatcatttgaaagtaaagaagaaaatgactattttgtttgctatcatctgttctgtctctagaccgtctgttcccgttcagttccaatattttttgccaacttaccccccttctgcatacccactggcggcacatacctacaccccaatcaccagttccgtgtccactatccgacagtatccaggtatgagccctgctttttagatgacttttcacagtttaacttttgccaacaataatgtagaaattgatgaggggttattttttgtatgagattaattatttcagcttctgttttcagattcagataaaatgtgaagcttgaaggtcttaaataatcatctttgtgatctataaaagttgttactcattagtgatatttgcatagtattatgccaccctgaggatactcatgttaacaatttttgttactccttaaaatgacagtagttacaatgaatagagctgcacttttatagggtttccattgttttatgcaaatcttggctatatttttaaaaaatttataaaggtttgtttataataacttttactttaggttccatggtacttgtgcaggtttgttatattgataaattgcatgcacagggatttggtgtaccagttatatgttttttagttgttatgctctcctctcatcatgatgacgtgtgaatagtgttctttttgctaatccaggaaaaacaatccttaaatgtcagagtctgtgtagtcttttactgtggaaccctcaggtcactctgggcatcagaaagccttatttccagccaggtgcagtggctcatgcctgtaatcccagcactttgggaggctgaggcagggcaggcagatcacttgaggtcaggagttcgagaccagcctggccaacatggagaaaccctgtctctactaaaaatacaaaattagccaggcacggtggcacatgcctataatcccagctacttgggaggataaagcaggaaaatcacttgaacttgggaggcggaggctgcagtgagccactattgtgccactgcac

SEQ ID NO: 96133 - DNA, 1313 bp, Homo sapiens
gttgcagtgagccaagatcgcgccactgcgctccagcctgggcaacagagcgagacactgtctcaaaaaaaaaaaaaagaaagaaaaactatatgaacagtttgtttgtttttttttcttttgagacctagtcttgctcaggctggagttcagtggcgcggtctcagctcactgcagtctccaccccccgggttcaagccattctcttgcctcagtcttccgagtagctgggattacagacacccaccaccacccctggctaatttttgtatttttagtagatgggggtttgccatgttggccaggctggtctcgaactcctgacctcaggtgatttacccacctcagccttccagagtgttgggattacaggtgattcccaagtgttgaatctttttgcactcctatgtaatttttttaactgttccctttaatgttgctttcatactcttctccgcccttgactgcattttcagcattgtctctcatgttccacttctaattttgccttcattcttgaaactgctgagcagttgccttctgtttctctctggagctctgcccatatattttgtcttcttctgttgttctctcatcatttccactgagttcttatgtctttgctttgtgtttccatttcatagaagcagttacttcattaagtttttaaattcatggtacagtgttcatctgcgtagtgaaagcacttctggtgtgttttgttccaccttttgtcttttagcatctttaaatagatcctgttttggatcctttctgagtattcatctttgattggattggctttattctggatccccatttgtaattggttcttattgtagcctggactatatactgggtttggataaattttccaaatgactcagtgtcctgtgtttgaattttgttggccattacttcactcctgtcagtgcagatagaccacttaaaatggcaaagcctctcttccctaggtcccccgcacactattccccacagacggggcttatctgtgtctgtgtctgattcctggtttaaccctagatcctttgctttttaacccttggaactggtccaaatgctccttcactgccagcttcatttccactgttacacaaaagattttggttttctctgtcagtttatgctcctcattttggagtattatacttccttactggattttatccccagaattatagccccagaaattctctcttcaggctgggcagggtggctcatgtctgtaatcgtacactttgggaggctgaggcaggaggattgtctgagcctaggaattcaagaccagcctg

SEQ ID NO: 96134 - DNA, 1032 bp, Homo sapiens
attacaggcatgagccaccgcacccagccttagttgcgaacatttattctgaagtcttctgttttaaggtttttttgtgaaattttgcaatcctactctgctgtgtacctgattaattaaatattttacattttttacctggggaaaaaaactaaatctaaaaactttcccttcacattttcaagaaaaatttatatcccaaagaggtgtactgtgttttttccttttgtcatactgctgagtactctcagaagtaccagaacccttagctgagaagccctgaactctgtggtttgggagaatgtaagggacatttcagggttgagctgaagaactggtagggagcacctgttggataccaactgacatttacttagaaacaaaaaagcttaaagaatggatggatgcagtggtatgtaaaggaaatagtgagaatgggaaaaaaaataagcatttggccagaacagggaaaacaagtgtgaaaggtaatatcgcagatgagagtttctaaacgtagatatcgaagtatattatctgtaattatgtgggcctgcagcagttgtggggtcctcatacttctcacatgcctgttagcacagttcattgtacggtatggcatgtaaaagtagctcaagctgaatgtccttagccctttctcttgggatactcactatctaaaaaacaacctgacccacatttggaggcaggtgacttcctagaggcaatggctaagagcaaacatgtaaaaataacgttctatcctctttctttcagggccatcccagtaacctgcatcacatcatgactacaaatgtgcaaatgtctatcatccgcagcaatgctcctgggccccctcttcacattggagcttctcatttacctcgaggtaacgacttgcaagttttgttcaaactctcaaaatgtagtagtagatatacatttggtaaaatacgtaacacagaatgtatctagaatcagcttgttaaagttgcagaacaacagtctgcagaaccgtgaaccaaataaacctct

SEQ ID NO: 96135 - DNA, 1071 bp, Homo sapiens
tgcctcctggaaggtagctatcaaaattttagggtttagtataaagtctaagatgctcagaaacattaagacaattgtccttactgtgccaccgaaaggctaaagggagtaagcttttaacaaaggtttaagggagtaagtcccagagtccaaactggatttcaccgactgactgttgaagctttcgggtctcagctgttggcccaacgaaccttcccaagaccttgaagaccggcagcctacccgccaccctgaaaggcggaagtgaggagagaggcaggactcccccctccccaaccctcggagatgagagggcgaccgcgcgacgctctgggctgctaggtctcgactcggtatccggaagtcctccagcgttcgcctgcaggaagcggaagtaaaagggcggccggcagctgggcaattgctttgcgaggctgggtgttgagtcgagccgcgggaaaggcgcgtgtcggcctctcactggcgcagcctgcactgccgctgccgcctcgccccgccctgccctggcgttgtctctggcactgtggcggactgaccacggcccgggcatgggctgcaagggagacgcgagcggtgcgtgtgccgcgggtgcgctgccggtgacaggtacccaggggtggcgtgaggaggcctcgtggacaaagagagggtttggggcacaaggcgaccctgtgcccctgtcacattgagcttccgcctctaccgtgactcagtttaccctctggtgtcctatcccttcccctattcgcgagcgccccgagttgccctcagtggtcttcttggcaaggtatcgcttccgcgggggtggcggcgggctctgttcagcggtcttgaaccttctttgaagagctttagatccttgtgccaagtgcagaaggaaatgggggaggtatcctaccatggatttagaccaagcttgatcctcagtgagttgagaagcagcactttgcaggaccctgattgcagaacgacgtgctttttaaaatagatttcaatttttcctaaaatgaattcgggttgatgcgtattggttactgttttcttttaaca

SEQ ID NO: 96136 - DNA, 1050 bp, Homo sapiens
tatcagtcactcagcaaatatctgttggactagctagatattaagtgctattatatgtcagaagcatttctgtttcgctaacttatgttattttgtgtctccaagtattattaggattgttattttgtgtctccaagtatgaggttaaaattaccttgtagcaggccaggcatggtggctcatgcctgtaatcccaacactttgggaggctgaggcgggcagatcacgaggtcaggagtttgagaccagcctggccaacattgtgaaaccctgtctctactaaagatacacaaaattagcagggtgtggtggtgcgtgcctgtaatcccagctactggggaggctgaggcaggagaatcgcttgaacctgggaggcagaggttgcatgagccgagattgcaccactgcactccagcctgggcgacagggcgagactgcgtctcaaaaaaaaaaaaaatttccttgtagcaaaacttcttttctttttttccttttaggagtttgctataaaatgggagttctggttgtactcactgttctgtggctgttctcctcagtaaaggccgactcaaaagccattacaacctctcttacaacaaaatggttttccactccattgttgttagaagccaggtaagagaacattttttttcccttcgtgtatttgagtataaatataggctctgacagtgaacattcaggagctttttaaggagtgagattatcatcaaatgcatttatgaagagcctctttcagtgtatactgtaggatgtattgtacaaaggctgttaggacatagcatcattcagtaggacaagggctatgtgggtttatagagctatgtaggaactttggacaaataactgtgttggataagttagtatgttactttccaaaaagcataacaaggaaagagagggttatgtttatttatttatttatttttggagacagggtctcgctctgttgcccaggctggagtgcagtggtgagatcttggctcactgtgacctccgcctcctgggttcaagggattctcatgcctctgc

SEQ ID NO: 96137 - DNA, 1004 bp, Homo sapiens
gtttttgtgatattctgtttaacattctttttttgagatggagtttcgctcttgttgcccaggctggagtgcaatggcgtgatctcggctcaccgcaacctctgcctcccaggttcaagcgattctcttgcctcagcctcctgagtagctgggattacaggcatgcaccaccaagtccggctaattttgtatttttttttttttttttttttagtagcgatggagtttctctatgttggtcaggctggtctggaactccccacctcaggtgatccacccatctcggcctcccaaagtgctgggattacaggtgtgagccaccgcgccaggcctctgtttaacattcttaccctgaattacattttgttactttcacttttatttacactaatttcttgatagttgtacattcttgatcattgtcctagaagattcttacagcataaaactatggacttttgagaaagaatgctaaaattgccagccctaattgctcaatattttcagtttctttgatcactgtgaagtggacagggtatactgttttcttcaccaacttccttatcacagacatctccccctttcatgatatccctggtcatttgccattttgttttatttttattaatttttttccttggcatgtgaagtaagagctacatttgcccttttggtttactatttttaggccccttctcctgtggctatttgtatacagtttcccaaggtaatacgacatgtaggcaactcatagaaatgagctatgcttattagaatccacttagtattcacctccagagctagcagagcccaccattcttccttcttatgtctgtgggagaccctgatgttggatcaaggtactatgtccatctggttaaggatgaagggtcaaaatattttactacactttatggcatgccaccaccacagatcttttgccttccttgcatctatcccttagggactaaaaatattcctgttgtgtatttttagattggacc

SEQ ID NO: 96138 - DNA, 1043 bp, Homo sapiens
attttttgtatttttagtagagatggggtttcaccatgttggccaggctggtctggaactcctgacctcaggtggtccacccacctcagcctcccaaagtgctgggattacaggcgtgagccacggcgcctggcctgtaaaatcataatttatgctcagtggaataagtattatataagaagctaaaaaaacaaaaagcaacaaaaatatgctgtaaaaaaaggcagcatttctttaataatatcttgtattgttattctctcctctgggttgtttcagtggatctagtaagtaatattaggactgttccaagtttagaccttgtaagaccttatgtatgcagtggggtgaaaagaatgtatgtttcaagaagtttccctgtaattgtatgaaaagcatgtatttattcgtgtgtggcctttactgggagagtcttagtctgattgaatcttagttctcaccacactggtgagtgtgtcaccttgcccctctctgcttatcttgtgaatgtgcctttaattaattaatttagtgtttatttgcacatcctgatgtatctgtcttaggacttgttttcttagactataagctatgccaagcttggtgtggtgtctatgtcagttactagaaagcctagaaaaatactactttcaaggaggcattgagaaatttaatatattatgataatgggtattttcagaaacctatttttagagaagctgtgcattaccaggaaatgtttcttatttttcccatatttctgtgtctagctgtggagtagagtgagattgtacaccccagtgttcacaagtaatgggaaagtcttcctttggctaggtaagctgagatccagatctgtagtttgctttaagacagtgaaagatcaccactgcattagtattatggctcagaggagaagataagcaattgacatgaatcattcaattactacatgcatttcctcgtaggggttttagactcttgaatgaagggaaatttagactggccattattttagtaggataaagtcgaaaaaaattaag

SEQ ID NO: 96139 - DNA, 1053 bp, Homo sapiens
cctttattctcagaaatttttctacggttcatattttactgtgggagaactttaggcaaaacatattttttgttctttgtaaggcctttcagaaaataagtaagcagaactagtactagaatcatcagttcctaattcttcttccactactcatagtatttttgtcaatggggtttcataagctttctttatattgagacttcccttttatgtttttattattccaggtttcttaagaaatagctattaagtgaaaaaattcataggctaagttattaataactaataagataggacttgattatcattaaaaatatatatattatacataaaagagtattatatattatagattaaaagtcaaactatggacatttggaaacttcaaaacttatttttactctctttagtaatatagtttatattagaaaattttattaagttgttttatttctgatcttttctcccagtgagtttttagcagaagacagtcaagagaaattttggaattttgtagaagccagtcaaaatattggatcatcagatcatgacggtaaaattgaagcaaatgcttctttgactttggtgtctgggaaaatattaggaaaaaattgtctctttatagtatgtgtggcatggcagttaatggaaaacattgttgtctttaatgactggagttatgatggtggtcaggaagagccaacacaacacaaattattatttttgaagcaatgtatacctttggctataagtggtacctttgtttttttcccctcttgtttttgttctatcgtgatcctttattaaagtgctatgtgaatattttgtggaagtacatttcattttaaatcattcagtattaataaccatctaatctgattcactatttttgttatgaactacacaactgagctattatctgttaagttcattatcattaagttagtatcatccagagtgttttccattatgcctgccagccacccacaacttgagtgttaaggtatcaaatgaatgattatcctgtaaaacctcatttgcagtttttatgat

SEQ ID NO: 96140 - DNA, 1751 bp, Homo sapiens
tactggtttaaaaaaaaagttactatgtacattgttttgtgcctttgcttttcatttatcctggggattttttcacattcgtatttggatttttttttctttaaaataatttggtccaactttttgtttaaatgcttcttttcaaactttacaatttcattagtattctttaatactgtgtaacttcctcatgacactgctcagttttgtttagtttttggagtagttaccatatgctaggcatcatggatataaggataaataggtcatagcctcttcctctggggaccagaagtctaagtggggtatagatagacagtgaataaataatttagtaaatgatatgataagtgaaagaggtaaacaaagacgtgttctgggattgaggaagaggtttaactggtccattgaagcatggggtagggattgtggagactttctggagtaggtaatttcacagctgaattatttctgaggaagtatgtagctgtaagtcatccaggtaagtgggaaaatagcggtccaggggagggaatagttcgaaaggtgagaagagaggaagagcccaactgcattttgtactccagggagttttaagcatttgttgagagttcaagacaatatactggtaaaacttgccttcacatacctttgtaaacacagctttgtgcttcatgaactatcttctttagatatctctagtcatacgcaattactttggttaatgttcttccttgacaggtaccgattattcctactatcatgcaatattggaggctgcatttcagtttctgtcacccctccagcagaatttgtttaaattttgtctgtcccttcgttcttactcagctacaatccaagccttccagcaggtgggtccagtgctcttaaagaacagcattttagagtgtatatcatgatgaatggatggaccccagttgtcctggaattgaattacagagctattatcacttttttgcctgaaattttctaggatttatgatttttaaaaaaaataataagcaaaattgatgttaagtcttcaacccacagatttaaaaaaataaaagaatatctatatagaaaaaagacagcaatattttatttatgcattgcagcctgggagatgtaatcttgttaaaccaatgagccagcatctaattacagcctgtagttctaaaagcagttcacaggaaatacaggaggcaagaaatgtttagcatcaccacagggatgcagtcaggaaaatctagaattcaggaatcgttgtagtaaagtaatctagtttcttcagtacataaattatggaaatttctattgtaattgaaaagaaaaagagggacagaggaacctcaagttaagagagacttaagaagagacagtcaaagatgtcttcaccaacttgatatttgatataaaagcaatgctaattttaaaattattttttattataaaataaaacatggaaaaactcctcacaaaaaatatatagtaatggactattataatgtgaacatccttgtaattttcacccaagtcaagaagcaggacttagtctggcaccatggaaagccctccgtgtactttgtcctgattgtggccacctttcacccctgaaaccaaccaccctgttaatttctgttggaatcacttgcttgttactgtattgtattgcccaaaggtacatcttcacacaataaagtgattttttttttcatttttctttattttgtgacacagtctcgccctgt

SEQ ID NO: 96141 - DNA, 1044 bp, Homo sapiens
tacatttcttcaactgtttatctatagagtgtttaagacatgtcattgtggcaggatgtatgtgtttttctctgttccaaagaactatttttcaagtttttttccccaacgtcatttactaaaagtcttcatgctgtattttgtgatgtattgtaaatttagaaaagggaaaaggacttgggcctgatttagcctgtgctacatgcgttagtgtagcgttagtgtgtgccctagtgttttctgcagatatatcagaaacggctcaactgaatactccagagatctttgaagtgaataaaacctgaaattaaatcatgggcactctctggaatggttgcattcgaagatattcttaattaccatgaaaagagtgggaagtaaatttggattttgttttctgcttctcattgcattagattaatccacttttaattatatttgacattgttgcagatctcagtttccagactgctgctcgaatcttggcttctcctgttgagttggctttggttgtcatgaaggatcttagtcagaattttcctaccaaagccaggtaatgtagaataatgctcttctccttaacatcatacccagtcatcgtcatgttcacttgccaaatgaggtaataacaatatgaaaattcctagaaaattaagattctttttttttttttttttgagatggagtctcactcttgttgccgaggctagagtgcagtggtgcaatctcggcttaccacaacctccgcctcccaggttcaagcgattctcctgcctcagcctcccaagtagctggtactacagacgtgcgtcaccatgcccagctaagtttttgtatttttagtagagacagggtttcactgtgttggccaggctagtcttgaatgcctgacctcaagtgatctgcccgccttggcctcccaaagtgctgagattacaggcgtgagccaccacgcctggcgaaaattaagattctttatgaccaccaccactactattgcagatggtgctctgtgtcttgaagatggcaagaccatgcattgtg

SEQ ID NO: 96142 - DNA, 1538 bp, Homo sapiens
gttttcatttggtgtagtagaaaaagcggcatcatcactttggagtacagttcccttgttatcagcgtaagtccatgagaaaatcacctagcccttcagtaccaggttttttgaacatagagggaggtagctgctatgtgtgtaattcatcttttatgtggttcaagcgtagctcgaaaaaggttggcttcatgtacagtgactcataacatttttctcggcccacagatacttgaataaatgtcatttcatgtgttcttttccctttcttcaacaggttttcatagttgatcctgcacatgagaccacagcagagttgatgaacacagctgagatgttccttagtaatcatataccactaaggtaacactggtattgatttgatgatgtatctaatttagctgaggttttatttgtcatttttaaatgcaagtctggtgctactgagttgtaggataattaatagtgcacatcactaatggcaattttatcttctggtcagtatgaagccagtgtcttttgggactgagaatttgcttctcaatgaatagaagcttaccaccaatgaattatcaataaatagcccatgtaaaaatagtttctggctgcagcttgcttcccaatggaagggaattttcctaggtgagtgtccacatcacaaaacctatttccactttcagcagagatatagagcattgccaataacttgttagcctgtcaaggactaaacatatacacagccttttgtagatgcaaacagtaacagttacttcacttgtgttgccaaacctgcctacagggtactgagtggctggatttccactgtctttttaagaacagttttttttattttttaaaggttttacatataaatgctaagatattttcacctacattctaaataattctggtaattttacatgttggtgaaattttaattcttagaaaatgtgaaaataaagaagaaaataactctttattcaataaatattactgtgtgttccatgattactactgggctaaatgctgtaaacatgtatgccttattctaccttcttggaaaagatcctctgtatactttcaaaccctttagggagatatatgatcaactgctaggttatgtcctactggttagttataagtgcgttaggatttcagggaaacaaaaaaaatcattgagatatttgggaagccaaaggtttttggagaagttggatttcaaataggctttgaggaaaacagagggttctgatagttggaaatgcagagattttgagtttcatgacatttttcatataaagcatgaatacatctggttagatggaagaacctattactggatcacaaccagagctatgttttgatcaaaagagaaatataaggacacagaagaagttgggtcgtggtacacagttggcactaatacaatatttcttgaattgagggacgagaagagggcatgtggtcttctgattgcaaaggcaggtgagaagaaggcacttgaactcctaggcaactgagagattgtgaatagttgg

SEQ ID NO: 96143 - DNA, 1068 bp, Homo sapiens
ggatcacctgaggtcaggagttcgacaccagcctggccaacatggtgaaaccccatctctactaaaaatacaaaaaattagccaggggtagtggcgtataatcgcagctacttgggaggctgaggcaggagaatcgcttgaacctgggagacggaggttgcagtgagccgagattgcaccattgcactccaccctgggcaacaagagtgaaactctgtctaaaaaaaaaaaaaacctttgtaagtggtgtatgtatacctttgccaatcatgttagagtagagtaggctgtgaactgtgcttttcactcaaagagttttcctctgttagctataatgtatgagaagggtacaaggatgtcattctttttaaccatttgcattctttgacatgtttctttttttcttttccctttccctccagaattggttttatctttgtggttaatgactctgaagatgttgatgggatgcaagatgctggagtggctgttcttagagcatataattatgttgcccaagaagtggatgattatcatgccttccagactctgacacatgtacgtttttgttcagaatggcaaataattttttcagatctaacttactcttaataacaatgtgtggtcattgtatgctaggcagctggggtgtatagagctcaggggtgggtcctgaatttaaaagtcatgtctgctgcagtgtatagagatggatctgaggaagggcaaagcaaagtggcagggatgccagttgatgagctgttgcagtgatctccatgagaagtaatggggaaggtagttaagcagggctgcggagaatgaaataggttcaaaagaagtcactcagaatagtaagtattttatactttgttattttattcactttatctctgctaaaggtttgcttttgtttgtttgtttgaatatatcttccacaacggctaccttaaaattttatttatttatgtactttttgagaccagatcttgttgtgttgctcaagctggtctcaaactcctaggcttaagggatcctcccatgtcagtcccaaatagctgggattacggc

SEQ ID NO: 96144 - DNA, 1063 bp, Homo sapiens
aaaaaaaagaatatttaatttccaacctaggaagccatcttagtaaggtatatggaaaaggaagaattgctaacatgtcccaatttgacctttcaagaaaagtaattggccaggcgcagtggctcatgcctgtaatcccagcactttgggagactgaggcgggtggatcacctgaggtcagggtttcaagaccagcctggccaacatggtgaaacctgtctctactaaaaatacaaaaaattagctgggcgtggtggcaggtgtctaatcccagctattctggaggctgagacaggagattcacacgaatccggaaggcggaggttcagtgagccgagattgtgccattgcactccaacctgggtgacagcaaaactccgtctcaaaaaaaaaaaaagaaaaataagtatattttcctctaaattcagaaaaatgtggaataaacactttgaaatttgaacttaaaagtgtagttaaccaactgttttttctttcttcagatctataacaaggtgaggactggagaaaaagtgaaagttgaacatgtggtcagtgtcctggagaagaaatatccgtatgtagaagtgaatagcattttggggattgattctgcttatgatcggaatcggaaggtaaaaaatttctttgtgtttcttatttgattgcaacattgtactgtccttaaccccgtgtttgggggctttggttaataatggcgatggtggttaaagtgtttcagtacttagcatttaaaagtttagaaaccagatcacttttcagtgtttgaaaaagtttttatttcagtcttgtgaagatatgactgatttttaacttgcttattaacttttaatggaactgtttaagtctcattttctcttatcctgttgaagagaaagtaccagtagctttttattgtggatgattatgatatcaaaagtatttacttgaaaaatgatgagtagagtggacaaactggggaaaggagtatttttatatctttacatgtgtcgaaatcttgattgtgctgaaaaattgaatgagagtatcacacaccatgctcctt

SEQ ID NO: 96145 - DNA, 1043 bp, Homo sapiens
ggtgctcagtagttacatgaggttagtgactactgcattggacagcacagacaagcacagatagaatatttccatcattgcagaaagttctgttgtatagtgctgaccgtagaatatgtagttcagttttgacagcctgtgctacacacacacacaaacacacacacacacacacacacatacacaaacacacgtacacacacacgcacttcataatttgcaagcttttgtggtcttgtaaaaacttgaactcagtaattcaatctcagatttacatagtaggatattaactttgatgtcatttttcatttttttaaaaagaaatatcttgagttattttttctttacaatatttctattgattgttgttagaacaggcatgtaagaaaaatatgctgtgttccatttgtctcacaaaaggcaaaaatatactgtttttgtggttacttgtgtttcaggaagcaagaggctactatgagcagactggagttggacctctgcccgttgtgctgttcaatggaatgccctttgaaagggaacagctagaccctgatgagttagaaaccatcacaatgcataaaatcctggagaccaccaccttcttccaaagagcggtgtacttggtgagtcacgtttcaaggctgattttttaaagagaacagttggcttatattttttgttgcctctatagtaggcagtaaaattcttagtatcactatttgggaggctgaggcgagaggatggtttgagggtaggaagtctgagaccaacctgggcaatatggcaagaccccatttctaaaaaagaaattaaaaaattagctaggcttggtggtgcacgcctgtagtcctagctactcaggaagcttaggtggaaggatcgcttgagcccaggagtttaaggttgcagtgagctgtgattaccccactgtaccccagcctgggtgatggagtgagaccctgtcccgttaaaaaaaacaaaacaaaacaaaaaactattttctgtaagtcacttgtaattggtttgcaaactcttggcaagtc

SEQ ID NO: 96146 - DNA, 1197 bp, Homo sapiens
cttgagagaagaccttttcctattttttttttttccttgggacagagtctcactctgtagcccagtgcagtggcatgatcttggctcactgcaacctctgcctcccaggttcaagtgattctcctgcctcagcttcctgagaagctgggattaccggcacctgccaccatgcccggctacttttgtatttttagtaaagatggcatgttggccaggctggtcttgaactcataacctcaagtgatctgccttcctcagcctcccaaagtgctgggattacaggcatgagccaccattcctggcctgggtttgcatttcataatcactttgcattagctttgtgagtttgagtaagttatttaacctttctgtgccttagcttcctcatctttacaatgaatgtcaacaatatctgcctcacgttgttgatagaggtagagatgctgtaggtgatgtgcccaggtatactcggcagtgacagggaccaataacatagtaacttctgtcttaactattattagcacagaggaagccatttataaagttaataattttttggttcctaatgaattattattgctaaaatttgctttaccctcccccctcaacctcctttttttttcttgcagggtgaactgccccatgatcaagatgtggtagagtatatcatgaatcagccaaatgttgttccacgaatcaattctaggattttgacagctgaacgagactacctggatttaacagcgagtagtaaggagcatttcaggaacaaccttatgctttttttgacttgtgcttcagaatctttacatttttcagattttaatattctgattatcttctgcagtgttcagaagatagcccaagattgtgacaaaattttatgtgtaaactctttgcacctttagttcataatatgagattctaaattcacaagagtttcctcctaaagaagaaaacatcttctgggcaaaaccctgtgaactttgaaaaatatttagtgccatttaaatgccaactaaacagacaatagatgatgagaatggacctggattgttcgcttctctagtcataaagcagttctctttcttcatcctcattctagagtcagtcagccataatgtcaacaaatatctcagtgaattttactctgagaacttaggaaggcctttagcagcttcatcaagatatgatgta

SEQ ID NO: 96147 - DNA, 2824 bp, Homo sapiens
aagagtgaaaatgaccttttatttctgttaagggtttaaaaggtgatattttgttagacctgaaaaataaaaatcagttttcttacgtattttctcttttacccctgcttcctctgtaggaacaggaagagcttactccactggttggactagggaagggagaaatgagttaaggggatctctttgagattgtcctccagttgacaagtgacaggaatgggaataggatgaattcagccattaaactgacacatacttatatgatagctgtgtgagatatgtatgtttccatcaaccttgtgtctttgatgtgtgacttcagtagggataggggccatgttgtgaagttgttcagtaaacatggaacttaatatacttcactcacgcatttctataaatcttatattatgatcaagtcaggttatcagttgaatattaagaatagattgaactggaactaatatatacgtatttcattttttctcccagataacttctttgtggatgattatgctagatttactatcttggattcccaaggcaagactgctgctgtagccaatagtatgaactatctgacaaagaaaggtaatccatttgaggcttattatcttgcattcaacatttttttgaaagtatttgcatattcatcttaatgtgcaaattaagagagaaaagggaaagagacttcataatttttcttatttcttataaagctttgagtctagaacatatctatttaaagtttaattctttgtatatttgttgaaagtatatatttgtttaaaaattcagatgtcttcataaattttgtattacctgttttaccttttgactaaagtcaaaaggaaaaatatttcatagttcaaatggaaaaacatttgtgatgtaaaaatgggttaatgaattaaaaatgactgtacagggttaatattattttggggtttataagataaagttggttttagaaagccttgtataatctttgaagctgattttatgcagaggtatttatttaggctaagattgtgtaaaatgacgccctgtagtggcggacagattctgtcgccctcgggtcagtgcttcagaaaagcactggctgttattttaagtcagctatttttaccgcctttttaaatccccgctgtggtctctccccaagagaagttctggtttctcagctgtatgtaaagtacaagcaattactccatttggttctttaaagaaactgtttcttagggtactgggacagcgccatgacaccgacaggactaagcagcaggaagaaccatagaccgtgttagccattgtttagactttcaatttttacagtaggcattcattccagaaatgatactttttttctactcttttctctttacctttgttcaggaatgtcctccaaggaaatctatggtaacttaaaacttcagaatgttctatttcttaattttcttctttggtttcagtgaccattgtaatttagaatttatcaacacttaattgtactgtttccggaatctgtgggtaacaggaagctatatcaatgtagataattttttttttttttttttttgagacagagtctcattctgtcacccaggctggagtgcagtaccatgatctcggctcactgcaagctccgccttctgggttcaagtgatttcaagtgattctcctgcctcagccttccaagtagctgggattacaggcacccgccaccacgtccagctaacttttttgtatttttagtagggatggggttttaccattttggccaggctggttttgaactcctgacctcaagtgatccaccctcctgaacctcccaaagtgctaggattacaggcgtgagccactgcacccggccaatgtagataaattttgtataaacatttgtaaagaattagtttcagaaaattacaaattagtatgattaaaaatgacaatatgttacccacatgttcaaaggctgtttttcattttacatgctaacagatgcccagaccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcaggcaagtatctatgacttcattttatatttttgtttgtggctgtagttgtcttcatgggcttcgctgtgcggctaggattgttcagtgggagttgggagtcctgctttcttaatgctcgagggaacggagaattgtatctctagagatctgccagctctcaagaaaagagatctaagactacagtatccaggctttgttgaacgggatagattcttatagagaaaaaaataaatagcgagatcctcatcatagacaagttttattgcatacctgttcatgttcttggagcagagttgctccaacaattgtgttgtgtactgtatcggggagatggggtccttaccacgacagaggtctggacatgggggcagtagcacacaggaatggtagtgtgtgtgtttagtagaagtagatccagatgcactgagggatacacacataggtgttctgaaaagatatgctgccattaatagttgg

SEQ ID NO: 96148 - DNA, 2960 bp, Homo sapiens
ttttttttttttttttttttaatgagacggagtcttactctgtcatccaggctggagtgcagtggtgtgatcttggctcagtgcaacctccacctcccgagttcaagcgattctcctgccacagccttgcgagtagctggaattacaggcgcccaccaccatgcctggctaatcttttgtatttttagtagagacagagtttcactctgttggccaggctggtctcgaactcctgatctcgtggtccgcccgctttggctttccaaagtgctgggattacaggcatgagccactgcgcccggcctgagacttttaagagagatattatttgctacttattgaacatgactgatgttaatgctgctttttaagttcaaaaatatctacaatatgactcccgtttcccattttgtgaacagaaatccagtaacaatgttagaataagcatgatcaataatcctgccaaagagataagctatgagaacactcagatctccagagcaatctgggcagctctccaaactcagacttccaacgctgctaagaacttcatcaccaaaatggccaaggagggggctgcagaggccctggctgcaggagctgacattgcggagttctctgttggggtaaggctctgagcctctcatgaggctgccccattttgtctgccacggaagctcacccactgcagcttacgtgtccggttcatgatcacgatttgtcattttagtcctgagtctcagggaatttttttttttaatttggaagtttccctttattacttttaaccttgcctagctttcatgtggtgcatgatttgagtttttgtgtgttttaagtatggagccatttgttatgcacagtttttaagagagacaatatggcttatttatagagcaaaaaacggagatttgaaccacttataggttcaaggcttatatgttcttgatgtgtttccagaataagcctgtgtttattcatttatattttatgttacttatttttttgacacagttttgtagtttttaaattttttacagaatgatgagtatatactatttgacgtttgagttaggaaaacaggctgtcactggaaattagcaggatttaaaaatgcagagtaaaggaatgatgaatagtctgctagtcgaacaaatcacaggaaaagataaggaaatagcagttactctaagtagtagggagatggcggggagactggagaattgacacatcttaatgttaattatgaaaattagttattactttccagggaaagaaatttttatggtttattcactgtgtttatttgtttatatggtttgcttagtaacgactatttttccttaataatgattactttcctagggaatggatttcagtctttttaaagaggtctttgagtcttccaaaatggatttcattttgtctcatgccgtgtactgcagggatgttctgaagctgaagaagggacagagggcagtgatcagcaatggaagggtgaggatttgtcaagcttgacttcacattagatccgtgaacagtctttgcagcattctcctctgaagctagtaaactcttcagacagagccactcttttttcaaaggtgattggggcttatgaagtgccattgatgtttctgcctcctatttccaaggagctgtgctttttgacatagacaaatatccccatatggagccttcctgctgtcggtgagagtgtggtggctctcagaaagtcagtcagtatggactttgacacataaagtagcctttgttgtttttattcaggtagaattaatgaaaactactttacgattttattttactttgtccttgaggaattgataagtaaataactacaagtatttgctttgggcttcactttgtattatttcactgattttatctaaacatgtacctgtctcaggtctttaagatgttctggcgtatgaggtagcctgaggacgccagagggttccttaccagcttgctgagtgcaggcagccttccagagctaagcgcctgctcttctctccttcacagatcattgggccactggaggatagtgagctctttaatcaagacgatttccacctcctcgaaaatatcatcttaaaaacctcaggacagaaaataaaatctcatattcaacagcttcgggtagaagaagatgtgtaagttttgccataggaggaattacaggggttatataattggactttcctcattgatcagttagaattatatgttgttactcatactacatatcccaaggagttttatttccagtttaaaatctaataatactcttcaattccagttttaatgtatgcttctgttgaaacaagataatttattttgtagggtactatttaaggaactgaactagttctctctttttatttttataatttttggttgtggaaaatttcaaatatatgcagaagtaaagaggctagtttatttattacctggaatacttatgtaaagtgatacttttcatcattatctatttggttacccttcagttttattttgttcaggaaaggaaaggcagtttaaatgtttcttttatttaccagtgcagaatactgagttgtttcccttgtatcttcaaaggtgatgatgaattggttgttgtcggtttttaattttaattttcagtgttattataagctgatgtgttttagtgtgttattttcttaatggaagaaaataaattgtttggatggaccctggagtccattgttacatatatgtagtttctgcattaaatatcaaatgactatgtagttggaggatctatttctatgtttaattgtttgaggaaccacaatacctttcccacagtggctgtaccattttacattcccactggcaatgctcaagggtgccggtttctccacatcctcacaacacttgtaattttctggggggttttttgtttgtttgtttgcttt

SEQ ID NO: 96149 - DNA, 1241 bp, Homo sapiens
gcaggctgccagtataatttgtttatatgtatttaaaagtatagaattatgagccaaaatatcagaccttgttacttgatattatgtgtaatttcaatttttggcttttatgtttattttccagtgaattattactctaatagtcataaaaagtaatagttttaaaaggacaagggagaatgtaaataatactgacagcctgtaatgggccagggcctcagctaggtgcattgcagagttgtgcagttttactagagtcatgcagcgtgggtgctgtctccatttcacatgtgggaaagtgagtaacttctccaaggttataccactaatcactctttctcatgcctatcagtacggactttataccttgttcaaaccatcttgttagaattcagtatttgggctgatgatatgtttggcaataattggaaaactttcagttaaaaagatgttaagatttctctaaccccttctttcagggcaagcgacttggtaatgaaggtggatgctcttctgtcagcgcaaccaaaaggagatccaagaatcgagtaccagttttttgaagacagacacaggtatagaattaatgttgaatttgtgcatattcttgaatattaaactcttatgtttgctttacctcagctccttcatttttccatataagatttatatataagttcttacaggaattgaacatttgtttggtgtgcagttttcacatgtatatatttgtgttcatatataaaattcatatgcaaatctcagttgtatgaaaactgacatttatttctaaatgaatctgaaataactctgagtgcacccttgtagtagaaaatagactgcatttaattaaacagagaagttgtacttttcttaaattcgagaataaacacaggcaggtcaagatagctcatgcttgtaattccagcactttgggaggccagtgtgggaggatcgcttgagcccagaagctcgagaccagcaaacaaagggagaccctgtctctacaaaaaaattttaaaacattagctgggtgtggtggcatgtgcatgttgtcccagctactctggaggtagaggctgcagtgagccatgatctcatcactgcacttccagcctgagcaacagactgagaccctgtctcacaaaaaaattaaacagagattggctgggcgtggtggctcatgcctgtaatcccagcactttgcgaggctgaggccagcggatcacctgaggtcagga

SEQ ID NO: 96150 - DNA, 1076 bp, Homo sapiens
gccggggaggtggaggttgcagtgaaccgagatcacgccactatactcccagcctgggtgaatgagcgagactctgtctttaaaaaaaaaaaaaaaaaaaaaaaaaaaaaaaaaaaaaaaaaaagacaaggaccaggtgtggtggcttatgccattgctttgagaagccaaggcaggaggatcacttgaggccaggagtttgagactagtctggtcaatatggtgagacccgtatctctacaaaaaaatataaattagcccggcatggtggcatgtgtctgtagtcctagctacttaggaggctaagttgagaggatcatttcaacccagaagttagaggcttcagtgaaccatgatcacgccactgcactccagcctgggccacagagtgagaccttgtctctaaaaaagtaaataaggaaaagaacaggcaaaatatctatctataacttaatgctgacgaaggatgtggtgaaatttattttttggccttgtaaatttgtttagttcttcaggaaatgtggttgacaatacttattagccgcaaagtatttgtatcctttgtctccataatctcatgtctagcacttccttgactctaaagaaatttccaaatgtggagaaagttggttgtacaaattgtttacaggttgaaagccatctctatgtccagcagtaaagaaaagctggagtaaactctgacagcttcatttggtgaatagcatattatttcttatagaggatgcttgttgtgtaacagcatgtggaaatctttatgctacagtagtgagagacggaaggaaattgttttgaaattgctaatctgtatctacaactaatgtttatacaggcatctagaaaggattacgtagagatgcagctaagtgggctgggatagtgaatattttgtgattatatttttcctttttctttgttttgcaggttttctggaatgttctttcattattttttaaaaattgatttattccttttctttttgtactcttcttgccaagaagtaaaaactggcataatgttatcagaagctaacttcagtagcttttctcagtttttgg

SEQ ID NO: 96151 - DNA, 1033 bp, Homo sapiens
gttttttcatcctttggcatgtgagcggtgactctgaggcctgtagtttttccatgatctgcctgctgcttccccacaggaactgccttcgtgtgaggagcagtgagctgcagcagcctacttcccattgcttttggccacgtcctatgtatgtgtgatgtagattgtgcagtagagttgtgatttccagaagtttcgccagtgcagactctgtggctgttatctttatatcttttcttgagatattaatagctcagtgtcaaataataaatttctgaagaaaaaaatcctaaatattttgtcatctggttttccttctaggttttggctcagctgataaacatgaatctgagagtatttatgaactgccaatccaaactttctgacatgcctttaaaaaggtaaaacatgctatgtaagaaaacagttgaagaaattgtactgaatccaagttctgatattgcatgttagaggatcagatggatttataggtggacatcatgtttgaaatggtcatttactaaatgttcagttttgccaaatttcattctaatcagaagttctaagaacatagtgtgtttgtagcatttaggtggcattaacccaggctgcttgcatttgtgccttttctttctttttttcgagatggagtctcgctctgtcgcccagattggagtgcagtggcatgatcttggctcactgcagcctctgcctcccgggttcaagggattctcctgcttcagcctccttagtagctgggattacaggtgcacactaccatgcccagctaatttttgtatttttagtagagacggggtttcaccatgttgaccagcctggtctcgaactcctgacctcaagtgatccgtctgcctcacttcccaaagtgctgggtttacaggtgtgagctaccacgcctggccccatttgtgcttttcatcttaaaagaagaatattcatttcaagttggaatatacatgttagaggaagcttgcttagctatatattgtcatgagctttggaatggtcattt

SEQ ID NO: 96152 - DNA, 1072 bp, Homo sapiens
aaaatgagtcctccttgaagggaggaaaatgcccaggacctaactgtgaccctgacagccatccatgtgaacgagtggcctccgttcaagtgattggattttggcttgcaggtggacagtatagtggctgctgagtatgagctagagtacctgttactagaaggtcattgctacgacatcaccacaggccaccactgagcactcctcctcagtgctgtccttgtttgccttttcttgcatctgcagcaaccacaaggaggcatcataaggtcaaagatggttttggaaacacttttcccaatctggaagggtactcctccaaatctaatttgttttaaccagttgttacctgtgtaagggctgtgcactcaagtcctgttgtcacatcgaaaattatctaacactttccttttcaatttcagcttttaccgttatgtcttagaaccagagatttctttcacttcagacaatagttttgctaagggtccaatcgcaaaatttttggatatgcctcagtctccactgttcactctgaatttgaacacacctgagagctggatggtagaatctgtcagaacaccatatgatcttgataatatttatttagaagaggtaagaccatatctattgcttccaaatacctaatcatgtataatacagcagattgaatcatagtctaggtgggcctctgagacatcagtgttcaggtatgatatttttttaaacaacagctttattcacatggaactcatataccataaaattctccccattaacgtgtacagttgagaggttttagtatcttcacggagttgtgcagccatcaccactatgtaattgtaggatgttttcagcatccccagtgaaagccccatactcattagcagtcactcttcatttccccagcccctggcaactgctggtctactttgtatctctatggatttgcctattctgacattttgtctaaatagaatcaaatgtggtcttctgtaactggcttctttcacataacaaattgttttcaagatccatccatgctgtagtatgtatcgacgcttcactcttttta

SEQ ID NO: 96153 - DNA, 1043 bp, Homo sapiens
ttaggtctttaatttttttcaacatttagtatcttatcctcgttcgtatttttagaataacgtccttattgtttttttctcctttctctttccaacctagtttttataattgtatacagtcattaaccaccactatagccacgatgcagaacatttccattaccccaaaaagttcttttatacccctttgcagacagtagcctcctctcgcctggtttcaggcaacaactgatctgctttctgtcattatacttttgtcttttcttgaatttcttaaaatatgatcatatattatgtaagtcctttttgtctgcttcctttactttgcataatgcatttcagatttattcatgttgtctctgagtgcattcaagtgattggattttggcttgcaggtggacagtgtagtggctgctgagtatgagctggaatacctgttactggaaggtcattgctacgacatcaccacaggccagcctccacggggactacagtttaccttaggaacttcagccaacccggtcattgtggacaccattgttatggccaatctggtaaataatctgttcatcagatagtgatattgtagttacgttaatttgggcactataatttatgatggagcaattagcattcttaaccatagagtgagattaaaattcattatgggctgaatttggtcaatatagaaatcattagttcagctaaatttgtaggttagaattacatgtcaaaagaaaaaacatgctggaatactcagctataactgaattggccccctgaaaatagattgctcatgagctgacagcctttttcttttctttggaagtgcaacacttattcatgcatcacacgttgattcttccctgaagcacagctaaagagcagatgatttattggtgtgactggcctttattgtactagtttttttttttttttttttgagactcctgcccaggctggagtgcagtggtgtgatctcagctcactgcaacctccgcctcccaggttcaagcaattctcctgccccagcctcctgagta

SEQ ID NO: 96154 - DNA, 1020 bp, Homo sapiens
agtacagggcctattgttgactgattgttgcctccggcagaaagagcgagcagatttcctttacaacactattccagttaaagagtagtggccgggagtgatgggtgatggctcacgcctgtaatcccaacactttgggaggccgaggagggtggatcacttaaggtcaggagtttgagaccagcctagccactatggtgaaaccctgtctctactaaaatacaaaaattagccaggcgtggtggtgggtgcctgtaaactcagctacctgaaggctgaagcaggagaatcacttgaaccccggaggtggaggttgcattgagccgagattgctctactgcactccagggcaacagagcaaaactctgtctcaaaaaaaaaaaaaaaaaaaaaaaagagcggaggcagtgtggttccaataatggttcagggggcctgttccctgcattcctttatcgaaggctctgtgcttggctcagagcttgtgaacacaggcggttgtttagtactcaccatgtggttaccacacatgggtgcctctcactacgtgatgggtaatttgcaagaggactcacaaaggaggtttgggcatgcaccttatataaagagaggtttcaacacgtgcttctgtgcagctcgaaggagcttaaggagcaagaagatagctggatctggaaaactcctttatgagaaggatgatggactcagatgctctgagagcatttgctgccttttgagaattgtgccttgtaatattgatctttcttttctcgcaaagccacgatggcactgattctccccctgatgctgatgaggtggttatcgtcctcaacaacttcaaaagcaaaattattaaagtgaaggtgagtttggtaaaagtagtggcattctgttattggacagctgtcatttaaaaatatgtatcttggaaccagcccaagagtctctttggaatttgctatggcaattatagggatactgctttaaggcaaaatgtctttgtaactgtgagtttgtggc

SEQ ID NO: 96155 - DNA, 1020 bp, Homo sapiens
aggtgtctcgtgattgactctacataatgttgaggttaaataacattggaaagctgttattaattacctgcttttgtttggcagcataatgatgctatccgtgctgaagaataccaagactcctgtgaaattctggttcttgaagaattacttgtcccccacatttaaggtttgtttcacagagaaagggaaaacattcttattaaggagatatttactgtatatttttcatgacttttgttttatctgtatactttagcaaattttccatttactaagataccctaatttggttgcatatttttattttgattattcttccagattggtctatttgaaggaaacagttaaattgtgtttaaaaacttggatgatatggtaggagagtcttttgttgttgttattattagcagtgtcttactgagataacgtttccttcctctgaagcctgcatgcttgctttaatttagaaagcacagcgatggtttacattgaagagaatgattggtgttagcatgaaccactcctagatgatgtatggaagtagtgcttcctctgtgcaaaacaaaacacgtacttggaatgttttctgcattacttatatcagtcagtatttgtcatctaagttgatttatttgcatcctttttttttcttgtagaatttactaagtgacttttaatatattcaataaccattctccttgataagcactttactgctggcgcctaaaggtgcttatacttagaatctgaaagacttattcaaaaaggacaacacatttgtccagagttctggctttgcagtgttattccctgggttagatctggcctcgaggaaggcttgtcatcaagctcagtaaatgccttactgaaatcaagtttagacaaatggacttaaagttcatgtgctgtaaaaacacacacagagggatatacatctaaaatccttctcttgaacattctgtcatttcatgtggtgaccagaagtcataaagaaatggggatttgacaaaggtttat

SEQ ID NO: 96156 - DNA, 1509 bp, Homo sapiens
tctctctttcctactcagttcctgttctcacagcagataacctcccaacttattgactgtctatccttccagattttcttaattcttacagaaacagctgtgaatgtgtattctttttttttttacacaaaatatgctacctatttatacattttgtaacttggcttttttttttttttttttacttaatgtcatatacatcttctcagtgaatagagagagacctgattccttttcatagctgcatattattccagtgtgtgagtgttatttatagttttccctgtgacctacaatgttgcaatgaataatctactaaataatttttcatatctcatatatttgtgagataaattcctagacgtagaccttttaggtcgaacagtgtgtgtgttgttacatttctaatgagcaccccattctcttctctgcgagaagtgtgatttgaagatgtgcagggaagaggaacgtgtaggaagcggcacatgcagagatcactgctggggtttagtgatggtggcttcattctttacattcctggtccaaaagaactgtaaggactgtaacactctggggttttcccccccctgtaacattgaagacatcatcaggatatcattgaataatggttgtttatcagttactatggcttttgttactgccgcatatgctagaaatctttggtctgagattatttctttcggatggcaaatacagaacagtaacaaaagcatagcacagtatagattttgcagtgactttcttagagatctttaaagtagcacactttaactccactgtagggctgtagcataccttttcaaagaaaagccagaatatttggctagtggcctgttccattattcattgggtttagttttcctgtcgtaatccatggttggttgtaacaagcgggtcttctttattcagtgcactatatgttgtggatctgaagaagtttaggaaaatagctgctggtgacagactcaggggacagtaccaaggtctgagtcaggaccctaacagcctttcaaatcttgatcaagtaagtgtccattttttatggttaactgtgagtgacgggtatacagtgttgcatcagaaaatgaagtattacttgtgtcttcagtcctctcctcacaggatggcgtcttgttttttcatggtgtgtgtgtgtgtgtgtgtgtgtgtgtgagagagagagagagagagagagatttttatctgccctcaagacatatcagcgtgaaaaatgtcatagatttgatgctggctggggagagagatggaaggagaatgctgcctctctgaaccattagcatatctttgtattttgtactcaaactaatctcataggtttgtttctctacctactagggtcagtttgtttttctgctgtaggaactaaatagctcaggattcgtagtatagaatcacagtatagtatcacagcttcccctttttctatgtcagaaaccatgatgtgtttcaaggctagctaaattactg

SEQ ID NO: 96157 - DNA, 1050 bp, Homo sapiens
tgttgtatagtaagcataagtatatagtttgttggggctattcttatagaatattcttataaatattcttatcttatagaatatttcactggttttatttccctgcttacattaggaaaccaaatcccttagcacttaatgggactgttttcacaacttacaatctgctgagtcactccttggcttccagtttatctctgtgccttgtaatttttccaaatggactttcacttttcctgccttccattagccactcacacattctttgtagatgtaaatacagctttacatagcccactaccatattgcttctggtagtatatcatttggttccttactattgttttcttgtccagttaggacttgtaacccaagaacctttgaattctctatcatgtggcctttcttcaactcagctgaagtgtgttcttttggtttcacagtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagacaaaagaaccaagccgagaaggtaagcacaaaccgttggttttaggacagtacttctttccatttctgatttctgcttgttgtaaagacaatagaataatggataaaaggaagagaaaaatctcctattaatccttccattctaacatcaaccagtatatatttttcattttccttttatgttggtcttctaaacagtatttattagtgcaattgctatgtttttttttttttctcgtttttctggtgagggggagaaagggtattttaattgtgattatagttatttaggttcatgagttttgtgatacataaaccaaaccttttgcagagttcttcttagattccttgttttttttttcattaaatctgtcagtgtactagtgaatgaaaaaatttagatcaacacaaatatgtagttgaagaaactttttttttttttttttgagacagagtctcactc

SEQ ID NO: 96158 - DNA, 1117 bp, Homo sapiens
accctcaagaattactctcttgagaatatatctgaaagaaataattcaacagaaaaaacaaagttgtatacatgaaaaaatttattttactattacttataagccagaagcatcaaaaacagtttaaacatccaagaatgagctacactgatacatagaaaatgtttagatgctattaaatgataaaagaaaaatcccgactaaaaaaatgcatgcaacgtttactgaaagtaaatattgtatttgtgaaaacaattcagttggagtggggtttacagatagtttccatttttaaaaaatctttaatttagtttttgctttcaaaatacagtacaaaagcacaaatcccaaagatttagtaagtgagataagatgaaggtggaggtacaaagaataggttccagtgatgaaaaatgcccactcagtggtgtttgtaatttgaagatcatctgttttcttttctgtggttctccttttccttaggtcctcagaaacgtgaagaattatgatctctggagaaggacaggaaatcaccccatttgaaaaacagtttttataataaatgctagttttttctgatctgtctatacaactgctgataagccggctgggcaggagtgccacaccttttgattctgagcatttgattctgacttctgtactctggtggccactggatctttgggattaaagctctgttggatttgtacctcagaggaagaccaagtggctgatcctttggactctgtaaagagcattcttctagtcagagggtggaatggcagcagcaactggaagaaaatgagttttttggtgcccacacccaagagcacacacatgctgcactgtctcggaaagcagggccagctagagccaccatgttcttccttacctcagtttacctgcggcctgcgctgcactgcagatgcccaccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgg

SEQ ID NO: 96159 - DNA, 1021 bp, Homo sapiens
gaaatgcctagaggatacagatttctcatttcattctttggtctttcatttctctatatacagaaatgaaatgacacttctgggaggcagtagaagcaggaagtcaatgaattgagtagagggtcccattccctcaggctgtcattgatcagtgacaatttataaaaacaaactgcaaagtctgtggcaagtggctgcctgcttcctagaaggagcccatgaaggttaaactctgtggtcggtatttgcaagcgccgggcgtggtggctcacgcctgtaatcctagcaccttgggaggccaaggcaggcggatcacccgaggtcaggagtttgaggatttgcaagcaaaaggtcctctcctgagtctttcccagatacccagcagtgcagaggctagctgtggaaggttgcagtgggacaggaatgtattgtatgccttgccttacttgtcaccattgagatttccagagaaatgggcataacgtctcttaacaacaacagcagaaagcaaaatacattaacttaaggttgacaacaaaagattatcaagtaccatgttttccaaccaaccagttattcgtggtaataataaaataaaggtgggaaaatgttataatttttaaggaaactgtgtactttaaaaatcttctttatgaatatccaatgttactgtaatcctgctccattaaatgcagcattgttgtcaggtgctgcctcttgcttgggaacagcattgggcttttaaatgtctgcagaatctctgcgttcgaagggaattgagaatgaacttcctggtactgtaatgaaaataaggtctgctcaacacagtaaacgtttcctctcttctttaaaactgcgcagtcatttggcctttgtgtttaggaagggcagattgatagagcacaaagtccaaccccttcatctagcagaagctgcaaacccagacagaggaacgagggctttacctgagtcttgtctgctgctggggctggcttcgggttgcatccagttctttggattc

SEQ ID NO: 96160 - DNA, 1056 bp, Homo sapiens
ttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaaggagtggcgggtgtgctgtggtctctgcgggcatagctgcccctcccagtggggtctcacaccacgtcccaagggcggggtgctttgcacaggtgcaggaggctcagtgaggaaagtcccattaagtaaggcattctgaaagaaaaaatgggactttgtcatcaccataaagagtaaccgtttattaatcattagtgatagtatttgggaagatgacaccagttgagagggaggcaggtgccactgagttacattctcattaacctcttccctccctgtctttggaaattttgaaagatttcaaatgacaaagagagtggaggaatagttcatgg

SEQ ID NO: 96161 - DNA, 2477 bp, Homo sapiens
gagcagccctggtagcccccctcatgctgcgtcacagccctcacctcctctccccgtctccttgcaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttac

SEQ ID NO: 96162 - DNA, 1055 bp, Homo sapiens
catgaggccagcaggcaccagctggccagtcctgtccagacccaggtgcctccgtctgccagagggggcagggcagggagatgggcctcagccctgctgctcccttcctgccaaggggctgggctgaggctggatctcagctgacccagctccaagcccagcccatgcttgagggggtgagtagccttggcctctctggtgttgcttcctcatctctccagctgggacacgcccaggctgtcaggtcactggtgaggggctccctggggttgggtcagcctcacctgtccatccgggtgtcctgccaaaggtcccatcagctgcaggctctgcctgccctgtgtgtgtcctgaggcaagagggggctctctggaaggggtgtgggcagcacagccttcccaggaagcacatgggtgaggactgccccctgtgcccacacagcacctgaccactgatgtcatggggcccctctccagacctgggtatgtttggaagcagattgagttaatgaaaaaaaaaaaatctgactactcttctacagacgtcaccaagaagggacagccttagcccagcattttctgtgttgcatttgtagaggggctccccagcctgctgccgccagctcagaacttgatgatctgggtttttctgcaggcagaggggaggggctgcctgcccttgggccaagccaggcctggtgctgcggcactgggtcaggtgcaggcacaccagagcggtggggaagccattccctctcaggcagtggctcacatgcctgtgcctcctgggagcgggtcgtctcctctgggctgtctcccaatcccctgccctcctggacctgcaggtgccccctctcagaaggaatgacaccatggacagccagcccggccttgtggccctggagagctgcgcctgagggctgcttcctgccacaggaaagaggaggcagccacccgccccaagtggggcgctcagcggcttccaccccacagtgggacttggagccaaaatcagacttccactttttctaacaaactgggcagaagccggactgc

SEQ ID NO: 96163 - DNA, 1028 bp, Homo sapiens
gtgctgctggacagccgcagtttctgtttacagtggttcagcccagtactgccgcgtcttcactgcagggctaaaggtggttttttctttatgcagaccactctgactcttcactgatgcactgtgctctaaggaaacgggctgtgatttttgttcctagtcagaaaacaccaccctggccatggtttgggcagtagtcagcagggcgtcctgagcagcattgccaggccattgtatctgcctagcctctggggactggcaaggtcagcctgcccttccagcctggaggctgtggctcagcaggtgaatagttctcttcagtcagtcacagcctgggtccaggtggacatgggctccaatcccagtgctgccctgaccagccatgtggcctgggctagttattgaacctctctgggtctcagtttcctcatctgcagaatgagaataattcatgcctatggggtgactgggtaaagcgccaggagttcagtaaattaataattcagttactcctgagcccaggctgctgccaggccctcctggccccgcccgggagcccaccctgtcatctcattcaggtccctggtgtatctccctgaatagatggattaggttcagaggccaaaacagggcagcagtttattttttatttccctccctttggaagggagcccagcataagcagaccaggctggtggaacgccaaggaaacaccaagaacccaggctctttctcttcgctctacaaagtggggcttctgcctcatggtccaaggtgactgctggtgctccgcggtcacatccgctttccggtcagcagcaggaaaacagggcaaagaaggctgtctctaaggacatcctgatggccggacagtcacacagccacacctggctgcacatcatctcctgggcgtcttcctcctcagggactttctgcactgttttctaagcctctctcttgagggccacatgagcacagagccctgtaccacctggactgcctttccacccatccgtaagaattcagct

SEQ ID NO: 96164 - DNA, 2725 bp, Homo sapiens
attttcctctcttgtgcatttgtccaacttcggtattaggattatgttggcctcatagaatgaattgggagtgtccactgctttactcttgtctaggagggtttgcttacaaaaatctggttcttttaaaatttggtagaaatagcccagcactttctttgtaggaattttacccctaactttttatcttgaaaaatgtcaaacttacaaagtcgttgaaatggtagtaaagtgaacctcatacctttcaccgagacccactgcttgttaacattttgcaatatttgtgcttgtgagtgggtgctctcacttgctgtttacatatatgtatatctgtagatacatgtgtacttacatgtatatttatatatgtagttatatacatgcttttgcattttagtagaatcatttgaatgtaagctgcaggcatttcctcaatattttaggaagattttaaactactgctttgatttttgctttttgagattatcgggctatttgtgacttatatttggacattttatacaaataatttgactgacagctatcctctctctatctcttacatgttctcctggtgcctctggcctgtggttggtgaaagcaggtaggtctgttccggcagcttcctctctttccctgccagctggggtgggcccatcctcatgccgagcgtcatgctgtgacctccaggaggcatattgtcttgttttgtgcaaggaggaaacagatgacagatgcattccttggggaactcgtcagggccacacagctgctggatggcagatcccttagcaagctggagacctgttttctggtgctgccaatggcgcgccgggttctcctgggagcttcgtgctgctcatctcagggaccgtgcacgtgggtgagcagcagacatgccttgtggcctatgaagtcagacacctctggtatctgggagactttggctgcagaaggatctctgagtctccatttgcccatctgcagggggatctaatagtggcgaccgtaccggggttgcaggaataaaatgagcaaatgcctgctgggccctaaccttttttggaggcaccaaccacagaagtgcttgatggggggccataaaatggctggttctggagagtcagcattcccgagtccccagggtcactgctcaggtgacagctttctcagtgcatcacccggagctgtcgccctccttgtaagtagagccagggccatgggagtatagagttggatactgcagttagcttgggcacagaatggcttatctctggggtgggctgtttaggctctgaatttccctgtctggggaagaatagtctacattcaagagcatgcaaggccatctctccgcggccgcctctgtgtttatatggactcgggggttgagggagcaggtgtcagcccctcttcgctgcagagaggctctgtggggtcgtgggtgagaaccaggactttgcctcggaccctgacatgagttgctgtggggtcagcaggaggtggagcctggaggggtcccagggacacccccagtgatcctcagatgagctctcgccctcctgaccccgagaaaggctgattactggtgatgatcctgtggctttggagatgtcctgagaggctgctggggaggccctgagcctcccaggcctccctgactctcctacctcctgtgagaaagtcagattagattgttttgtttgtttgtttgttttctaatacatgcatggttatataaaatcggaaaaatacagaaaaagtaaaagaaaaaatggcccagggcactaggcccagggcacctggcgcgggttgcatttctgctccatctctccagttgatgtgttttccagagttggcatcaggctgtacccacaagctttgatgtggctcttttgcccattgtgcacacagatatgagcttctgtgttaatgcagagtccccagaagggctgtgcttttctactgccatggagtcaccgggcgtaggtatcaagtcgtgctggctggcctcagggccctgagcactttctcacctggcagggacagtttcatagcagggtacaaatactgcacaccccggcaggacctgacgctgccgccagcctccctctcgggcctccacgtctctcttggtgggcccaagcagccatggtggatgtgtagttacaggctgtaaggaagaggaagggccacgtgagtcctcgcaatagcctcagcaaaaggcctagaagcagaaggagtgagccccagagctcttggccaggacaagaggaggccatggctctggagacaggtctcaggccgagccagcccgcccctagtcagctgccctgctgctcgactgcgtgccctgtgaagaagcagggcactgtcaccttctcctgaccccaaggtatgagtgtgtgcgttcaggcataagtgacatctcgcctgccggtgtcagaagccagaaagtgccaggcaggcaggtgtgaaatatgaatgggcagccttcatgaccggcgagcagccccgcagggccctcatggccttgctggagccctgccttggagcagcaggcaggagagtctgaagggcagtgggacacaggtgaggaggtggtcctcaccccttctgctcatggaagacctcggcagagccccattccaggtgtccagtcagcagcatctgggcccgggctgctcacagccatgctgggcttttggacagggtcaagctc

SEQ ID NO: 96165 - DNA, 1045 bp, Homo sapiens
ccctcaggccaagctggagcctctgagctgttcccactagggagacaccggccagcatggtgtccctgactgtctggcagccgtgatgcctgcgtgagccagtggggcccaggaacacatgctgcccgatgtccatgagtgccggggaccccatggaggctgggcccagcgggcaggatcagctgcaggcttcaaaccagcacacatgtacccctgagggtgagaggctggagaactcccagggttgaccaggggctgacaaagcacgcacgctctcccacacacgcacgctcacgctcatatacacacatccccagcagtagctcatgctttggcgccagtggtgactcagaaacattctggaacaagaattccttttttccttacaagtggttggcacttggggatgtttcttcgtatttgaaattccttcccactggtccctttaagagctgagcaattttccattctgagctgggctgctcttccatcctgagctctcagaagtctttgaaatggtcccaggatattagaggagatgcttttccaaagacgatctgctgtcattgcagacacaggaagggtagcctggagccacatggcccctgggaacccctgcctgacacacagggcgcaggagccatgcagcccctggggatctctgcccaacacagaggggtacaggagccatgcagccctgcctcacacagaggggtggctagagctacgcagcccccgggaacccctgcccctcacagaggagtggctagagccatgcagcccccggcgaccccagtcccacacagaggggcggctagagctacgcagcccccagaaacccctgcccctcacagagggagggaaggctggtttctatagaccattcaggaggctgttgctgcatgtacccaagcagccaaaagcccagactcctcaaactttgtgacccagggctcccattcctttcttttgccctccccagctaatgacaatgacagaggcactcatttcttaggcatgtgccattgcacccacccccaccaca

SEQ ID NO: 96166 - DNA, 2238 bp, Homo sapiens
gcaccgtctgctgcgggcgcacccagggctgtccctgtggggcactgctgtatggataaagcttttcgcaccccctcagaaaggagcatgggggtggtagccccctcatcatcccagccttggaatgtgcccccaccccatgtgaccccagccccatatttgcagtacccctgctgccatgcccccactggcttgggacagaagggcctacacatcaccatccacctgagaattagaaagcgccttctgctgcagggcttgcaggaacaaatgtttacagcccctaggcggcagggggagcatctcccctctgagttatgagctttagaggctcctgtgtaaatatttacctctctagagcattggtgaccgtgggagatcgggatctgtaagcactgaggttttctgtttgcgtcatcgtggccagggtggggtgggggtgtcgtcctggagcagggagccaggctgtggagcgtgcagctgcgttctccctggaatcctggtccacattccctggcagagaaatcttcgcagcggcgcggccacgtcctccagcccgaccacagttgatggagggaaagccagggaaggcactgtcctgtggagtgacaccagcgtgctagccctgctgaggagcggaggcacaaaggagggcattcctgtcccgagggtgcagtctgggagcagggaggggctgtgacagtctcattcaggcctcactgtcaggggcgctgttttgcagatgagtaaactgagactcaaagagcctaaataactcatcacctaaggtcaccggtggcagagctgggattcacacacaggcctgtgcctgcaggatttcccccaaactcctcccagtgacaagtcgcaggcaggtcactccccagagtgggggagccaggcgtgtggctcatgtccgccacagtgcctgcctctgggagggtaacgcagctgctctgcgagcaggtgggctcgccagggagtccaggatggtgcagggaacctgggcaggtcctgagggactgctggcccaccctcctcaaggtccagctgaatgagtggcctgctggaagcagctgtcaccaggtgtgatgcttcagctcccctgagaggatcaagggcaggcagagcagatggtctcccgggggagttgagagggttgtgatgtcacccgtaaggagaggctctgcccaggcactaagccggggagaaggtaggccccagagtgagagtgggttccagctctgcctggagaacaagggcctcagccagccgggctccaacccttgccacagcctccttccttcccgcccactgcagaccccagggctcccggttggaggggctcggcccctcctcttctgcctctgttccctcctggcaggcaggaaggtgagcaggtctgagcagttggtttagctcacgcaagtccaggcagggccgcttgtcggcacacgtcctgaaccctgcaaaagttcaggcctcccaagtcatgctttaaaactgtccaagcaggcccatcgggaagccaggcccagcaaggaggggtttgttactctgctttcctggaagctgggctggcaacgttcccagcagagaacatcattcttacaaagtagaggggtgtcaggtttcagccaagtgggtaaaaggcaggtattgggattggtgtggctgttccaggacaggagcaaacccccatccttcagcaagtgggtcaaatggggacccaggcaggcaatgggtcaggccagcaaaggctggagaatccagaatggagagcttaggaggccctcatagcagggagctgcctcctgcatgacactgaccctgtgcattccacacagatcacaggcactgccctgggccaccaggaaggccctggggaccatgttccatgggttgccacagagccaggggatgatggcctgcaagtgtgtgtgggtgctcagtcacccgccctccccagtgcagcccagcccagctgcaggagaggaaggtagccattcctgagtgtcatgagatgctgagtgctccagggtgggtcctctcactgacccagtgagggctgccactgctgtgcgacactgctgtgagcactctgatgggacacagtgtcactgtccctgttctctggtacatgggtgcctccatatcttcccagtggcagagggtttttggccagcatctgactacagcggctgtgtgcattgctgcagtgctgggctctcccgagag

SEQ ID NO: 96167 - DNA, 1095 bp, Homo sapiens
ggtcgtgagaccctgtgggtggcagcctgaccccacccccagccatctgagaacctcgagacccaaccaagaggaacccagggtcaagaggaggaaggggtggatgccacgtgatgctggccctgcacagaggctcgcctggctgagggcccaggccttgttcctcggatgcagtggttcctcccttccctagaccccaccagctgctatcaccccctacatggtatctccaggggtgtaactggggagccttgtggagtttcacctctgttcccactgcaggcttagctgggtgcggctcgcaggtgaagaccccatgcactgtgctccaccccacccctgcctccctgcagcctcgctcagcaccactgtcctgcgtttcacatgtttcctgcccttgtgtttatgctttcgctgtagatgtgtgtattccttaaatgatacacagtgctgttttgatgttactaactttccagaacccttatcaaactctgcttgaccttctgcaacttgccgtcttcactcagccttgttttgagatttatccctgttggtccctgacatgcgtgtttaattcattgactgctggacttaacatcaaggtagtccagacggatctctgcttggttctaatgcagctgcggggagcaattcactttggccatcacagtccaggtgcggccacggtgctcgctcatggtccctatgtgtccctaggagtgtgtcagagggaggttctcctcaccaccatgctgtgcccgtggttcccgattgtttgggcgggcactcttggctcatttctgccaggccaggagccaggaaatgggacctctgtgctcttagtgcatgtttccccatggcagagagatagcatcttaccatgtgtttatcggtcagtgaggtctcttccaccgacctgttcacgtctttggcctgttttcccctacagggttgtttgtgcttcgcgtattggttcgtaagcgttctttatgtgtcctggtgccaggttccatgggtagcatgctccccgcttctctcctcctgttcatcatttctccatgtgtggacttgggcctgtggcatcccggtgcctgc

SEQ ID NO: 96168 - DNA, 1052 bp, Homo sapiens
actccacagcagtatttataggtgaggtgacattttgtttgcaagaaggttttcatctcttaagactgttcttgccttctcagaaactcagttggctctgtgaagatttgctgtctgttttgggtttgggtggggtatgttatgctgaaaaaaatagtcctagacctaggggatgaggttgctccagccaaatgacagtgagctggtggtagccagaggtgtgggctgcagtgccctgagggagtggaaaagcctcccacacacagggttttgcaggatgagcggggtgtggagtggaagcagcactcagaaagcacagttgggtttcagacacatcatgcgagaccccgccactcacagcaagggggggcagtggagatgggacggcatgagtggagaggggcccctgcaagcaggccagttgctttctgactgtgggacttgtggcctaatctctttgttcctttcctgaaagtgcccctttcctgatagggcattgtcccaagtccccagcttgcaagggatgttgttttggaaaaacatggcaggtacacgcccacacaggagtgttcaagtgctgatcccagaccacccaacccagggtggaggctgttagaggacatttaggatccacaggtgggcagagggaggatgtccagccaccagagaccacacacatcctaccccagccgtggtgaagatggggctgttttccttgaccatggagcaaaaaccatccaggacagctctccccctccatgccaccagttgctcctgagccagctctgtgggtgctgggagctgcgctaaggatttgcacctgtccccaccagcttgtggccttctgctgccgcggtgcctctgccctgaactccctctagggctcaggacctttggggcctcacacctaccccactgttggtccttgattccttgactcacacagcgtgtggtctggggctggggctggggcccagctcactgcggggggatgcctgtgggggtgacacgccgcaagttccacggggccacctcgggaggtcttgggtcct

SEQ ID NO: 96169 - DNA, 1677 bp, Homo sapiens
ttggcggtcacagagctgcctgtctagggcccctgaaggattgcttccggcccagcacttagtctgctctgcacagatgcacgttcctgctgcagggcccccctaaccctggtccagcttctctgtgctaggctcagctgtgcctgggaccacagccatgcccccacccacccttccaccagtcagagcagtaggctcccagagttggtcactgaccaataccaacagacgcctccctacctgtggggggtgcaaggatgggggtcaccccctttgccagagggacttagctcggcagcctaagaggattgcgtggaagcttcgggccgccaagaagccggagcttttgaaacaagcctgctcagcagaggccacctcagccctagattgcaaccaggatgctcttcctgcagccccgcacgcctgtgggtccccagggtgaagagccttggcctcctttctctggagtttgtccatgagagtgggaggaccaggtggggccgatggggccccaggtgctacaccaggaaggcccggctccccctgcccagggagcatgtgtggagcaagaatggaaaacgcagatgcctctggcggaggtgggctgccagcctggaaattgctagctcagcagcatgcgccagggttgggaggggcttccagggccgtcaggaggccccctctgccacccactctggaagtgggttgtgctaccgggcaggtgacagcaccccaccctccgagtccctcttctccgcctccactcccttcagttctgttgcaggcactaggtagattgcttttttaatgagcttcatcaggaggccaaggtaatcttgcctttgtgctcgcagggccaagctgcactgaggtccacctgctgagcgctgccccgccacctgagtcttctggcccaggctggagctgggctaagctgctctgctgtggcggttgggatgcacttcccccatctgcccagggacccagcaactctctatcaggggcagtgcccatccctgctggggtgcctcatgttaagtgggcttggtgtcaggagactcaggtgtcaccctggccctcctgcgatgtcttcactctggctctgcactgccatctccgtgttctctggggactgagaccctcttttccttctatctctgcctgcctccctgcccaaggctggctcctggaacctctccaccaagcccctcccattccctgctgcggtttgggagggtctcagtgggcctgtggtgcgcgtaagagaggtggggctcttcccggctgccagcctccccattgcacagtatcagcctgggctgctctgagctgggcatccatggagatggacaggtttttgatgtcttcctggaatatggtttggaacttctagtggctgttagtgcttggctgccttggtagaaaggaacaagagtgagcagagcattggcgggtccctgtttagtcctgtgttcaccatgggggctgcctcatctgccgacatcagccagggtgcttgtaagactccactggaaggacgtttgctggctggccttaaagaggtgtggccatccccaggcagcagccaaatggccagccattccagggaccactcggttagaatgtctcagcaccccacactccgctgtcactcagagggtccagatggtgctccag

SEQ ID NO: 96170 - DNA, 1069 bp, Homo sapiens
cctccccaagtcccagccgcccacgtccccgcagcccgcgcgggaggaaaggccttgaccttgcacgctggggcgctgaagttagacgctagcctactgggctgcacttccagggaccagggcggcgggggccgcccaccaccaggaccgagagggaaagcgaggctttcctttcctgctcgaccccctcacccctgcggctggctttgggacagtgccccgcagccccgcattgaagagatgttgggctgtctgcagaggcctgcggagcggctttatggcttcctccttgtttgaaaagaatatcagacgaggtgcattttcccccatccatgtttattatactccaatgaaagagttataaaacattgagccaattcttaagaatcgtgagtgcccaccaaatattctgtctttcgtgggttggttggagagtccagcggcccgggcccaacctggctgcggagggctcgctccacgttggctcgtgtgtgggccgggtggtgcgggctcctcactcgccgccgcccagcctggcaagcacgcgcggcattcgtggggcggggggtcccgccaggtgcccactcacactgcttgggctctggcagtactcggaggctgcagcccgtcggaagcgcaggagtggggctgggacctgccaggatctcacagctgcagggccggccgcggtgggccctagtgtgttggttcaggccagcgagggctctgggagcgagtctggctgccaggcgtgggctcccagtgtccacgtcaagccctgccggggacggggtggggggggaggcggggtggtgccctgccttccgttctgttagggaccggaagcgatcatggggtgtcaattatgcctcagtaaagctgttaaacgtagacaacatcacaccagaaagccctcctggaagcaaacccagagagctggaaaaaccaacaccccaaacccagctgagcgggcggcatgcattttccaaagggaccgcaagaatatccgctgtggacaggcgggtgcagaaccctcaacacagcccagcgcaccctggagtccatggtg

SEQ ID NO: 96171 - DNA, 1043 bp, Homo sapiens
cacagaacagagcagcggtgatcaagcaggggatgagggaggctgtcttcccctcatcccctgcttgatcctcacagcggacccccaggcttccgtggcacctggcatggccactgatccctcccctccttgcccaaggcattcccctttggaccctctgggggatcctccctgagccccctcaggctctgggctggcctctgccatggtggcctccatccacttggaaaggggcctcagccttgctaaggatgtggcatcctcagagggcctgggtcttacctgcctctgtcctgtcctccctgcctgcccgtggccccctgagctgtcatctgtgacagcttgtcaccttggctaaggagagtctgaaagcccaagggtgagcaagggcattaggggcacggaccgggcattaggggcatgcttccagttggaaggctggccccaacctgccacctcggtccccagggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtaagtcctcagcctgggccagcccggtatacgtcaacccagccagaccagggccaggcccttagctgggggtggctggtctttaagagggacccacacgcccagagtgggccccggcaaagggtgctgtggagactcctgggacacgtctgtgtggtgaggtctgaaaccggctggatcctgcctgccctgcagccaccaggcactgggtgggggatcgcaggtgtgcccacagagcgggccggcacggtccaagctgcggccccgtgaccccgctgtttctccctggcaactcgtgttggccgcttcaggaggtgagcctggtctctgccttgcattcatcctggctgggttgggcgttggtttctgtcgatcctcctgttgtttacctcctgcagacactgctagggg

SEQ ID NO: 96172 - DNA, 1232 bp, Homo sapiens
ccaaagtgctgggattacaggtgtgagccatggtgcccggcctttgatcctagttttctcatggcttattcaaaggctcccttggcagagcttgctcttcccctccgttcattgcatagtgcacaggtaatatggaggggatttgcccctgtctcagttttgtgaggtggtgtttgtattggaatcttggttctgccacttactagctgggtgggggtaagtgaattatcccatttctgcctctccttcatcatctgtactgacctgcagtcatagtacatctgtacccatcgggttgttgtgaggttggtttttctattcttgtatgacaaacttagcagcttaaaccggcatccatttattatctcatagttatgtatgcagaagtccaggcattacaagattaaaatcaaggtgttggtagctttgctcttatctggagactctagggaagaagctgcttccaggtttatttaggttgctggcagaatccagttccttggagttgtagaactaaggtctttgtttccttgctggctgtcagctggggactactctgtaacttaaggtccactaacttaggactctaattggatgtgcaaaatgccgtcatagcagtacctagatgagtatttgattgaacaaacaggggtcgggaatcttgggctgctatctttagaattctgcctaccactgaggattaaatgaggagatatatagagagcatttagagcgagtcctggtatataacaaatgctgtacaagcattaccgaggattcagtactacaaacttggctctgaagctggccactatgggctgcaggagaacagtatttctttttttcttttttttttttttgagatggagtcttgctcagccttctaggctggagtgcagtggtgtgactcagctcactgcaaccacctctcctgggttcaagtgattctcgggtctcagcctcctgagtagctgggattataggcacccaccatcatgcccggctaatttttgtattttggtagagacgggttttcaccatgttagccaggctggtcttgaactcctgacctcaggtgatcctcctgcctcagcctcccaaagtactaggattacaggtgggagccaccatgcccggctgagaacagcatttctataaaagatgggaattgctggccaggcgtgttggctcacacctgtaatcccagcactttgggaggctgaggcggatag

SEQ ID NO: 96173 - DNA, 1041 bp, Homo sapiens
tgagcaaaacatatcttgaacactcatgcaaaagagtgtaagaatctagcagaggctttattggcctctgagactttggatgccaaagagattcaagttgttcttgaggggaagaaagaaactggaagtgagataactctcttcttgatagggatgtattactagtttcattgaagaatggaagcattagtctctctttggcaatgctttcccatccattcttgagttagtataattcaagggtgtgagatactttgtcagtctattgtcatgatgacacctattgcaaattagcaaccttgcagcatgcatatttaaaaaaagaacaatcaggatttagaacagcttatttgagaaatgtcagtcataaagttgaaagaaatgattttatggttggtgactctactagatgcgaataaaaattgtgcccttagctcttgggaagcatttttaatttgcaagctaaaattgttgaaggatatccattatctcttgatattaccatttatcttttataataaaatattatttggttgttggtaaatcataattttatgtacatcaatggaaacttaagatgcagtaattgtgcttcaaattaactgcatataaaatgtttaaatctaagagtagagagttgtaattcagttacaatcagaatttaaatggttataacattttaaaatggacaataaaaaaggcagaccataagaagtaccgtaaaagatgtggagaaactataaccctcatacactgcttgttagaataaaaaattctacagtcactttgaaaaccacatccatttagttataagcatatttcttaattttaatgtgtcatgttttaataaaatatgtcggaataaagactttggattgaaaaaataatactgagtagtggacatgatttggagagttggtacctttgaaacaaatattttatttctatgcaaatacctttctgtccccactctgttacacatgaatccttattttagtcaggaatataatctttccttccctttcacaatagaaacttaat

SEQ ID NO: 96174 - DNA, 1087 bp, Homo sapiens
caaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctggtaaggccggagggagggagtcggggtgggagccgtctgagggcagacggggtctctgacagccacctttccccgccagtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtgagtctgggggccttcaggctggggctgcgggccaggccaggcatttgccactctgtttccctctctttccttgtgccccaggtctctgacatcctccgatacctatttcccgtgcccaaagatgacagccaccgggtcatcaccttcgcaaaccaggacgactacatatcattccggtgggtccacgggcca

SEQ ID NO: 96175 - DNA, 1142 bp, Homo sapiens
cccacagacacggccctcatctgtgcaggaccctggccggcatttgctgacaataacatggccagttggtcttttctaaataaagcaccgcatacagaggaagtatgctgaagctgggctagcatcaggtgtagaaactgcaggctgaggaggcagcagcctgacccggcctgtcagtcatggaagtcccagagtgctgccagcgttgctgttagagcacttgtctgcccgagtttatttcctccaggggcacatcgggggcctgctctgggccatgcagatgcccaggctctgccctggagtagtgggggaaaagttggtatgagcattttaaagatggggaagagggctttcccctctattcctagtggtttcccctcctttctgaagcagaattgcaggacagctcccgagggcagcaggtcagcctccacaaagagctgggggttgtggggtttggtggtagcgctgagaaggggtagggtggctttctctttggcctctttctctttggctttctctttccaccgcgctgagctgctgaccctttcccatggagcgatcaggaggagtctttgattcagaacactgaaacctggcacgcctgaggagagttagaggagacaggaacaaaagctctcccagaggacttagagctctcaggcatcggacgggagggggacacagccacatgcttcctcttgcactgaagagggttgcctttttcctgtttgctaaatgccagacttgtggatggaccaacaggacaacttgcccagcttgaaggtttttaacagaatgaagcaatgggaaaatgttttcaaatttatgcccccccttccacttttgttttaacttagaggagggagtaaggaggtgggcgtggcaatatcagaaagggaaactagcagtgtaataataatattaatagtaccaagtgtatactgcaagccaagtgctgttctatctaaatgctttatatacaatgatttccttaaattctcacaataaagcaacaagaagagacacagtcctacagaggaggaaattgagacatagaaattaaatgacttgcccaaggtcatactgagaaagtcatggtgccagaattctaactcaaacattttggttccagtcttctg

SEQ ID NO: 96176 - DNA, 1028 bp, Homo sapiens
cacggtctggccaggacatatactgtagctggtacacagaacgggactcctgaaacacagaaaaagatgagcaaaagacttaggaaaaaaaagaaaaaagcattaattggccatctactatacaccaggcccacttctaggcatcttccatttatgtctaccagacaataactgaggaagtgggtactagtatgatgcccatttttacaggagaggaaacctctcccctttcaggagcccctttacctcctcctcccctgtcacagtaccttctggaatgtgaccttgagggtcctgagcatgatgtcctcattcagccacttctcctttatctgagtaaggggggtggggcaagtaagaagagggaggagaacaaagatcataggtaccagaagacatttatagaaagcaaagcattcctgattaaaaaatcaaatacagaaaacattttaaaaattcatatagcccaaactttccccaaagctttcattaaggaaacatttgacacaggagcaaaagaggaactattataaaaacacaagcccttttgcaatgaaaagagatgtcttttgttctaaaatgaaacttttattgcatttattaagtactaactgtatgtatgacttgagagagttccccaagctcttttgaaatggtaagagaagtaagaatttcaacaacctaaccaggcacatttacatgacagagattaactgattgtagccaaaataaaaatgcaaaggctatccctatagtaagttctaactatttgcaggctaacaccagagggtttcctgcagtatgagtggactgtgggttaaatcattcaaccttttaggcccaacccaaagcctttccaccctgggaatcttccttgaaaactcccacagctcaccagagtgatgcagaaaagcccagtctgcagtggctcctgctcctgggcccagtaccgctcacaccttttctgcaaaaggtaagggagaaaaggcagggagtgagaagagggagtcagcttcagagctagctca

SEQ ID NO: 96177 - DNA, 1399 bp, Homo sapiens
cctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgctagcccgttttctgtgggtgtgcgtgcattttcctgtggccagcagcctctaaaggtggggtgggggctcacctgtcgcagatcac

SEQ ID NO: 96178 - DNA, 1097 bp, Homo sapiens
attaaatgtggtttctggcttggagaaggaatagtgcaagagtgactgtccatgctgctgaatcctgtgggctccacgccagctcgccaggccctggctctgctcctggcgccccttggcaggacagggcgccatctccacacacccgctgcctgggctgtgggtcagtcctgtgtgctgagccacagaattcggtctctctcttatggcttctcacgctcacgagcgtaaggcaatcttctgtgtcactaagaatcaattctttttctccattgtttgttgttagaaaaacaagatgccaaaatccaaacaaaaccaggaacgaggtggttctggagctaccgcacagcagcaggcagactgaccacactcccgactgggagtatgcagccgactgcaccgtcttgtccttttccgctacacacacacacacaagtgaagagggtgtccagcagccagcggtgtcttgaggggctgggaggcgaagggcgggctccgggcgcaacacaagggtgtggaattcctggcttctgccctcccaagtggcaagctgcctggcaccactggccgggctggggacttggagaactagagggcagaggggcacatggcctggcattgcaggccacagaaggccagagagtcctgcccagaggaaatgaaaggaggattaggtttccagagaagagggtcccacgcaggtagcgccttctccccagctgggcctgggctgagctgcggtttccccgctccagcagtgaggccctacacaggtccagagggcggatggggcccaagctgcagcggcggtgtggcgagtgcggggtctgcccccttgctggtctcttcagggcaccaggagcagggaaaaagacaacaggagtacagacctggcacgtcttggtggcacaagcaactccccagcccatccctgctcacttgcaggcagaggaaggccaggccgagtgggcctcggggaagaaaaactgggggccactggcaggaaggcccagcaggtgctgtcaggcagggaccagttcacttgcggaagggtgccagccggctgatgctgtgccagaaggtagatggcttgcgcc

SEQ ID NO: 96179 - DNA, 4837 bp, Homo sapiens
ttgaatacctactgttgacactgtccatcttgagccttgcctggaatgtgctctaaccccccacctgcctgctacaggaaatagggctccagttgcaattgggggtctctaggaaggaagtgagaaccaggtccagcagttttgcccattgctgccctttccgaccctgctgggcctcatcctacttgagattttggaatagcggtgccggaagagctctgtgtgactgagtgtctgtcttcctttctgcaggtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgcatattgtgg

SEQ ID NO: 96180 - DNA, 1737 bp, Homo sapiens
gttcccccaccagcggggctgtgccaccgtactcctcctccccgaacccctaccagactgccgtgtaccctgtgcgaagtgcctacccccagcagagcccgtatgcacaggtatgcttgggtacacactgctgtgtgggaaggggtgataccacctgggcgttcatcctttggccctgggaccctgtgtcagttgtctctcttctccccacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaagtcctcgttcctgcggtgtctgtcctatggtgtaccctagagctgggggaggggagagctcacgaatcctctgacccttggctctaggttttcatagctgtagttgtgtggaaggacagaaaattctttggggaagaaacagcaggttatcttttattttgcctacctgagtgaccccttgtggaggcctctctgaatctgatggactcgctttgttggtgaactgagccatttggcaatgcaggatgtgccccctctcctcccaccccctatgaccatgtaagacttgagtagaaggaggacactttgtgtaccggggttgctctggccttcttcctttcccttgaggggagcttgtctttgcaggtcagttgtcttcatcgggatgttttcatgcatctaggagagctggtcttgcgttgatagaagaaacagctgcctgtagaaatcctttggcattcatctaccgtactttactttgcaaggcctcctctaaggaaaataaaccatggaaagatgaggcccctggctgggatgggcacatctccgcggaagccctgggggtttgatctgatgtctagggattgggtgaccacccaatctgtatgaccacccatgtggattcacctcctggtctctgggtcaatatgaccacctttaggtcatgcccacacaaaagcgtactgttccctccttgtttttctggacttgacttcagtgtaaggaaattatgccagagagaaaagcattccgggttattatgtgtgcttcaatgtagactctgatttggttttccccatacttatctgtcaaggaacaggaaactgggcatagacagaaactgctggtttgaggcacagggagggagggcagcaggcaccaggttgggtgccactgtgttggaggtggtgctggtccataaagggactcaagtagttgttgagtttctgcagttgtaggaaaaatagatttctcttaaagaactcagaagctcatgtagtttagaatcctcatttcttttttttttttttaattttaaaatttttaatatttttttttaagacagggtctcatcctgtcagccaagatggagtgcagtggtgtgatctcagcttactgcaacctctgcctcctaggttcaagtgattttcccacctcatccttcccagtagctgggactacaggcgcctgccaccatgcctgcctaatatttttttgtaccttttggtagagatgggatttcaccatgttggccaggctggtctcgaactcctgacctcaggtgatccacctgcctcggcctcccagagtgctgggcttacaggcgtgagtcactgttgcc

SEQ ID NO: 96181 - DNA, 1683 bp, Homo sapiens
gtgtaaaattttttaaaaattaactttaattattattactatttttctgagacagcgtcttactttgtcgcccaggcagaatgcagaggcataattacagctcactgcagcgttgacctccggctcaggtgatccaaaattctttatactcagctcattttttcaaacttgaggtataatttatgcacaaaacacccacatattaagtgctcaactgggtgggttttgacagttgtacatgcccatggaaccaccactccaaataaaacatggaatactttgatcatcccagaacgctttcttcgccctctcccctctgatttccgtcaccgtaggtaaatttctttgttgttagggaataaacgggatcattgctctatgtgctgttctgtttccagcttctttggaaagctcagcatgttgtgagattcatccatgttttttccttttgattgctgagtaatgtttatagagacatatcatgatttatcctttctccagttgatgaagatttggattagttcccatttttggctactaggaataagattgaacactttttacaagtctttcgtggacctgtgttttcatttttctaggggaagttttgggagtggattgctggatgttgcgggatgtgtctctggcttgcaaagttgcactgtctgacacggacagtgtgtgagtgctccacccctcctgctctcacccatgggaatgtgagatgccataagcacttgtatggaggtctgatttacatattataagttaatccttctcagtgtacagtttggtatgtttggacagtcatacacagctgtatgaccgtcaccacatttgagtgaatgcactctttggaaaggttctcgcatgcccctctggcccctggcaccattgctggggttttgatgactctggattaggttggtctttcctagagcttctgtcagtacatgcatccagcatgtgtccttgtatctggctcctttgacatggtgtggctttgtgattcattcatgtgcttgtatggatcagcagtttgtccctttggcttgctcagtaggatttgtatggatgcaccacagtgtgtttacccatttgtctcctggtgggcatctgggccattgccagcttttgatcattgtgaatatagctgctgtgaacatagctgtccagagaccctctccctcccctgagaccaaacccctcttctctgttggggtcaggaagggacacctaactgcttattcagcaaactcaaccactctactagatggggtctctttatctgcttctggagacgggttggtggccagcagtttgcagggctttggggaacggctctcttggtgccagctgctcctcgctgctggctgagtgccttcttctcgagtctgctcaatcatcctccacttcagcttgccaggcttcaacatgctgtcttctcttccattcttggtgagttttatgtcttttttctcttaatctgctttattgtcattttcatgtcattttgtgtggggacaaaagcaagtatgtgtgttcagctttctcccttaacccagagggctttttaccatagagtgcttagccagtcctggtgctgggcaagtttctcctgtttttgctgtaacaaacaacactatgatgagcatgcttacagttaagtctctgtgtgtgtat

SEQ ID NO: 96182 - DNA, 1038 bp, Homo sapiens
gtcacacctaaaaattttttttatcactactgagattgtaatcagtgttcatatttccagttatctgtcatgaatgtttttaattgtatgaagaaagggaaccctgtgggtttgtttgtttaaactgttggaagtttggaatgagattcccaactttgaagtctagcatctgttctcaggatgtgacacacagagggtagctctatgttttgacatttttataaaaaaaatatcatcttggtcagataagagtttggtgactcctgggaggatctcttttcaggctagtggaaatatgaggcagaaaactgggattaagccgtacagtggggatcccattcggcagtgtctcctttaggtacagctgaaggtacccgctggtgtctggctgctgcatggtggtgggaaatgaaagaggtggtgtggctggggagaagggagctatccaagatgacccttgacgtccctcatccccacagtttctttcatttgagacatccttgccccacctgcccctctctgagctgactcctcattgcttgccaagactgcataaaatgctgctatgttggtggtttgttttcctgtgatttcttttccccctgaagccaagcaccttatggagagggctggatctgtcctgatcatctccgctgtgacagggcatggccccatgttgatggtgaatagcctctctgtgttggtacaatgccccagtcaccattcactagtcacatgtgtgcccgccacacaccatgcttcctttttgcatttcttccctgagttagctagtcacttagggggaattggactgtcccgggtctcctgggagtatcagtacatggccggacacactaccttttcctttataattctttgatggcattcacactacctttttctttataattaaagaaaatgttatacaacctcgttgtggcgtaattggcatacaactaagtgtacagatttaaagcttcagtttgatgagttttaacctgtgtacacctgtgaagctttccttttcactttcctttt

SEQ ID NO: 96183 - DNA, 1341 bp, Homo sapiens
agacatgctgttggccacacatagtgctcttggggctgcttaagtctgtggagttctggggaagaaggtaagagcgatggctttgcaggagctctagtgattgtcgctacttcagttgatgacatgagattgttctttatttttcttcagctggttttcccatgggctatgcagcagcagctcctgcctattctcctaacatgtatcctggagcgaatcctaccttccaaacaggtatgtgctgggtggtaaaatgctttgtacgtacagctgggagagaaaggtgaaggggtggattttgagaggggtgggtatagaattaggacttggttgagtcgatttctcaagttcattaagttagcctgttgataagtgcaacaaaagcttaattcttactgcactgaagctttatatactgtgtttctcatgtcctcccacaaggcaaatctgtaatcactaggttgttaactctgccagagcatctgttcatgaaatagtatcacctactagaaattgaagaatttcttgccatgccaacaggtggaatttccatgttaatgtttttagagataatttttggttagactactttagcactctgataatattttttaaaaaagtattattttccatgtaatgtatagatgaatatttttagattttggaaatcactgttaatattaaaagtggaattggtttgggtctgaatcttgaggagattggttatttagtgggatttcctgctaggagcctgcactctctggtgttggttccttttggacttttttcacccacacggggctttgcctttctgccgcagcagtggtggtgcacactctgatctgaggctgtggtttggccttaatcctgggactgctggggcaactttatccctcaacagtagcttcacacagttaactttgacagaggaggagacaacagcagtgtcctttccccagattcttcctgttttgttaatcataaaattctgcctttatattctgtccttacatccatctcttcgtttccatttccacttccactatgaccctatatgaccacccttgttcagaccgtagttcacaccctgagaaaaacgttcttgacttggtcttcctgctcccaagctttctttccccgggttagtgttcttcccatttaaaccagagcgatgctcccagatgaatttttctcagtggtttcccatgactgtgagacacagttatgcctagagtctcgactttcagtccctagctgtttgccatattggcccattttttccctttagagtggttttccttttgtgttttgccttgaaagaaccatccatctcgtagtgta

SEQ ID NO: 96184 - DNA, 1068 bp, Homo sapiens
gtgcgtcagagagaaagggggctgaacttgtcctttttatcaggaacccactttcataataaagccgtcacctattaaatgtcccacctctcagtgctgttaaaatgacaaattttaacgtgagctttggagaggacatatgaaaacatattagctggtcatgctggagaagttggggatcagaacatcaaaatatggcaaggcgtggtaactcatgccggtaatacccgcactttgggaggccgaggcaggtggatcacctgaggtcaggagttcgagaccagcctggccagcatggcaaaaccccatctctactaaaaatacaaaaattagctgggcgtggtggtgcacgcctgtagtcccagctactagggagactgaggcaggagaaatgcttgaacccaggaggcggaggttgcagtgagccgagatctcaccactgcactccagcgtaggcaacagagcaagactctgtcttagaaaaaaaaaagaacatcagaatgtgaaaaaacctgaaatgaatttagaagtttaaaacagtttcttacaacaaaaaataatagcttttaagtcaaaatatgtaatgtaggaaatgtcggaattcagtgaaaatgagtgacctttacataggcttagctgttcactggtagcagcaaaaataggcccttgagtccaagctagacttgaattctgattcttccagactttgtgcagtgaagtcagatgagggtaacaggacctagcgtgtgatacccttagcactcttactactcttgctaagtaattatgtgattagagtttggaatgaaacttccagaaatgttataattgaggcttggcgcggtggcttatgcctgtaatcccagcacttcgggaggctgaggtgggtggatcatgaggtcaggagttcgagaccagcctggtcaccatggtgaaaccttgtctctactaaaaatacaaaaattagctgggcgtggtggtagatgcctgtaatcccagctactcggaaggctgaggcaggagaatcgcttgaaacggaggttgcagtgagccgaggtcgcgccactg

SEQ ID NO: 96185 - DNA, 1723 bp, Homo sapiens
tctctactaaaaatacaaaaattagctgggtgtggtggcgcacgcctgtagtccctgctatgcgggaggctgaggcaggagaatcacttaaacctgggaggcaaagttgcagtgagctgagatcatgccactgcactccagcctagcgacagagcgagactccgtctgggaaaataaataaataaataaataaataaataaataaataaataaatacaggaaattgcaaaaggaccactaaatccactcccatctagagtcaatcactgttcatatttttatatatttcttttcagactttttttctgtttgtgccagggatgcacatttttatacacataggtgtttatatgggatcatactgtgtaatgcaggatgcagtataatactctactttgttttcacttaacattgtattattctgtttttaaacatttcttgaaaagcagctgcgtgatatttcatgttctggatatgtcttggttaacttaactatcctctgttagaagaacattttggttacttgtagggttttccccatgttttttttgcgacaaagtctcgctctgttgtccaggttggagtgcaatggcatgagcttggctcactgctaatctccacctcctggattcaagtgattcttgtgcctcagcctcccaagtagctgggattacaggtgtgcgtcaccacacttggctaatttttgtttgtttttgttttgttttgttttgtttttttgagacggagtctcgctctgtcgccaggctggagtgcagtggtgcaatattggctcactgcaacctccgactacctggttcaagcgattctcctgccttagcgttctgagtagctgggattacaggcacgcgccaccacacccagctaatttttgtatttttagtagagacggagtttgaccatgttggccaggatggtcttggtctcctgacctcatgattcctccacctcagcctcccgaagtgctaagattacaggcacgagccaccatgcctggccaatttttgtatttttagtagagatggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccaggtaagtaagtaaaattttgttttcatttttgaactttgaatacttggtatattttcatgtcactaagaatgctttctattgacaaacgcagctcaaagtggcttagacaagaaagaaaatacctggaagtgaaaaatcaaatgataggactggatttggtcaaaacttgatctagtggctccagcagttgggaccaggatctagtttct

SEQ ID NO: 96186 - DNA, 1974 bp, Homo sapiens
ccaccgctggctaatttttgtatttttagtagagacggggtttcaccatgttggccaggctggtctggaattcctgacctcgtgatctgcccaccttggcctcccaaagtgctgggattacaggcgtgagccaccatgcccagccaggtctttcttttttctttcttttttttttttttgagatggagtctcgctctgttgcccagactggagtgcagtggcgccatctcggctcattgcaagctccgccttccgggttcacaccattctcctgcctcagcctccccaagtagttgtgagtggctaattttctttttgtatttttttttagtagagacaggtttcaccgtgttagccaggatggtctcgatctcctgaccttgtgatccacccgccttggcctcccaaagtgctgggattacaggcgtgagccactgcgcctggccaggtctttcattttaaagatagagttttcttctgattatgatttgattttcaagttaggaatttttgctgtcatctttttaaaggtaatctgacatttgtctattctaatgcaggtgtcaaaccacccataagaattctgacagttgagtcatttcaaatgggaaactaaaaatgtggtaagctcggcccggtgcagtggctcacgcctgtaatcccagcactttgggaggccaagactggcggatcacctgaggtcggaagttcgagaccaacctgaccaacgtggagaaaccccgtctctactaaaaatacaaaattagctgggtgtggtggcacatgcctgtaatcccagctactcaggaggctgagacaggagaatcgcttgaacctgggagtcagaagttgcggtgagctgagatcgcgccattgcactccagcctgggcaacaaaagtgaaaactctgtctcaaaaaaaaaaaaaaaaagtggtacgctctagatccagccttgggtttgggtttcttagtccacagcaaattagactggaaagttggtggttgcagggagattttagtagcactaacatttcaggtagattggtgatggtgtgttttttctttagttttgcattatgcagaattgaaaatgcggcagtacagtgcataaccttatatgcaacatcttgatgtaaagattattagcatttacataatttctacttgatgtagagattatttgctctttttgtagaaatattttaaagtatagatgtatcattttcgactttatatactttattgtatctttacaaatttatgtaactatacataatcacagtactgttaccaggattaaacataattgtttcataccagctgatacccagtattcagtcgtgtcccagatatctttaaactctgtttacagttgtttcagtctaaatcgagtccaaacaaaattcagctattgcttttatgtctatatctattttaatttagaattatctggccttcctcctctcccgcccccttttccccccaccattgccttattgaagaaactgggtcatttgtcctctggaatgtcccacttttggggtttgtctgattgtttcatggtgtcattcagcatattccctcctactcctgcgtttcttgtaaactggaagttagatgtaaaggctccatttgatttttttttccccccagacagagtcttgctctgttgccccatctggagtgcagtggtgcgatttcagctcactgcagcctctacctcccaggttgaagcggttctcatgccttagcctcccgagtagctgggattacaggtgtgtgccaccacgcccagctaatttttgtatttttagcagagactgggtttcaccatgttgcccaggctggtctcgaacgcgtggtctcaagtgatccgccctcatcggcctcccaaagtgctgggattacagggatgagccactgcaaccagccaagtagagttttattattattggtctaggctataagtcagg

SEQ ID NO: 96187 - DNA, 1269 bp, Homo sapiens
gtcgcggcgcgctcaggcggaagtgaggtcggcggctccggtggctgcgcagcgtcggcggggagcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcggtgagtgggggcgggcagcgggcgactgcgcgtccaggccggaagtgcggcgctttgtgcggccggctcggggcggcgccaaggtcggcccgcggctcggggtcgctgggcgtctggaccggcctgggctgcgctttgtgccgcgggcaaggccgggcgggggccgggggcggagctcggccggacacgtacgcgtgcaggtgcggtccgggcggcgcgggcctgccgcctaggtggccgaggtggcttcgcggcgcggggcgttctcctaaaggtcggggtcacagccgtcaggaatgcgagcgtgaaacccgggggcagagctttgtgacaatagtcatttccaatgtgtaactgctcactttgtctacccacgaagtaaagataatttttatttttatttttttgcttggcggaatctgagcgttctccttccagcttgaaaaggcacgatttaaattacagatttttaagatttccttcagaaaggacgtttcgtggcctagcctgggttaactttgaaaaaagagtgcagtgcgcctttacgacgtccacaaataagggtatttctgttttatagtgtatgtgaacatgaagtgtgcatctcatgggctgtttgagttaatgtttaatcattaaagtcaaacaagaatattttgcagtgttttcgcatgcaaggaagctttataaataaaaaggtttatatagtttccactccttaaactttcaggtcatccttgtgtaatttgagatcacttttctcaaatactatggatgaaagattctagattaaataaaactttttggttttggcaaaaacaggacacatttttaagctcttgtagatgaaggagtgggttatttttgctttgacagccaagatttgagcagtgtaaggctattctaattttgaagctagtgttgcagaaattgtgaagatcttgcttctctttgtctttacaaagcaggcttactttggtggagttccgtagttt

SEQ ID NO: 96188 - DNA, 1345 bp, Homo sapiens
agttatatgtgcagatttaaggcttaatttaaaaattggtttgcgtgcatactaagaagctcatttgctttaagtgagcatttcctttttgggcttttgttgggcactgtgtgtctcccatgttccccatttgtctgccacccaataagcatggtgtcgagggctgaagtagaaatcagaggctagaatctgaaagcttcattagggttctgctttttgcagattagggactttggcccttagtgagctgaggatcttggtttcctcccagtgtgcggtttcagggatgtcggccacatgatgtgcctgttgtggaggagggctgggtcgccagtgtgacaggagacagcagatcccttttgtgaaaggagaactggtactttgcgtgatgttaaacttcacaaaccgctgctcagaaatctgctattttccttctcttttaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgc

SEQ ID NO: 96189 - DNA, 1049 bp, Homo sapiens
gggcttctccgtccaggtccctggagctcccggtccctggagctctgcacttgggggcacaacttgcatgaggcagcgcgactctggcgactggctggccatgccgtcccgggctgagaactatgaagtgttgtacaccattggcacaggctcctgtggccgctgccagaagatccagaggaagagtgacggcaagatactagtttggaaagaacttcattatggctccatgacagaagctgagaaacagatgcttgtttctgaagtgaatttgctttgtgaactgaaaaatccaaacatcgttcattactatgatcgtattattgaccggaccaacacaacactgtacattgtaatggaatattgtgaagaaggagacctggctagtgtaattacaaagggaaccaaggaaaggcaatacttagatgaagagtttgttcttcgagtgacgactcagttgactctggccctgaagtaatgccacagacgaagtgatggtgatcatactgtagtgcgtcgggatctgaaaccagccagtgttttcctggatggcaagcaaaacgtcaagcttggagatttggggctagccagaatattaaaccacgacacgagttttgcaaaaacatttgttggcacaccttattacatgtctcctgaacaaacgaatcacatgtcctacaatgagaaaccagatatctggtcattgggccgtttgctgtatgagttaggtgcattaatgcctccatttacagcttttagccagaaagaacttgctgggaaaatcagagaaggcaaattcaggcaaattctataccgtgactctgacgaattgaatgaaattattatgaggatgttaaaggattaccatcgaccttctgttgaagaaattctcgagaaccctttaatagcagatttggttgcagaagaacgaagaagaaatcttgagagaagagggcgacaattaggagagccagaaaaattgcaggattccagccctgtattgagtgagctgaaactaaaggaaattcagttagaggagcgagagcgag

SEQ ID NO: 96190 - DNA, 1110 bp, Homo sapiens
tagcccatggaacagggataatctccccaaaggatgtgggccttcagggccagtgttattttgtgcatctgctgcttgctgaaaggcctccacatcacccagtcataccttaaatccagtcgggcaccaatccacaaactggatggtgcgcttggtcttgatggtggcgatggccgcgttgacgtctttggggaccacgtcccccctgtacaacatgcagcaggccatgtacttgccgtggcgagggtcacacttgaccatttgattggctggctcgaagcaggcattggtgatctcggccacagacagctgctcgtggtaggccttctcagctgagatgactggggcataggtggccagggggaagtggatgcgggggtacggcactaggttggtctggaattccgtcaagtccacattcagggccccatcaaatcgcagggaggctgtgatggaggacacgatctgcccaatcaggcgattgaggttggtgtacgtgggacgttcaatgtccaggttgcgccgacatatgtcatagatggcttcattgtcgaccatgaaggcacagtcagaatgttccagggtcgtgtgggtggtcaggatggagttgtagggctccaccacggctgtggagacctggggggctgggtaaatggcaaactctagcttggacttcttgccgtaatccactgagagccgctccatgagcagagatgcgaacccagagccagtgccgcccccaaagctgtggaagatgaggaagccctgcagtcctgtgcacagatccgcctgagagaaaccacacaacgtgagccaatgcccatggaagccacaccaccaacctccaacaagccagggccgcttctctttgcctctaaagagttgatatggattcaaatcatccataataaacatgcagtacactttgaagcaaagaaaagcaaagatctacggacaaatcaccactgcagactcagtaggactcaagatgctggtctaagtttttgcttgtttgtttgagacggaatcttgctctgtttcccaggctagagtgcagtagtgcaatctcagctcattgcaacctccgccttccgggttcaagcaattctc

SEQ ID NO: 96191 - DNA, 1085 bp, Homo sapiens
ctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtatgactgggtgatgtggaggcctttcagcaagcagcagatgcacaaaataacactggccctgaaggcccacatcctttggggagattatccctgttccatgggctaggcatgtgggcataaattagtgaaccagagttgataattgattcagtgatttctttttttttttttgagacagtcttgctctgtcaaccaggctggagtgcagtggtgcgatctcagctaactgcaacctctgcctcccgggttcaaacaattctctggcctcaccctcccaagtagctgggattacaggtacccgctaccacgcccggctaatttttgtatttttagtagagatggggtttcgccatgttggccaggttggtcttgaactcctgacctcaggtgatctgcctgcctcagcctcccaaagtgctgggattacagtcgtgagccactgcacctagctcagtgatgtcttttgaactctctgtc

SEQ ID NO: 96192 - DNA, 1482 bp, Homo sapiens
gagggaagggggtggcgcttgcattgtccagaggcgtttggagcgcagagggggtgcttggctcctcagggctgcgggaaccgggcgatgtggatggatttggtatagggcccggccctcctgggaccgactgccaggcctggccccgggcggccgccgctatctgcacctggctctggcggcccagttagggaagatgagtacttctgggtctgtgacgttgggaaggggcaaactcagttgtgtgtggggttcgggtggatggcaacatcgcacttgtaaacatacccagaccaaagtgttagaggtatctcattctaaggagatgcgagtgggaagctgggtcgttgaactgacccccacccccagtttattgtcaggacctgatcaacttggtttttactccaagagactccccagcgttaatctctgtgtcatgcacatcctaagccttacggctgcatcagaactcccttgtctgtaccgagaaaatcactgaacagtttttcatgaagggcaaagcatctgagatttgtggtgaatgaattttcaccctcctccccccgtcctcactgctttcctataaattatttttgttgctattgttcagggctgagatgggcatcctcagatttatctggcagtaaagattagagcaaagctctcctgtctttttttttttaaagatggagttttgctcttgttgcccaggctggagtgcaatggtgcgatctcggctcactgcagcctcagctttccgggttcaagagattctcctgcctcaacctctcaagtagctgggattacaggcgcccgtcaccacacccggctaatttttaatttttagtagagacgaggtttcaccatattggccaggctggtcgcgaactcctgacctccggtgatccagctgcctcggcctcccaaagtgctgggattacaggcgtgacccaccgtgcccggcctagcgcaaagctctcctttctagagagctttttagttttttccagtttagtttttttctcttgccctcctccatcaccctgcttttaaatgctcatttaaatgcccatgttgtcagccttacctggagaggccctgaaaagcaaggtgatggaggaggggcaagagggtgactgtttcaccctttgtaggggctgggagaagaggagaaggaagttgctctgtctggcatttgcctctgctggggtggctccaactggatatagggtttgggctttttctttcatctcctcctttgtttcagcctgccttcttcactctgggacactcgtgactggagtcattaggagaaaggaatctgcagtcctggtttggagctttgcagggtttgcacctgcacaagcagccaccagttggttttaaggtgaactgcaatggcaggaggggtggagggctctgcccagatctgccggtggcaaccgtatgctccaactgctgctgcagagcagctcatgggct

SEQ ID NO: 96193 - DNA, 1047 bp, Homo sapiens
ccaggaaccattctagttgtcactctgacatttgacacaacttttccctaatgttccatgtgtctcaggatctaagtcactacagagacatccctggattaattttggcaggggatgggcagtgactagtgtaccctgcagagatgtgtagaaaactgcagagcagtcatctgtaagatctgggttggaaagtttatgtcctctccttcccagggtcatacagacaggtgactgctctgctctttctcaagaggctttaagcgcagtagggactcactgtcttccttcctccttgtgtgtcatgggctcctggccctaggaggcatggaggaggagtggttgggggtggcattctgtgttgatgctgttataacaggcctcaggaaagtgtgtgctgttagctttgtctctgggggtttcgtatggtgagtttcaaagtttggggaaggctcctggtgtcaggtgaacaggttgatgggtagttttgattactgtaattcagatgatacttgagaaaagggaggaaataattttatacggggggattgctatctgggtgacaattgggtgatagggtgagaaataaataagcatttgggacttgtcagtgcaggttttaccaggctgcctttaaagttaataattgctttgaagtatggaatcactcttagtagccagaagatggctacactttcaaatttctctttgaaattaagtaatgatctctccaacccttaaagtctctaatctaagccatatccctatactgttttacatcctatgtcaacatccacatttgtgactgatgctggctgctgatgagcatttttccagcatctgccatgtgctgtgcactgggctggtgctgggtataaagatgtcctcctaaattatctcacttttaatttagcagaccttctcttactgtgtgttaatacaaactaatagctcttggaaagctgccaaggtgggtcccaggagccttagcactgtaaccacgttctcagctagaggagtttggactcgagctgtgtgtttgcccatttg

SEQ ID NO: 96194 - DNA, 1056 bp, Homo sapiens
gaggccaggagtttgagaccagcatggccaacatggcaaaatcctgtctcttaccaaaaataaaaaattagctgagcgtggtggcgggtgcctgtaatcccagctactagggtggctgaggcaggagaatcacttgaatcccagaggcaaaggttgcagtgagctgagattgcaccactgcactccagcctgggcaacagggtgagactctgtctcaaaatacatgaataaataaaataaataaataaatataaaaaatattttggtaacagtatttcaatatcattgatttcctctgcagtcctgtgtattttattttatgcattaaaaaagtctttctgagaaggagtccataggctgcccctagtttgccaaggggtacagtagaattgtggtgtgttctagaccctgcacacccactgctcccctttccctcctcttcatcaagagttgacctcctcctgacttgggctttctccaaggctgtcaggtgcgtttgtagagtgggtgtgggcttatctccaactttttatcttagacctggtcaaagaattgagctctattcttggctcactggtttatcatatccagggaggcaagtttgtcagaacgttcctctagcaaggccatatctgtcactacaaggtatgtgattcatttaaagccaaatgtcctaattatctgaatcctaaacagaagtctgatttcagcttcagtttcagtttttcaagtggagaaaacccacagacattctgcaggaaaatgccctaaatacacattaaccccctgttttcctcttggtatgctttaaggttatatcatcgacaacagcactctaagaaataggtctctgcccaagaaatatgttgtgcacatggttgccaggggtgttttcctgttggcgtatggctttggacagaggggcatcccctaggaattggggcttggcttggaggtagtcagcgccataggaatgcacttcctcttggcttcccgcttgccactcagtgagtccagcccagagggtgctctgccgctgctgtacctggatttctg

SEQ ID NO: 96195 - DNA, 1025 bp, Homo sapiens
ttttttgttttttttttttttttttaagacagagtctcgctctgttgccaggctgaagtgcaatggcgtgatcttggctcactgcaacctctgcctcctgggttcaagcgattctcctgcctcagcctcccgagcagctgggactacaggtgcctgccagcatgcccagctaatttttatatttttactagaaacaggttttcaccatgttggccaggatggtctccatctcctgacctcctgatccacccacctcggcctcccaaagtgctgggattacaagcatgagacactgtgcctggcctcttttccttttctttagaataactttatttagtctcatggcaattaagttgtcttctggaattttatggtgaccttttactaaatataccacaaatactgcttttctgaatttgagtctttggagaatgtggttttaaaacttttctgtgacattctttgggaatccactgagttgctggttataaggtatctttctggctttcagatatgcccttctgaataaatgcaccccaactttggatggacatggggtgctggcttgtggatgggcaggctgtctttctgctttatgcatctgaagttcttggccactgaagacttgcaatctggtgatgggcaggcttgtggtaagatttttttgtggtcttccctgctatctcagttattagtgaacagtcacctgattttcccatgtttgatttttgtagcaagtgtggtttctgtagttcatttctttgatttgctgtttttctcttgctactgcagacttctcactttcatgaatttcacagtacatgtttgtccctgcaattaaagattgaatgttcccgggagtattttcattttatctgaagagtttgtagtcccagctcccttccccaccacccaaccccacaacaacaaaaattgtgtagactagcattactccaaaggacttgatgaggatttgattggagcccaagtggctggagcaccctaactagttacaaagctcaaag

SEQ ID NO: 96196 - DNA, 1030 bp, Homo sapiens
gttgaagacggcccttgtcatctttcagatgtggtttgacagatcttttgtatcacttcagaaacatttgagaagttttgttctccacgataaagagagagcaagccagacagatatgtagaggccatagaattttaaaattgtctgcactttcttttacagatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcaggtaaaaatagcaattctctgccctgatatggagtcacaccctgctttggaccaagaagagaataaaggagagcagtggttcttactggaacctgcataatataaattctataaacttggcatggccattgtaaagataagtctaaatttattttttaatagcagatgttaaaatgctttttatagttttatcatgatgcataatatttggtggtttgtgtgacacatttgctcttaatgagctcctggaattcacttgtaaagagaagattcatggcatagattaaatgaaatacagaggttatttgagaagcttgtgccttttagagttcttcctcctccgtactcccatcagacaattttgaaagtctgttacgtataataggttctctcctccctgttgttaaaaaagagccaccattgccgaaaatgcctcctatgtatatatggagaaatagaaattctggaaatggcttttaggagataacccctgcctagtcgtaggcagattctgtagccactcatgtacaccaccatgcggttcccactgggaggcattttgtttggctccttctggaaactggaatattggatgagacaaggaaaattgactaaaaacaacacccagattatacgctgcatgttgttgcctgcagctcacattagaacccccccatccccgcaactcccccaccatcacactg

SEQ ID NO: 96197 - DNA, 1049 bp, Homo sapiens
gtgtgtgcgcgcgcgcgtgcgcgtgcatgcatgcagaggcatccctttcatagacactgtcttggccaaagtggatatagatatgctggacagccttcttcatttcccccagaaggtgggggggggtcctttatatcttgtcagtcaactacatatttttaaaaaacgatttgccatgtctatagagtaccagaaagaaggacaaggacttaagtgaacagttctcatttatgagcagcccttccttgcttttctgccctctctctgatccataaccatgctgatgtcttcagacccctctgtcaacccaagaatggctcctgagctgtgagagttcagttttatggggttccaatcctcgccaagtaaagtttttctctctcccttcctgaatggagacatgcggtaattgctcagaaatgttctccctggtgtgtctttacagctgactctggtgtcttattgctcactgatgtttctgattgcttattgttgtgtcttattgcttgctaatatatcttctggttggctataaactgtctctaaattgggtaccatagcaattgaagaaggattccctaaatttattttctttagggggatagctctgtgtgtgtgtgtgtgtgtgtgtctgtgtgtctccttattttttctctctagctgtgttctgtgtagcttttatccagtatggcttatcttcacaaatttatcaccgagggttttttaatgtgaaagtaaatttgcccctagggaaatttaggtggaaatgagctttattaaaatcaagaaatcagattgaactggatttttgagctctgtttgtcttgttgaagagaaaggggactcaaaggaatgaaaaagcagatttttaaaatccccacccttccaccaatcacacagtaaattaatttctccatattcactttctgaaagggcttgaagggccttcgtcaaaattctctccttttagaatgatgctttgaattttagaaagacccattctgtctttctctagttttgtgatcttaagtgaggaagtggagcgaata

SEQ ID NO: 96198 - DNA, 1081 bp, Homo sapiens
ccagaaactgcctgaccctttactgtaccttcccactccaaaatggggaggggaactcctgtgcgggagtgctcagctctcaagggaagacagtcattaacctgtctaaactctatgttaatagaaccttctcgataattgctttcattaagtgtggttaatgtgaacagtacaagttatagcaagatttgcagaagaacaaagtaaatatttaagactttatttcaggatgcagttgggtcgaggcaaggagaagattagtagaagctgtatctgatggtatctgaggttgaaacacagtgaacctcttggcagaagtgccagtcatttctcatcagtggttcacagaatcctaactctggggaggcagatgggtgtctcctggagatggttgtgtgttcaggttttctcctttcgcttctggcctctgtcagacatgaatgacatggtgatgaagataaactgccttccctgtactgcccaggaatgcaatgaggattaagaaggtggcttttagcctgtgtctatgccacatggggaggatggttgctccctgagggcagaaggccattattagcaactgagttggccaggagtgtgtgccatgccgggctgggtgtacggagctgtcaagccaggcacctggggattaatttagcatgggttttcatgcccccgggctaccagtgaccatacagccatcatctctacctttgagttgatgtgtataactgaataatagtgctgtgttttcaaaaggaaaggcttaaaaaacagtgcttctgtagtacaaggagggatgctctgctgaaaatctggaaattacagctaagcaaaaagatgaaaatacaaagtagctgttattctaccacccagagatcgatttgtttctttactaacagatacggcaagtgcctgttctgtgccaggcactgtctaggcactggagatagtgatgagcaaaaccatctcttctttctggagatgacactccagcagtgaaggcagataggaaacaaatacataaacacatctggtgaaaaatgcttgaggaacagcaaagtagggtaagaaattagcg

SEQ ID NO: 96199 - DNA, 1008 bp, Homo sapiens
ttaggcagccttgtatttccagaacatcaggcagttcattttctgtatctgttttcgtgagccatgtaactactcccattacagagacagggccctataaagtaattactctgaatgtcattgtttcaggtatattaacttaaccatctgcagagccttttactgctatcagcttttacaaaatttagaatgaatttcttcatctctgttgatattatgttgatagatgatactgatgtatttgacactggcacttttttttctttttaaacagttgttacagaacctaggaagcatcatacctttccagagttcctaatttgtttatgcttttcttgtatgcacttctgttgccattgcaagtagagttgctctgaaataatcaaattgcccagtgattgattgctagatcttaggatgtgtgcaagctattgcttcaaatgccaatttggactagatgcatgagagtgtgtctatgactctttcacaaaggagcaaaagaagcagtttcatgccttacttgtcaatctagttcttatatttcataaacaacagacgtaaaggtctttgcttctttctgttctcccttggcagtatgtaaaactaatattggctgagcatgtaattaaccttgagtttaaattcagcatacttaatcccttgattaatgctaagattaatgcccaacaggaaaggttgaaagcttaaatgtttgtgaatgcgagcatgaaatgaaatcctaataaccagtacaatgatttggatttatgagctgtgttggctgctaaagataacttggaaatggtgttgcacagactaatttgtcaaagtgggcagtgataaagaatagactgcttaggttacaggacaaaacctgaatgtaaaaacaactaacgttttggggtgggtcagggagtactttaaaaatatcaccggattgttgcccgagaataccaacacacacccttcaaatgttcagccatttgaaatgggaaattccttttcctc

SEQ ID NO: 96200 - DNA, 1049 bp, Homo sapiens
aagggggataaagaaggaaaagagatgagtgttcagaatgagctatggtgattactgaaaaggtggactcagcatgtttgagatgttctatgaaataaatactggttattatgtttctctattattccaatcactcgttgtatccagctatattatccagagcattaggaaaaatattcttcctggcttttaatttattctgtttggaattttaaattgttctcactcatggcagaaaagtagtattcttggctctttaaattccttagaaaacaatgaatttttgtttggactgggacaaaaccagaagatgagcatttatttccctatttaactctgtggacagaaagaggctttctggcaacttccacgttgtcaaacagcctgctaagaattgacttcagttttcttagaagtctgctgtcctgtggtagatccaagtggaacagtaaatttgagtgctgagaatttcaaggtacatcaaccatactcattataaaaactgcattttaacatagctcagggctttgtaatgcctgtgctgcttttctcaatttctaattttttaatgatgtccctttgggcagatcagcagtcagcagccttggcttcagtttgcaatcctgggaccttaaagtcaaagctgcagcagacaagacttacttttgaagctctcaatttaattgactaacccttttaagttttcagatgtcacatcatgaaaactattatgctttctgactttttatcttctattcattttattaaatttctgttgctaggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtgagtttcttattaattcagtgcagttagatgccagctttcttttaaaatttgattttgcttggaaacaagactaagagaaatgtcatatctcaaatgatattc

SEQ ID NO: 96201 - DNA, 1069 bp, Homo sapiens
tatctagtattcattaggcactttcttttcaatatctcattgtgaagaacccctgagagactggtatccaatgttctttgtatccagtccttgttttctggaagatgagcaaagagattgagagaggttaggtaacttgtttaaggtctcacagctgctacatagtggtgatggagtcagacccatatcttccttgatttcaaagactgtgtttatatgccaccatttgcttttgcaagagtcagaatcagggtactgggttggccttaatggatggaaataatttatataggtagcagatttgaaagggccatgctgtcatctctaaaaaggatttttggggtggcatttgcccattaaagttgccaagtttattaccttttaagtaaatgatttttctcttttttctcccctctcttttgccgtttctctagaatcatgaagaaggttgtaggaaaccgatctggctgcccaactgtaggagacagaattgttgagctcatttacattgatattgtaggacttgctcaattcaagaaaactcttggaccatcctgggttcattaccagtaagtgctacatggtgttctgacttaaggttttttttcccctccttaacaaaggttgcatggttgtgggtagaaaaagcttatcaaatagtatcttttcagctgtatggagtgttgctcattcgtaattgaaattcagattctcagtgactttgtactttctatggctattcgttattttcattggtttcttagaaaacaagtgtcaacctcctttctaccttgactaatgttaatacttagccttcctctcagtatgcgtatgccagtgtcatctatttaatcaaataacaattttgataaaatatgtacagtgtcatttcttgtgttccgtgggttttagatcatgattcgcttttcttaccctttacctcatcagtattcttgtcattcctggaagggaaatctgggaatacgttatctgaatgctggggtcttgcactttttaagataagcccattaagattagtatgtctgtggtacatgtgtactctgtgcag

SEQ ID NO: 96202 - DNA, 1025 bp, Homo sapiens
ctactgaatgagattctaagcttaatgtaaagtcaaatactccaattgatgaaaatgttgaatgattgctcctagagataacacgtgtcatatgctttaagcagaataagacctctatagatggtagctctgtttctttggcatcagttgattagacacctactgtgtgctcagctctggctaggtgctgggggtacagcattgaacatggcagtccccagttcaagctttcatagaactttttattttgctggtagttgaatgatcttctgtaattagttacccgatctgaagcaaatcgtatctgctgtgtgatgtctcagactctaaagtgacacaagtagatgttcggtacacaagctattgtaaaacatcacaattcttgtctggtcctgcttctatttaaaaggatttacctatttttagtagtcttgaaggaagggttagagcttttaccttttcaactttgggggcaagtatgtagtgttcaacacattgcttttttctttcaggtgcatgctccgagtccttgattcatttggtactgaacccgaatttaatcatgcaaattatgcccaatcgaaaggccacaagaccccttggggaaaatggaatctgaaccctcagcagttttataccatgttccgtgagtattcctgtttcatgtatgctttccagaatgccaccaaagatagatgggaaaattagccgccatctattttgggttatgattctcaggaccattagctgtagaagtgtgtgctgttgaaccttttccttgggaattactgaatttgtttttttgtttttgttttttagttgaaatcgaaaggccacatgaatattttttgaaaagccttgaaaatgttctggagaaaaaatgttcaatacaaagtatctttagaaactatttgggaaaggactttgcagttactttagattggcaggcactaaacacattttatgccacatggatgctatttagggtacactttgtcactaatgagaggtgaagtctttcatgc

SEQ ID NO: 96203 - DNA, 1007 bp, Homo sapiens
tgttttggttgtagtcatgctcttgggtccctcttatgaccgactgtctgcgtcttcccctctcctttagcctttacttggttcttttcccaacccacccgccaaaactggcaaccagcttcctcagaacttgttatctggctcgtaattgcccagactccaacgctcaaatgacctttttgctctaaagccagtggccatctggcagtaatctccctgtatacaggattctgagttcccaagagagcatctggttggctccccttgccttcctgagtctgctacatcattcctgggctgctggccagcctaggagtgggtcccctcaggtcagacacaccctgggcaggtcagcagccagcagtgggcacagggtaacagagccccctgcctacttaacaggagctgtgggtgggggcaggagttaccagatacatctagcacaagaaccatatcctagaacccttcaaactaacatatgccaggtaggtgtaagcttctgtactaatttaaaactatacatttctaagttaatgaattcagcatcttgcggccataccagacatggcatggaattaaactttcagtcccactgttcattttattcatacattagggtggcaagggtggtcttgctcattgcaagcaaagtcatcctggttcatgaaatgaagaatgtggactgtgcagttttcccagtcatgaagacttttgatacatcacttgaaatgttcctcctgaagttgagggtcctttgtaatatcaccagggcagtgaatggcagagaccagatcatgaatcgcttcatttagagcctgcctccgggcttccctgcactctgtggctgctaataccacacccctgtgtcccttgtggtcttaagtcacaaaaccagctattattagatttgcctggagtgtctgaaaacaggcttagaatgaggaaaccttgtcccacttttatacaactggaaaacattacagaatttgactttttgaaaatttccc

SEQ ID NO: 96204 - DNA, 1047 bp, Homo sapiens
ggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgta

SEQ ID NO: 96205 - DNA, 1107 bp, Homo sapiens
gagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggaggacagaccccgagaactgtgctggtgaaaaggaggacagaccccgagaactgtgctggtgaaaaggacagaccccgagaactgtactggtgaaaaggaggacagaccccgagaactgtgctggtgaaaaggacagaccccgagaactgtgctgatgaaaaggacagaccccgagaactgtactggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggacagaccccgagaactgtgctggtgaaaaggaggacagaccccgagaactgtgctggtgaaaaggacagaccccgagaactgtg

SEQ ID NO: 96206 - DNA, 1909 bp, Homo sapiens
gtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtgtatccttttctgttcgccgccgctcacgccctgtttcccttgcccggtcgccgggcctggtgccccgcgaacatggcgccgccggcctcggccttcgctgggcctcggcgccgcggtcagggaagtaatgttccggctcgggcagtcgcgaggggtcagcagaggaagggaggaggagataggaccccaggaatgcgggccaggagcctgcgttgtgtaatctgtttggggcagcgcgtggtggtggcggcgggggttgggagtgtggctcaggcgaaagaggaattttagggattattgcagaaaaggggcggctccctggacttgtccctgaccccgaagggtttgagaggtaggagggttagcgatgctgaaaggcctaagtgtttgccgcagcctttcccggctctcgtcgccggcttgatggcggctctcttctaccttgggagcgtactggagttctttatgttcttggcgtggttttgtatgggtgtgtgcgcgcgcgtttcaactgtttcattttgagtttagttagtcgtagccattgataaatagttccagggccctcagcgctgttagagtgaaaagatcagcagttcttattcccatttatttggcgtcaagcctattctcttcctgccgccccaccccccgcgggcatttatttctttatttccagtttggggtttggatttgaatgggaggtattggaaaagaacctgggaattttccatcaaaattgttctgggaatgagatcttgcttttgtcagatatttcctaaatattacgttccagctctcagcttacaataaacactgcgattgtttatatgcacaggttttatatgcaccattctttcaccaaattcaacaaaaatgtaagtactagttgtctgtttttactgtccgcaaatttgagggtaaatcgatacgcagaaaaaaagttggtcattgcgttgttggatttagtgttctgaattaacggtaaacgtatatcacgtgataaatattttgcttcagatgcggtgtttttgtgtttttaaaatttatgatgaattaaactgcaaggcactgttaagctctgccaggccttttaagctaaaaaagaaaaacatttatttctttacagagttattacataggttttcttcatttaaattctatacttaacatttgaataatttcagtagtgatgtacagtggaattgggcaagcctggtcgttctgtgatacatcttaattatgttggactcattgtttaaaagactgtcaattgagattaaattaattatgacattcttttgaaagagctatttagtagaaataattcatttcttcatttgctaacctagtaatttcttaagatgtcaacgtttctgtttatcacgttagcatcagttgtctcctaaaattttgggtgattcaaacgtccactcttgcttcagatatagtacgtcaggagtatgtttatgtattattagtaaaatttacacctgaatattaaggtatataacctgtaaaccttgacaaatagagtaatggcattttgttgaaatgttaatttcatttatgaaagatacgagtttggtgtatgttgagtaacacgcatactgtgttgtgtgtgttaaagaaaattgcatattgtttagaaatgtttaactctgctttaattctgtctttatttgttactttttatcatagttatttttagaatattattctgaaaggtatgtgtagaaaaatggaccaaagaag

SEQ ID NO: 96207 - DNA, 1378 bp, Homo sapiens
caaatcaaaatagttctgactattctttatatggctacagatgtcccatttgccgaatcaggcatacttttgtacttccaataaatgatctagccacaagtcttcacttcttttatttattaattttttttttatttttttgagacagagtctcactctgtcacccaagctggagtacagtggcgctgtcacagctcaccacaacctctgcctccctggttcaagctattcacctgcctcagcctcctgagtagctgggactacaggtgtgtgccaccactcccggctaatttttgtatttttagtagagagggggtttcaccatgttggccaggccggtcttgagctcctgacctcaggtgatccgtccgcctcggcctcccaaagtgctgggattacaggcacgaaccaccgtgcccggccatcttcacttctttgttttgagccctccttataatttgtctttatggcgtggttggcgtgctttacaacaaataccctgcttaaagccagaattcacaactttagattgtcatttgcattctagctttcactattttacttaaatgttttccttcaataaaaaggccaaggtattaattttttattaccttctttaatgtcttattgtgtatgaaggtaaacttcagcatttttacgtagagtcagtaataattgaaatctgttcatttctgttttgagaaatattattatacccttcatatctgttgtctttttttacctttgctattataatatcaaaagtggtttttatatttgtgtcagtgcacttgcatcaattgcaccgcctcacttttatctttcttcccccctgttcttttagggcaaagggggtggtctgaaattgaatgtgagtcgcttttaaatttgtattattccacaccagtgggaaatttttttctatatactgaaatgtcatggtaaactttaaaaagcgtgaatcttcaccagagtaaactgaacaccgttcagcaaattaaaccctatgaaataacaagcttaaataagttaagatgctagtgacaaactatatctagtcttatagtaaatattaataacatccattaactgtgtgaaaatatttttaaatgttcaggtgacttaattgtattttcccacattgacatattaaaagttttaaaacccccaaaagtaatgtgctgctgtattaatatttaagaataaaatcagtatcagcatgttttggtgacccagaaatggtctcttatcattgagttcttttgtcagttactcagagttgaatagctgtcagcagtaaatgacttttatatgtagcctaattagataaatctacactttgttcactagatgcaatgaggttcatgtaattggaatt

SEQ ID NO: 96208 - DNA, 1035 bp, Homo sapiens
tgcatcttgttgcactgtgctgtgtatgttgacatagtagcctgttttttcctcattcgtatgtgttaggaattccctaggaatggcttgtcatgtgatttggttgtagctatccatggggttttggttttgctatcttgttgctctgtttttctgtggggatttaagtatcccctctgcagccatcaactcagaattcttcaggtaaatcactaaaagtttaccttcattcagaagatgatacactcatttccagtgggacttcatctttccagaagtatttataagtacatttaaatgacagcctattgtggtcccactggaaatgagtgtaagatgaagttgattttttaaaaagaataaatcacttgaagtttctgttaaataaggaagctgtgggagagttcatttattaataggcattacaaagaatatatgatatttttgattgattttctcaaattaattctgaaagctactctagaacttccccagaaagctttaaatgttattttgaaacatgctgctcttatctgcctaattacagggatactgacttcagtgactctgtattattatagaagtcttatgaagtattcctgaagcggcttaaaatttttttttgcaaaattaaatgattgtgaaataactcataccttttctctgcacacacagatacatgtatattttagccttggtaatttatatgcttctctgtggtcctggctcatcctttttgttgagtcatcgcatggcaggagtgcaagagagtgaacccagtcctgcaagatccaaggcgctttcaaaccataacaaattctaaacttaggtgtatagagtagaataggttaatatattaacaaatgtgcattgagtgtttgcattggccaaggcatgcaaatgtctcagtataaaatcagacagattttatatagtttataaactgattttcaaggccattgcagaacaggagttttgtttttagtattaatagctaaaattggttaaggtaattttttaagtgaaaatccaatt

SEQ ID NO: 96209 - DNA, 1319 bp, Homo sapiens
acacttgttaaattgttttttaaatttaaaatcaacattaacatgcacaattttaaaaatttttcaacataataataatatttgagtcatattactagggagcactattctaagtcctgtgtatattggttcatttaatcctcacacaactttacaagcaggtactattaatatttctcccattttacagatgcagaaactgagccacaaagagaataagtaaattgtctaggctagtcagatcacagagccaagattccacttgaggcagcatggctatggctggctctgtcatctctacctccccgtctccatgatttgtatgatatatttctatagagaaattccacaaatatctatttgtctcattttgagaatgttacatttccttgaaatagttatatatctgctagagtaacaaactcatgacactattcagagttcaaacaattctaaacactattcgcatcaacttccttttacttttttccctttaatttgagaacgtttattaaactaggtccaaaatacaaaaataaatagtgcatggtccctgtcctcagtgaactgaatctcagtttgtaattgtttgattacttgaaccaaaccagctgtactcctccaatactagtgtgaattatttggcttgaaccaagcttgcatgtgccagtgaatgtttgttggcttcaaaagtatgctcacctttaaaagctttggaccaactagtaatatttctgttacccaaaacatttggaattcttttaagcctcacaacaaaatcaccttccatacaaaaagcagtagtacctagtttgatcaccttccttaatcatccttgaaattaaagcctcacatggatactcacaaaatatttatctaaaaaggtgttttgttttgtttttacagccttgatggaggaaaatatttgcaggttatagagaaggaaatgtgaatggaattagtggatttcaccaggaactttggaagagtgttgggaattagtgtttagctggaaagtatttcttgatcagtgtctttcaggcaagtaagagaaattctggatcatctgacaggaaggaagtttaagtactaaattcggtctaatttgacttttgacctgagcctctattgcttcactctgacaaatagttttagcatttgaaggcttgattaaccattcccctgttagacatgaataatgacaataaatgagagattgtgggaaactgagagtgtcttcattttcttgaatgtcttatgtgggcatcagctctcagatttttatagtggcatttggaatactttgaatttaatattag

SEQ ID NO: 96210 - DNA, 1876 bp, Homo sapiens
gtaattgttgacgccccctgcaagacatagtgaggctcaaatgttcatctcttgaaaaatgggtactcaaatcttgacatttagaaattgtcttcccatgggaaatttcttgaatgtaatcttaaaacattatttgagtttattttatgcctattttctaagtccacagttacttgatttattattaacttttggggtacatattcaaacttcatgtttctctgtcttagtatctttgtagtgcttgtgttcttatatttctgtcccaaggacctaatttactaagctaaaaaaaaaaaattgctaatttatggatctctgattggcaaagtttctactatattggtttatattacatgcttataccctggtggtgtagctgctttcattattgctatagttaagtaatagagataattaagtaacagttttatgttcagaatcctccttactttgccctctaggtggtttttctgttccttcaacaagatagtgaaggtatcttcactatcttgtgtggtagttatagccacacaatgaatcattgcttgattttttaaaagagtattagaaaatggtgactctgtgcctagaaaaggagtatagtgggtatacttgatccgcttttcatctttttttttttttttcaggtatagcatcatctttttgcttattttcttctttgcctccacaatgtgcaaattaatattatttaaactttctctttagcatttttagtatgttcagtcaacttacttagtatgtcttttcccttttcccctttgttctatgtgcaaaacgagtaaaacagatttatagattagttctatttaatgaataactttattaaaactattacatcaatcttgtcatagcccaactcacagttcatactattaatattgcattccttccttgcacacccgcccccccttaaaaaatagaaggtttgggctgggtacaggggcttatgcctgtaatcccagcactttgggaggccgaggcagatggatcacctgagctcaagagttcgagaccagcctggccaacatggtgaaaccctgtctttactaaaaatacaaaaattagccagtgtggtggtgcatgcctgtaatcccaccttctcagggaggctgaggcaggagaatcgcttgaacctgggaggtggagctttcagtgagccgagatcacaccactgcactccagcctgggcaacaggagcgaaactccacctcaaaaaaaaaacagaaaagaaaagaaaatagagggttttttgaaatgtatttgttcttaaatgaccagagttttatcttttctgcagataatatcgtctactgcattatttttggctgcaaaagtggaagaacaggctcgaaaacttgaacatgttatcaaagtagcacatgcttgtcttcatcctctagagccactgctggatactaaatgtgatgtatgtaaatactgggttttttatttttctttgtaaatttgaaactttttcataatgtaggcctaacaaaaatacacagttcaattagtggtgccttccaaatgctgcttgttttattacctcttaggaatgcaatgccaggaagcagtctggcagaaaaacatataatgtatgttcatgaatttggatgtcattctgaattatagaaggctttgattccaggtgctttgttgattcaaagatacttttgtttcatattttgttgttcagagttatgatatatgtagagggtaagtcctatcacctccgctggaagctgtatttgagaccagaatataaataactccttaaattgtcaacagatgaaggaacagaaaatcttctgaatttacccctagatgagtagtctttttaaagtattgttcc

SEQ ID NO: 96211 - DNA, 1472 bp, Homo sapiens
caaaattagccaggcatggtggcacatgcctgtgatcccagctacttgggaggctgaggcaggagaatcgcttgaacccaggaggcagaggttgcggtgagctgagatcgtgccattgcactctagcctaggcaacaagagtgaaacaccgtctcaaaaaaaaaatttttttttctagcatcctgagttacttaatcaggaacctttacccattgaatgactaacagattatattaattcaaagtcccgattaatttaagcttcaatggaactatatctgattttattaatggcaagttttatcataatgttggctttaagggagtaaactgttaatgtagccattaaataataggttgtcattatttaaagataattcctacagtttatattaactgtacaaattcagaactatttcttggggtactgtttaaataatagaaattgactgttttaaaaatcagctcaatgacctttcaaagtagagcataaataaaataaaaggtacttttactctctggctttagaaatatgtccttacaaaaatgaatataggtatattcatatcagtaatatagtatttccttatcactttggtcaattgtcatgatttcagaataggacagcagtaatttttcatatcctttatttccagagtaactgtaatagagggataatttcttgaaattgaataaggaggttctctggtatttatgtccccgtgggtatgagatacattattttggtatgtttggtcatttctaaggtggcagggaagttaattctaaaatttactcagtgacttactgtgacttttgaggaattaccacatgaaatgtcctagagtgagtttgtaagccaggtttgggttaaaggcaggtttgagttggatgtttttaattgacttggtgcttcctgtctttaatatctcttgaagcaccagtgcctaggttgtttcactttacagactgtgcacatctccttatttcaattaacttaccctctttcatattggttaggtttttgttttctggtgtttgtttcctgttacagaaagtaattcagtttaggcttgccacagaatacaggctttctctgtcaccctcagtttattttctccatattttcaaactactgtggttcttttgtaatcaacctgtaattctcacaagatgtaacagtcatgcagtctagtaatgttatttttattttaatcaatttgataatatttttatctgacaggcttaccttcaacagactcaagaactggttatacttgaaaccataatgctacaaactctaggtacgtacttacatcagataatggctttttgtgtgtatttcactaaagcattctaaataagtgaaaagatttctgaaataattgtattattgaagaaagttattttaaaacaggttttagacagaataaggttgcctggttataaggaaattacttttctagaatttaa

SEQ ID NO: 96212 - DNA, 1244 bp, Homo sapiens
cttttaaacatttcatctttggtattagaaacagtagtttaagcagtcatgagacctctatggtttgtcatatgattttgattattaatgaagtatggttataaggtaactggttgaaaccctttgatctagagtgccgtatcatttaaaagctcgtttctaccactgtggcccaacagttatgtttatgaaaactgcacttttcatgtcttctgaaagaaagctttggaatattaagaaagatattacgtagttgaattccgtccttaaattgtgggaccagcttaacagttgtatttgccaggaatttaatttgtttttaagataatcccgaatcatttataattcagaattttgaataaatttacccttggtcttttaactttattttcataattgagacattgtatttgaaaaattatatcttgtcattggaaaagtaatgagaatgtcagtgatgagaaacttataactttggatttttcttaataatgaagaatatattatacgtttatggcatttctcaggcaagtactgtagtggtaagagattggaaaaaaaagtgcttatcatttcaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggtaagaatctcatttcactaaaactccggagggcttccaagtattaggactctatccatcccccattgagctttgctagtcccatttcagtcaagtgtgggccaatagtgcataggttcagaaaataatattaattttgggtttgtgtcaaactttgactttttgaaaagtgataacagttgaagaattttgaggccaacctcagacctttcagataaaaattgcctttgttaaaagatttgtcagtacggtggctcccacctgtaatcccagcattttgggaggccaaggcaggctgatcgcttgagctcaggagttcgagaccagcctgggcaacatggtgaaaccccatctctacaaaaaacacaaaaattagctggttgtggtggtacacgcat

SEQ ID NO: 96213 - DNA, 2865 bp, Homo sapiens
ttagaccagattatttgttgttgttaatgttaaaatgtgactgattctttgagtacaaaccatatatatgtttaatgtcattttgtctgactaacatttcaggtaactagaatatatctcactccattttaaaagtactgtttcatgttttagtgtctttttgttttctttgctcttttacaacttttagctaacagcatttcccctctattctctgttgcacagtgactgtttctggatcactgaatttagatacatgcctaggtgaaaactgctaatggcattttttaattattattttttccttctctacgtatttttattcggagggggaggggaaaataaatttgatttctgtgaagtctttttctcccctctggagatgagaaagttggtattatgctactttgctgcagaattggctaatgtcattttacagggaccttcacttctgtgatttctccttccctccccaccaggaaagtcacactgcctccaagacatctgatgctttgacactcttccttagcacaactctgctaaaccccaatcccttttgtaaaacctttatgttgatgatccacatggggcagcagggattacaggtgccatgaataaaaaataggggagggggaaagaaatttgaggacggttagaggggtggagttgagataaactgatcctaggtgagcagaggggaaagatatgtcagtgcttgtggatgtaattgggaaaaagggaaactataacaagagcatccctgttgggaagactaagaggcagaataaggggagggaaaacttttcagtgtcttaagctaattaaaaattgcctttctgttgggtatcagtgttgaagcattctgatcctccctagaatacctgtatctttcctaagttagtctttaattagattctgtaatttgaactaaaatacagtggagcctcctgtatctgtacccgtatgctgtttctaggtttattctctgttgatgcttaatagcatgatgaaaaactgagcagtttgtgctctgtgttttgtggggtgggggtttgttttgttttgtttttgatggaagtatttaagccaacttaaatatgactgaggattaagtctggcaggcaactctttgtattttgtattagacttcaaaatcttttcttcttcttcttcttttttttttaaatccaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtagtaagtaaaatttactttttgtgtacaaatctttgaagtttttgttgtgttgagaactttttgattgtagcacgttaaggctgatagtattgtcttcgtttttttttttttcttacagcaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttggtaagtataaagctatttccagtttacaattatagttaaatgacaatttttaaaatttcacgttgatccagtcttaactttaaaatactcattaaagtttttttaataaataaaatttatgtaatttgaaattttttttcagataatacccactagtagcaagttaaaagtagtcaagtcctatccatgcctggatttgcataaacacaatttttcctttttttttttttttaaacaaaaaaaccttccttttcagtttatatagagtaaaaaatggtatgtgtttatggctgaacagataacatttccatcattgaaactgaactggaagaatagtcttaaggagcctttaatatataattctgttctagatttattaatgatttaaatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctcctttt

SEQ ID NO: 96214 - DNA, 2083 bp, Homo sapiens
caaaaaaaagaaagaaagaaatgcaaaatattgcatagttccctgtataccctttagcttctcctggtactaacatcttacataacaatatatgattatcaaaactaggaagttaacattggtacaatactgttaactaaaccacagatgttattcagtattccatatttttccctattctaggatcccatgttccatttagttgacatgtcccttcaagtcttctccagtctgtgacagttctccaatctttccttgtctttcataacactgacacttaggagaataatggtcattttatacagtgttccttagttggggtttgtctgatgatttctcattattatgtcgaagttatccattttgagcaagaataccatagaagtaaattgggtcttgcttggtgcatcatatcaaggggtacagtatgttgatacgtcttataactggtcatgacaaccgtgatcacttggttacagtggtatccttaaagtggtttctgcactttaaagtcactattttttttctctttgtaattaatacatttcatggggaagatacgttgggattatacaaataacgtttttcctcaaacttttgtccactaattttaaagaatcttttgatagatcttgtctgtgacaaaaattattgtggtgtttgcctaatgaagattttttttttattgggggggtgattatttttaatgctactagattttctagagattctaattaagcaagtaaaatcaagagggaaagtaatcgttacaaaaggattcagctttgaaaatgccggttgagagttgtgtgtacttctgtgtatgctgaggatttaataggagggtaaaagtgaagtagatgaactcctagcattcctttttaatactgcccacttaagagaaatttaaatcctaaaggcaccttctaagtttcaaatttaaattttatttttagagctaacacatgagtttctacaaatattggagaaaacgcctaataggttgaagaagattcgaaactggagggtaagagaattgacagggtttaacagaatttcagtcttttatgtaacatttacatagctaaccagtttgaatttttgtggttaaataatctttgcagtattcctgaataattcaacgtatctcaagttacatatactcacatattcaactactgagtccagtggactttgctaaagtacattatacttttaaaaaattttttgcagtgattatgacaaaagtatcctcttcattttacaaatggggaaactgaagcctagacaagttaaattactttctgaagtgctgggctaggatttaacttgtatctgattctaaaatgggtgttttcaattttttatagccttttatgcctctaaggcatttatttactgacaacataaaatcttgaaccccaggtcattttatttccatatgtttaatatataatgtttttaatatataacttttataagacaagaaatttgcattaaattattttgctatatcactgcttcttctgtgttttattttaataggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagata

SEQ ID NO: 96215 - DNA, 4626 bp, Homo sapiens
gacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctataaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtattttcagaaccaaagcaaagggtggtttgttcactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgagtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagacagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatac

SEQ ID NO: 96216 - DNA, 1066 bp, Homo sapiens
cctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaatccaaggctctaacatgtcttaagttaatgtgaatcagaagtaactttgaggtggggcgcagtggctcatgcctgtaatcccagcactttgggaggccaaggcaggcggataacctgaggtcaggagttcaacacaaccctggtcaacatggtgaaaccctgtctctactaaaaatacaaaaattagccgggtgtggtggtgcatgcctgtaatcccagctactcgggaggctgaggcaagagaatcgcttgaacccaggaggcagaggttgcagagagcccgagatcgcaccactgcactccagcctgggcgacagagcaagattccttaacaacaacaaaaacagaagtaactttcagtccctggaaaatgtgagatctctagtataattgaccctttatcca

SEQ ID NO: 96217 - DNA, 1056 bp, Homo sapiens
tttagtagagatgaggtttcaccatgttggccagaatggtctcaatctcttgaccttgtgatctgcctgcctcagtctcccaaagtgctgggattacaggcgtgagctactgcaccccgccagtaatttttaagagtgtaagggtgtctgagtccagaaagtttgagaattgctcttagacaaaaaggtataaacaagtgcctgttgtcagatacactttctttttctcaatgggtaaactcttcccagcttctgcctgcatttggtctctctccagagcattgaaaaatggtgtttttgtccagattttataggaaagtttatctgacaaagctgctttgccattaccagaacccaaagtgctgggaaatgattttaaaagggaaggaaatggcaattattgagcaccagctatggtattggtatcatgcactatagttgggactgtgtctgttaacttaatccttaaacagacttcaacagttagttataaccctattttatggaggagaaataaggctttgagttcatgtggtactgtaattttcccagtgtcattttgccagtagttttggtataagcgggattaaacctaggtcttgccttcagaacccatgttctttctattttactctgtcctttttggtttcagaaatttaagtgtgtgtaaaattacttccagtgagtattaacataggtttctaaggcagattttgggattctgttgtctggggctttataaaatagataaaaatcttggtggtatgagtatgatccttgaaggcaagggaagtaaagaaatgaccttttaagttccttttagccttgtaattttatgattctatttagctagcaaaaattttaagtacttttaatgaaatgttaagtttaggtatgtcatgatccagtaatataactgtttagtcagtgactgactcgtatctccctgaaaaattcatggaagaagaattagcttgagagtattaatagaataataatgactacaatgatgttgaaatgagttcacatttttcatacccactcagtagatgggaa

SEQ ID NO: 96218 - DNA, 1040 bp, Homo sapiens
atttttcagtcaccttctatgctcgcttttgcctttcagtatactctttgtttctgttacccaggaatctcctttttattatttcaaattcagcggtgtattttgacagcattgtcatatttgatcaggtatttctgtgtgttttgggacaaggagggcctgtgtcatgttagtttgccgtatggttggaagtcactttcagttttgtcttacttgacctttcttaaagtttaggaagccaacaacaaagcttttgagaactgtttaaaagttaagcatattaaatgtatgtgtattttcttttattcaacaaatataatttttaaacatttactgtgatccagatacagaaatatcaagaataaaacatggttactgccttagtaatctatgggattaatagataagggagtagacaacaataacattttgtgataaatgctctcataggaggcagaacacaagtttgatggaaactcataggaggtacctgtaattcagacagattaagtcaggaaaatgtttccagacaaggtgatacctcacatgaatcctgaaagacaagtgagaataaaccaggtgaataagcttaattaataagttaggtaaaaagatacttgaggcagaattagtagaggtgatgatgtttaaatgcacttttgaaacttgtaggtagtttggtaaggttgggtatagcagtagagggttgggaatgggaaaagatgagaaggactttggtatgtgggtattttaagactaatgtgaaccagacatcttaagaggatttcataatattctccttctgttttattcatataatttttattgtaattgttaataaatacatttctcaaaaatttcaaggatacagattacttgtaatgcttcagagatactgaagaataacatacacagaagttttcacctaaacatttatttaaatttgaattttaaaaagttaaaccagaattaaagcaatgacaatgaaaatttgaaaacgattttgcaatatatgcatctgtacttatttataccataaa

SEQ ID NO: 96219 - DNA, 1051 bp, Homo sapiens
ttggcttgttattcatggcttgtatacagtggcattgtgtgtgtgtacagtaaggaggttagcaacagctatcagtgttaaaatgcaaatgttcttttatccagcaaccactagaaatttattatagagatatagatgtagaaaaacagttgcagtattgttgcagcagcataaaactggaaataaagtactgatcaataggggattgtacttttgaaaagaagctttacaaagtgtatacaaataatataattgtatttgagggtagggtggttacgcagataaatggaacatttctggaagaataaccaagaaactgttgacagtgattttatacaagtacagaggatggaacggggatgttcacttgttttgttttctttcttccagggacatttgaaaaaaagaaaactatttttcaaagatctttagagctcaatttttaaagctctagattattttcattattttatgctgcctctgcataactaattttgatttcagggctaggagggtggaggtagggtgaggaaatgaaataagtttttgtcatctaaataataaacattatgaattaaacttaattttttaaatcattactcctgtttggggcatttcttgaggaggatgtttataaaaataaggattaataattctttatataccagagataataaattaggcaaatgagtaaaatctctcataagttattttctttattaaaaaatattaaatataaatacattaaagagtgaataggagaggaattttcagtatacaggataatcagtttgactttattttcataaaaatttggcagcaaatttgtgactttaaaggatatggcaactgaatgagaagttttaattaatgtagatgtcatagcaagatcaagctgctttatgataattttttaacccctttttaatgtgttattgagtaaaagaacacaagaattctttaattaggatacttagtaaactgtgttctcacatttagaaaggacatatacatcattgctgataattttcctgcagtttagggaatctgt

SEQ ID NO: 96220 - DNA, 1053 bp, Homo sapiens
aatgaatatgatcttcagatcttttatgtcacatctcttttttgaagctagggactacattgatctgtggaacccaacttacatcttggctatttattagcagtagttaaaaaaaaaagtttttaatcagtttatctcatcatctgacaaacctaaaacttacttttctgataagaaacatctctcaaaattgatttgagagaattgaacttaagagctggtttgggttcttaagtttaatcctcttctgccataatcctctaaatatttgaaaactttcataacttcatcttttctttttcatcttagacattcttagttcttgagatgttctttacattttatggtattatatcatgactgttgatttggatatttgtctcttttagaactacttttttatgttttgggaaatttagtttgtaggctcattttgaatgagtttcattttaaatttttaatgttcactcccatccatcctctctagtgattctgtagttttatggttactccctacctgcagaatatttcagaattaggtcttaaaatagtgtttggagtctcttgctctgtagtaatgttggggattttgataactggtcttagaatcttgggttgtttgctcaccacatgtgggtgagggttttttcccctcacacaataacctccagtcccataccttccgataaagccattgtgccaagcaggagtgacatgtcccagtgtctggcttaagcagagaatcttgcaatgccctcacactggactgagcccttttggtttcatcctaggttgtcagtgccgccttccacacctcaaggcatgtgccttgaaccccacttatcctccagggtccacaaagatatttccatcatttttcatcctaatccttccttccttcctccctccctccctccctccctcccttccttccttccttctgtccttatttttttgagacagggcttcactctgtcacccaggctggagtgcagtggcacgatcttggctcactgcaacctctgcctcccgggatcaagcgattctcctgcc

SEQ ID NO: 96221 - DNA, 1016 bp, Homo sapiens
tatctgtgtgactggatcagaggttatgtgtcaaagtggccttgttatggcttctagaacatttgctccttattataggtgaatgctcatttgatatctggacatgactaaaaagttgatatactgaccagccaaaatctcaccttgctgttgggcacaggagcccaaaactgaattaggttttttgggagcagctgtctactattgtgacttcaaattgagtttgtgttcttaaagctactagtgacatttatagatgctgctgctgagctaaatgtaaatgtcatgtattcctttgctactcaaagtgtagtctcctgaacagcagcatctggaaactggttagatatgcagaagagtattgaatctgcatttcacaagttccctaggtgattcctatgcatatttaagtcctattttatattagtttagattaagcattatgaagggaagctgaggtcataggatgtttaaatgatagtattaagttttgtgatttttagtgaattgacagataaatctaagttttcttttgttagctgattcattaatctattttgtgtgagtgatcattcatttctcttagtctgaaattttggttaaatattcaagggtggctttaatttgagtttattttcatttaaaagaaaagacatcctctccccaaaccaagtcttatgctttataatacttttacttatttgaaaaatgaatcacctttttttcacatttaatatgtctgaagtgaatagtaagaaatggtattttatgattaaaatagtaaaagatactttaaagagcattttgcttaatagaatgtaatatctctttttctaatagcagtttaaacagctttattttaaagctatggcattgtttttgaaacttttttttagctacatcaaatgaaaacatttgtggaagcagtatgcagaaattatggaaatccttctgtacacacaaatatgtggacaaaaatacagtgattctttggaaagtttacttttccatttttt

SEQ ID NO: 96222 - DNA, 1069 bp, Homo sapiens
tatttccttggtatagttttctagaagtattaaatataattgctgagtcagtattaaagcttttgggtatattttatgttttttagtgaactccatttagctactacatggcctcatctgaccgaagggatcattgtggataatgatgtttattcgtaagtatgttaagagtagtagtacactgagattaaaaaacttcagtagaataactctcaaattgctagtaatttttatatgcattttttattattttgttttgattttagtgttcccttttgtgttttattgtctaaggactttgatttcttatgatgttattttttaaaaacttatccaaatggctccatgtatctggataagagtaagtttaagggaggctaaatggattgcttgtccttctatgttttcattagactgcattttaataagttcatgaatcttgcagattgtcataattaggattttatatttattggtttgcattttagtgatttggatcctattcaagctccacattggtctgttagagttcgaaaagctgagaatcctcagtgtttgctaggtaaggtatattatgctcctttcctgaaatactgctgatctgcctaacttccaaatcggagacactgcatacattctttatactttgtcacctcttcagttaacaccatgtaggaaaaaaatcattgccaatagcagtgaatccttttttgaatagtgccagcaaattctccattattttctcattatctcagctttatgtttctgatgcttttatttacttttttttatttattttttattttttgagacggagtctctgtcaggctggagtgcagtggcatgtctcggctcactgcaacctctgcctcccgggttcaagtgattctcctccctcagcctcccgagtagctgggactacagacgtgtgccaccatgcctggctaattttttgtatttttagtagagacggggtttcaccgtgttatccaggatagtcttgatctcctgacctcgtgatccgcccgcctcggcctcccaaagtgctgagattacaggcatgagccac

SEQ ID NO: 96223 - DNA, 1123 bp, Homo sapiens
tccagcctgggcgacagagcgagactctgtctcaaaaaaaaaaaaataaaataaataaaaaataatagtaataatgacggaaagaataccattaatatgtagcagaaactgaaatatctttatcctacatgatttcctaatcttctagaaacatgtctttagcgtttcttcttaattttattaatggatttagattctagtagtgtagcagttggggaaagattactacatacttagagtaagttcttgttacttacataacttaatgacaaatggatactgtgtctcattgaggcatatagtaagtactattaggtacagttatttttttctttccttctagatggaattctaaggaaaagctttttaaatatcctgggacatggagagaaagaaaagaacaaggctacctttgatataggattaatttttgtttttttcaatggaaaaactgaatggttttactttctaccatatcttagttaatagcttttgtggaaagatgtactttaatttataggactgatttttttttttttcagttaagtgtcaaaaataactttttttcctacataggtgattttgtcactgaattttttaaaatttgccgtcgaaaggagtcaactgatgagattcttggacgatctgcatttgaggaagaaggcaaaggtaacctacatttttttttaacattactttcaaatgtcttactgtttttccttggcacatttttcagcaacttttcatctgttttctcattttgaattaagttggataatcaagttttgatggactagacagctacagttcctttccaggctgtacccagtgcttgttaagacattaaaggcatttaataagttctttccaccaaaaatgtaaaatattttgaaaagcagagttttagaggttaaattttgaagtctcctagggagaaataatttgtgtgacaccattgtcactcatgcttgcacataaagctgaacatgtatattaatattttataattccaagaccatgtaacactagtaaaaagaatgagtaaaatattctatataatcatcaatttgttcatcactttcacctgctgaggttggtgatataatttatatttatttctgtt

SEQ ID NO: 96224 - DNA, 1060 bp, Homo sapiens
aaataaatataaattatatcaccaacctcagcaggtgaaagtgatgaacaaattgatgattatatagaatattttactcattctttttactagtgttacatggtcttggaattataaaatattaatatacatgttcagctttatgtgcaagcatgagtgacaatggtgtcacacaaattatttctccctaggagacttcaaaatttaacctctaaaactctgcttttcaaaatattttacatttttggtggaaagaacttattaaatgcctttaatgtcttaacaagcactgggtacagcctggaaaggaactgtagctgtctagtccatcaaaacttgattatccaacttaattcaaaatgagaaaacagatgaaaagttgctgaaaaatgtgccaaggaaaaacagtaagacatttgaaagtaatgttaaaaaaaaatgtaggttacctttgccttcttcctcaaatgcagatcgtccaagaatctcatcagttgactcctttcgacggcaaattttaaaaaattcagtgacaaaatcacctatgtaggaaaaaaagttatttttgacacttaactgaaaaaaaaaaaaatcagtcctataaattaaagtacatctttccacaaaagctattaactaagatatggtagaaagtaaaaccattcagtttttccattgaaaaaaacaaaaattaatcctatatcaaaggtagccttgttcttttctttctctccatgtcccaggatatttaaaaagcttttccttagaattccatctagaaggaaagaaaaaaataactgtacctaatagtacttactatatgcctcaatgagacacagtatccatttgtcattaagttatgtaagtaacaagaacttactctaagtatgtagtaatctttccccaactgctacactactagaatctaaatccattaataaaattaagaagaaacgctaaagacatgtttctagaagattaggaaatcatgtaggataaagatatttcagtttctgctacatattaatggtattctttccgtcattattactattatttt

SEQ ID NO: 96225 - DNA, 1664 bp, Homo sapiens
caataatctttaataacagatgttcatattgtttctaataaagtagaatattttaatgcatatacaaagtacttttaattatgttgctatatttgtacaggaaaaatattataaatactgtgaaatgctatcagtttttcccagtgtgaaattatacttttattttgttctttatacttttatgcattttcaaagtcttttgtaataaacctgttttttgtaattgacattttacttaatcaaacagaacattttcattagcacataggttgatattgcatagtttagtgctcatctacccatgctatgataggagaatcatgattttgagcaatataaaatgattactgatccaaaaacatttatatcatttgccaatctctgcttagctggattctctcttggttttagacagtccgctctggaacattttacagacccagaagcatgttgaatatgagggagtgcctctggctgattgctgggaacctagtagtctagaggaacctagaactagagacagtccaaggtcctattgaaatacaggtggagatcttggtttttatagtgagaatccactgtaagaatttagtactgaatacacaaactgatttattttgtatggtgtgaaatactgtatgctagtacttcctggagtgggttcaggggctttttctcattttgagtttttgttagcctgaaaactatcactaatttgctgttatgttttgaaatatctattatatttgctattggtgatttgtggacaaggagtataaaataaattttcatcttttaattctatgtgctccccctctggaattcacttaccttacctgtggaaatctagttttgatttcttatcaatatagctaaaaattatggtagtatagaaaataatcatatctgaagcaattttactaaaactaagctttcttttctccttactttatttgatagattagcaagtggacccccagatctgaggtgttgtttactgcatcagaaactacaggtaaagatttctcaatgacatggataaatgtggtcttgatttaatcagattattctaatactaaatgtaataatgggttacatgctgttctcatggtgctgctgtaggttgcctatagtcagtagtcactgcaattcacaaggtcctgagaagtggagagtgaaaattaaatattcaagcagtaggtagatttttatttttctgtaactaattcaactataaatgttatttctcttttcttaagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggtaggatgcactagttctttccattttaatttattt

SEQ ID NO: 96226 - DNA, 1120 bp, Homo sapiens
aagtctggccaacatggtgaaaccctgtctctactaaaagtacaaaaattagctgggcacagtggcgcacacctgtagttccagctactggggaggctgaggcaggagaatcatttgaacccagcagtgggaggttgcagtgagccgagattgcaccactgcactccagcctgggcaacagagcaagactcttgtctcaaaagaaaaaaaaagtgtttatgtttaaagataaagatatagactgtttaaagaaactaaaggtaaggatttcccaatgacatagataaatgtggtcttgatttaatcaaggacctttaaaagattggacaaagtctatgtttaaagattaaagaaatctaaataaacttttggggcttttaggtttgccatttctgtaattgagaaatgttttgaagtttaagtagatcacgtcatcatatataaggtgatttataaactgagcagtgaatgctcagatgtttaaaaaagaaaatccaactgcacttatgtatgtttttgtttaacttgtggacaaagacttatggataggtgcaaaaaataaatcctcttttgcaacccagaactcattgttcagtatgagttttgatacatataagaagggatattatgatacctgagacagttaactgatgggaatattgatagccataaaggttggtcccagaccaggcacaatggctcaagcctgcaagccccacaccaaggtgggagtattgcttgaagccaggagttcaagaccagcctgtataagaaagtaacaaacacctcatctccacaaaaatttaaaaattagctgagtattggggcatgtgtctgtagttgcagctactcaggaagaggaggctgaggcaagagtattgagcccaggagttggaggctgcactgagctttgatgacaccactgtactccagcctgggtaacaaagacagaccctgtctcttaattaaaaaagattgattctaggactgtggaagagatagttaaacagcatgggatatgaaggaaatcctcagcagtattaattttgcattccaatttcatgttgacttgatacctacgatggctttttgttttaaaggcttttatcttgagaacatg

SEQ ID NO: 96227 - DNA, 1037 bp, Homo sapiens
agaagccagttggctcttggggcacatgtcaaaccaaaaggtagagaagggaattggcttaaggtgtgtgtgcacagcaggaaataccagcctccgcagcagtaattttccatctgacctctagctgccttcagagtcatctttccctgtcctgctgcagtgtctttgcagaggcatgcacgggaggacattccaaataggaactacggaagtttttccccatggaaacatactactccttcttggtaaagttctatatagttcctctaacactgcacttcagcaaaactgtgattcattagactattttgggctaacctgggtacctgcaaatcttacatgacattgttttaaccagaaaatagacagtaatttaaatagtcaacttacatatacacccatatgtagaaatcagataatacatttaaggaaatatgtagttattctaaaatagatatggttgcctttactttttgtatagggatgagttaggggctcttgagagtccccagagcattggaagcatactaatatgtgcctgggcacctacacctacacctcagagttccagaaggagagggtggattctggagcatgcccttgtggtacatacctttaacagtaaagagaagataagctcaagtgaaccttggccttctcttggtagctatgttcagcctagtatagtaaggacaaccagaaagaagaattttggtatgaaatgcctttcttcaatataatctatagtgtatgagtgaatattattttcttttgaagtttatgctctttactctgggcctctggtttcctaggatgttttcatgtgggtatgatgttaactgattaagatctagatctttgtacatgaatcctgagtcacccagtatcatgaaataatcttgacccactgcttttgccatggaccgtatcataacccttttacatttgtgttgttgacagtcagtgaaggatcttctaggggatatgcccttaggggtatatcctaagatggtagggatggtcatgctggtagccct

SEQ ID NO: 96228 - DNA, 1049 bp, Homo sapiens
gtactttcaaatgagaatggagttcagttttaccatctttaaaccccatgtagggcaaagtggagtcacaactcagcttgaattataaatataattgttcttgtaatggtgaggagatctacctttgaggtttcctagaaaagaagaggaaaacttcagatttttagggctgtggaaacagatttcagcacagaaagaaagcccagtttgaaaaattatcataaccattacctctagtagtgaaagtaaagattttaaaattatattgtatcttggttactggctaagggctctggcatcctacagataattctcagttcagggctcattaatattagggattctgataaaggcgttatgtgcactaattacacgcttccccttatatggcactgtgattacactagaatgacccagttttgagagtgtaattttcagaaacaaataagaaaaagaatttctatgtgtctacacgtggaataacaactggataatccctgtagagttggtctggagtacaactagttaatatattcaaattcatagccaaatacactgataggaattcttagcaagagctaaaatctgagtttgtttatggggcagctccctaaacctcagaatttcaaattaataaccaaatatttatttccttataaattagacttctagcaaacaatagatgcttgctttgatttattttgtttttctctctggcatgaaaacaagaaccgagtttggttccacatctgataatatctatccagttcactacccagaagcttacaagcgcatttccttgttagctaccaatatgaatgttcctcatattgcaaaaattctttcctctttgatcatttttaataagtgacatgttggctgggtgcggtggctcacgcctgtaactttgggaggctgaggtgggtggatcacctgaggtcaggagttcaagaccagcctggccaatgtggtgaaaccctttctctactaaaaatacaaaaattagctgggcgtggtggtgagcacctgtaatctcagctacttgggag

SEQ ID NO: 96229 - DNA, 1190 bp, Homo sapiens
ttaaaaaatgaataaataaatataaaagttcctatattgtcaaagttttacttgcagtcagtagagggggtaaggaggttatttctattttggggaaaataattttgcttagttatctaaaataagtaacaatctcaggactaaaaatataaatacttcacattttaaatcctcttaacacataactttttttttttttttgagatggagttttatcacccaggccggagtgcagtggcatgatctcagctcactgtaacctctgcctctcgggttcaagtgattctcctgcctcagcctcccaagtagctgagattacaggtgctcaccaccacgcccagctaatttttgtatttttagtagagaaagggtttcaccacattggccaggctggtcttgaactcctgacctcaggtgatccacccacctcagcctcccaaagttacaggcgtgagccaccgcacccagccaacatgtcacttattaaaaatgatcaaagaggaaagaatttttgcaatatgaggaacattcatattggtagctaacaaggaaatgcgcttgtaagcttctgggtagtgaactggatagatattatcagatgtggaaccaaactcggttcttgttttcatgccagagagaaaaacaaaataaatcaaagcaagcatctattgtttgctagaagtctaatttataaggaaataaatatttggttattaatttgaaattctgaggtttagggagctgccccataaacaaactcagattttagctcttgctaagaattcctatcagtgtatttggctatgaatttgaatatattaactagttgtactccagaccaactctacagggattatccagttgttattccacgtgtagacacatagaaattctttttcttatttgtttctgaaaattacactctcaaaactgggtcattctagtgtaatcacagtgccatataaggggaagcgtgtaattagtgcacataacgcctttatcagaatccctaatattaatgagccctgaactgagaattatctgtaggatgccagagcccttagccagtaaccaagatacaatataattttaaaatctttactttcactactagaggtaatggttatgataatttttcaaactgggctttctttctgtgctgaaatctgtttccacagccctaaaaatct

SEQ ID NO: 96230 - DNA, 2199 bp, Homo sapiens
ctttaatattgcgaacttctcttttgtggtcattgctatatgggcctctatcacttcggcatcacattagctgcccagcaagcaagaccaatgcccccacttttaatttggcaagtgaaccttaaaaagaatcgattaaaaaattcttacccagagtcaagatgaaaatcatcttttcactctggagaaaaacagctccttactggactgaggctgtcagacgtagacttgggtcattgctggaagaaacatagaaagcagcacagctccgaggtcctttttcatcagatgtgtaaatatggccttctctcttcagagcagattgcctggcagtcatcatccctcctgtctgtctccagcccggctgctcatgcagtgtctcaagcttcttgcatttgctgtgttatgtggtttttgagtaatcttaacatatagctgactgcattactgagtaacgtgggacattttcatatctttattatgttaattcatctgtccttcaaaagcatctgagtttagcatttgacctgcttttgactttagcatttgattcttttccaggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggtt

SEQ ID NO: 96231 - DNA, 1117 bp, Homo sapiens
gcccagccctcagggttgggccctgccaccagcccaccacaagccccatgacaggagcgctgtgtgacctgtgctctggaatggcccctcctcttcagcatgtgccccaaaatgggatggtgtcccaggaggcagtctccgtccctcactcatccaggagtctcccagcctgcctgtgtgctgggccagggccttgccttaaaacagcctcctctacagacacctttgcttccattaaactttgcttcagaaaggtggcctcggctgtggccagatgggacaccatcaaagctcttccaaagcccccccagccacaggacgatttgagtaaataatgacttgtccatgctgtttgttcacattcctctttctcagccctattttggcccaaaacactatttttgcccatgttacataacgagggaactgcattcttagtaacccactgtcactctgctgtgttatcttgcctatatgaaaaaatgaaatatttttagagtgtgaatttcccaaacgtcctcaactattctgggactgaagtcacaacatcacgaagggagtgcgacggtgggaggcccagcctcctctgtggctgtggctgtggctgagtcccacccaagggcttccgttgccactgaggctgggttgggacgtgccctatcctgccctgtcccagtggcaagtggctgtctctgcacagggctttccactgtcagcagtggactccgcagcctaggaatactcttcattgattttcttgactcctgttgttactttggggaaaaaaacacaagcaatggcctgtcctcttagggactcaagtaggaggctgaaatccccattgggggttagtccaggtgagcaaattaccctgaataagtgtgtaggctccctccctgccaccgagggacatggtaagaaggcttccccaacacaggtgttagcagggttaatgctgtcccatcagtaaagcaaacctgtccaaaacgctcaggggtttcaggccttgccatctggctggggagccagacatgtttcttttgtgtgtttatcagctccccaggtgtgtcctggtagacaactgctcccaggagctggcatagaagcaaacctgcag

SEQ ID NO: 96232 - DNA, 1015 bp, Homo sapiens
gtttggtttcccaggttgtctcaaaaatgccttttgctgggctcagtggctcacacctgtaatcccaacactttgggaggccaaggcaggtgtatcacctgaggtcaggagttcgagaccagcctggccaatatggagaaaccccatctctactaaaagtataaaaaattagccaggcgtggtggcaagcacctgtaatcccaactactcgggagctgaggcagaagaatcgcttgaacctgagaagcagaggttgcagtgagccaagatcatgccactgcactccagcttgggcaacagagcaagactctgtctccaaaaaaaaaaaaaagtattttatagttactttgttcaaattagaatcaaaatgtcacccacatagtatatttgattataatgcctcttatgcttcatttaatctattatagcaccccattccttttttatactatcatactatcaatggttgaatatactggatcatttgccattctggatttgtcttcctgtatctgcaaggtattgtttgacatgttcttctgttcccccaattttctcagtaagaattgtaagatctagaggcttagtttcattctcattcagttattttgggaaaagatcttaacaggtggtgcagtatatcaagaggcacctatggtctggcgattcccctttccatgttaatattgaaagacaagaggcaaacagataacccagaaatgtagtccatcacaatcagaggctatgtatgtgtatatacactcacacacatatatgtgttcattgcattgaaaaatgtaattttaatacaacaaattatgacaaattattatttatagaacactatcatcaatattcactttcatttccaaaattcaactggatttctaatcttgctatctgaacaattctaaatttcaaactaggccaggcgttggctcatacctgtaatcccagtacttggagaggccaaggcgggaggattgcttgagccaagagttaccagcctgagcaa

SEQ ID NO: 96233 - DNA, 1044 bp, Homo sapiens
gactaaggcagcaggaggactgctggagcccaggaggtcaaggctgcagtaagccgtgatcatgccactgcactccagcctggacaacagagcaagaccctatcaaaaagaaaaaaaagagatatctcttgagaactgctgtaggtagtttacaataaagatatgaaaactgcatcaaattgaagaaagccttaggttatggaactcaaaagcctatttgggggacataacaaaatagcagttttctgatgttgtaaataggctcacattcaaaggaagatatctgcctgtgagctgttaactcttattatctcattttctgccagattttgagatttgttcgagaatggagtagtctaactgccatgaagcaaaggataatcaggaaaagtggacagctattctgtagcccaattcttgctttggaagagatcacaaagcaacaaaccaaacaaaattgcaccaaaaggtatgagttgtctttttttaaattttgtattatattacttttcatggttctttctacaggggggtctgaggcatcttttggaaccactaatgaaatcctgatgagttatgagaaaattatgcataaaatcacagccatattgtttcataacaagataattatatgtctagtgaatttgacaaaatctgctaaaagagatcaggttgtccagatcttactctccatgagtcccatcaatcaacaaaaagaccagagtcacaggatggtgcaacctatgacctgccaagcctgggacacttattagcagcaggaatacattttactcttagaacatcagagcatgcctctggaccccatctgctttgccctgctgtgcgtgagtatgatgctgtgcagcaagggagctggttctatttgaatgcatcaccacccaagtaatggaagataactataatcatgtccatgattggaaatgaaataaaaggaaaggttgaccgtcagatatttgtgactgttttgtccttatcattacaggttcctttctaatctctgtacattgatttccttccttgtca

SEQ ID NO: 96234 - DNA, 1018 bp, Homo sapiens
cctcatgccccatgttgggggatctttaggccatgcctctttctcagaccatcacatgagagggacagagaaatggtcccaagagggtagagaaaccaaaggacagacaccaggcagagcataccacagaaatccagaagcccttaaattctttaatctttttttactctatacaatgaaagctctgcctcttggattacctgatcaatgttttatccccgttggggtggagacggagagaactgcaagctcctggtagagggtataatgcacctgctgccaaaccaaaccacagcgaccacctcactgacccgtattcaggctctgccaccagcctagtagcctgcttcttcttgacatctctgttaatggtctcaaatatatttttatgactgttctaaatacttacatgtccctttaccataaaatgttatcacccaaataattttccaaacacaagacactaagcagatgagttgttgacatatcttttcacaaccagagtagagctgagatgaaagctttccttttcaccttaaaagagctgaagtaaggctgggcacagtggctcacacctgtaatcccaacactctgggaggccgaggcaggcggatcacctgaggtcaggaattcgtgaccagcctggccaatatggtgaaaccccgactctactaaaaatacaaaaattatctgggcatggtggcaggcaccagtaatcccagctacttgggaggctgaggcaggagaatcgcttgaacccgggaggtacaggttgcagtgagccaagatcgtgccactgcactccagcctgggcaaaagagtgtgactctgtctcaaaaaaaaaaaaaaaataaattcctagttcactgcctaaaaggatatccctttaaaggaagagtagtaacagacatttagcatcctgtgtcatattagaactgttcatttcagctagaatcccaagtctatatcagggtttagaattacatatcaatttttttttttttttttttttgagatg

SEQ ID NO: 96235 - DNA, 1259 bp, Homo sapiens
ccaggctacagggaatcaggcatttaagtggccctcaacatagcgatgttgctgctaataatcaaaatgatgctcattcggtctcaaatctactctagcaaaaggaatagattagtctaaattttttcaagaccaatagcagctcttattggtggaaattcttccttatgcctaccaacttgtattttttcagctaattctgaatctgtttgtttcttgttagatcattagcaaaaatgtaaaacaattggttaccatataagccaatatgctcttcaatggcctaccgtggtagttttatttcaagcctagacaattactttttgttaaatatattgatattttgatatagctatttcatcgttctaacctacacacgattaaaataagctattttagatagagggtagataagccttcaggttctcttttgtcttctttaatagaacagtggaagagttcagacactttgccagtgtatgacaccttaatgttctgtgcaagtaggaatactgaccggattcacatctatactaaggtaagcgtcatgcagattctgtaacttgaaacataaaaaagacttccttttttcacttttcagtggagatacttaattttattaacattgagataagcatctagttattttcctcaaagctaattctcaaatttctgtgttaaatctacagacaatgagaggtaaaaccacacgtctttaagaacatagacttcagggctagactgcttcagttcaaatctgttagtatgtaatcttggacacattactcaactgctcagtgcatcaatttcctcaactgtaaaatgtggtataccccatttaccctgatgtgattattacacattgtatgccagtatcaaaatatctcatgtatcccataaatatataaacctactgtgtacccttaaaaattaaaaattgttaaaataataaaaaataaaatgcagacaggatttgttataaagataaaacaagctgagtcctgtaaagcacttagcacagtgcctggcctatatgaactctccataaatgttaattcctgcaatgatcacttgcagcagcaggagcagcagcatccttacagaagcctagacctgcccatttgtgttgagtaaatgttaggaagctttttgtcagatgattgctgattcctgccataggctagcttagtagtgcccaaactttttagattcagtacccctttgcactcctaaaatttattgagaaccccaaagagctt

SEQ ID NO: 96236 - DNA, 1055 bp, Homo sapiens
tccaagcttcctagagccatgaacagctctcagctcaaatgggactcctctcagagcttggtcctcatgacttttgctatagtagtgctctccaaaaccttcttactgaaaaaaaaaaaaaaacaaaacttagttgtgttctctttatctgaaaatatactatttacctatttgttaattttattgtctttctctgccatttagaatggagtctagaatgcagggatttctctgtcctgttcctgctgtctcttcagcatctagaatagtactgggtatatagtatgctcctgataaatgttttgaacatatgaataaacattattcactttctttttataagacctaactgttacattctttttactttacttttaaatgtaaattattacatttttgtaataatttttattttaatagttatgcaaatagatagcctcaaccatatccaggataaaaacgagaaggatgattctcagaaagacacctccaaaaaggttcaaactatctcagactgtgaaaaacaagcccttgcacagtcagaacctggccagttggctgacagcaaggaagaaacaccaaaaattgagaaagaagacggacttacatcccagccaggtaatggtaagtcttgtttccatttctagcatccaagtaataaccatatactttcacacataatactgttattagattagtaattactaccttgttccaggttccttttactctcttttatattaaaaataccaaccatttgtaaccacatacttaaacaccagatgtctagaagagctgagtgtgtctgttggcattcagacattacacatagagcaaaaccgataaatagctacatgtgctgccaccaggcctgttgcccagcctcaaccaagcctagctcattcacacagtaagggtgttgttttgatatttgggaggtgctttgggacaaaacagtaagactgacagataattaactaacacttagcatatcattaatcctttacacaaaaattcttgtaaatagttatacttaattggcatatttttaaaaa

SEQ ID NO: 96237 - DNA, 1022 bp, Homo sapiens
ccctcaaggaagggacgatcaagtgtcattagacatttgaagagaaaatctatagcatgaaaaagataaacaaaagtaaactaatacacaaattgatcctgaagataattttaaaaaaactcttaagtagtagtttcagatttgagattatattgcccataaaaataaaatgagaatacggtaaaaaaaaaaaaaaaagaacagagaataacaaggaacttttagatgttaaaaatatgactgccaaactaaaatgattctatagaagggttgaaagataagtagaggaaaactaagagtttacagggtaaaaagacaaaaagaaggaaaatattacagtaaaaggtaagacataaatgtgtaagtctaacattctactaataggaatgccagaaaaagagaaaattaagaggaaggaactatcaaagaataatagaaattttcgagagctaaagataatagtattcaaaattaataaggtatcttaagtcctgagcagaatttttaaaggcatataaatatagactatatagaggtaaatcactgtgaaattttaaaacaccaaaaataaaagttcctgaaaagccctaaaagaaagcaaaaatgtgcagcctaccaaggaacaacattttcagcaacaacagatattggaagaaacagaacaatgcctttaaggatttgagaggtcaggcatggtggctcacgcctgtaattccaccactttggggggccaagacaggtgaattacttgaactcaacagttcaagaccagcctgggcaacatgttgaaactcaatctctgcaaaaaaatacaaaaattagccaggcatggtggcatgctcctgcagtcccagctacttgggaagctgaggtgggaggatcacttgaatccaggaggtcaagactccaatgagctgtgattgcaccactacactccaacctgggtgacagaggaagaccctgtctcaaaaaggaaggattcaaggagaatcgtatgcccagcaaaactactgaataaagat

SEQ ID NO: 96238 - DNA, 1501 bp, Homo sapiens
tttacttcctgtgacagcattcatcattgttcagtttagccatcataacattagccatagtcattgctaatcttgctctctccttttgctaatattgtattcttaagagtaccttttggttcacaatattattaaaatgatttcctttctatcctttcccttgttttctggattttatgtactaaagcctcaattttattacccaagtggaatgttctgttttagaacatcacctatgctgattactcccatgccactgttcataaactaccataatggcagaagtaagcatcagtttctcattactgtcagtcactgctaaccttacctctcaacctgccttcagcatataatgagaattctcaaatgctattttcccaaaataagtcattgcttaaatagtaaaataagttatttttaaaatagcttaattaaatagcttaattaagaagatcaactgtaaagctggtatttgaaggccctgagaattctttttttgtggggaggtttctttagttgttttgtttgtttatttatttatttatttatttatttatttttgagatggagtatgctctgtcacccaggctggagtgcaatggtgcgaactcagctcactgcaacctccacttcctgggttcaagtgattctcgtgcgtcagcctcccgagtagctgggattacaggcacccaccaccacgcacgactaatttttttgtattttcagtagagacagggtttcaccgtgttggccaggctggtttcgaactcctgacctcaagtgatctgcccgccttggcctcccaaagtgctgagattacaggcgtgagccccaatgcctagctaatttttgtgtttttagtagagatggggttttgatatgttgtccagggtggtttgatctgtttggccagatcaagtgatctgcctgccttggactcccaaagtactgggattacaggcatgagccaccacgttcagccttctttgttgttctgttttgttgttgggaagattccttttgttttaacaaatgttgcaaattttttttttttttttttggtggggaaatggagacataagtcattaaataaacagattctttaaaatatagaataggacaaaagattcaagtattatttaaacattattcagtgtagatgatagtggactattatatattttatatatatagctatgctgacatcagtttgttttatttgctcttcttaaaaaaaaaaaaatttaaggccgggcatggtggctcatgcttttaattccagcactttgggaggctaaggcagaaggatcgcttgagcccaggagttcaagaccagcccaggcaacacagggagacccttgtctaaacagtaacaacaaaaattaaccagacatggcagcatgcacctgtagtcccagctactcaggaggctgaggcaagagcatctcttgagcccagaaggctaaggctgcagtgagctgtgatcacaccattgcactcc

SEQ ID NO: 96239 - DNA, 1049 bp, Homo sapiens
ctgcttatccacctgcattcagcctctttcctagggatatgtacaggagtctaacctcccacttcatgcgacactgcacctggctaagaccatgtctctaaaaaaaaataataataagtaataacgttttcttttttactactttgggttttaaaaaaaatcaaaatgtgttttattttgtgtgttttgttttgttttctctctatctgcagagaaacactagtagttgtgcctaagagtggatattgtcagtattttattcagctgtatgggaatgaacattttggaaaatctgaaaaaaaaaccagtcatttctttcttagaataatttaaatctattttttcagttagatgattaaaaccctacttgtgtcactctgtctcctttgaaaacagactcttgttggcttgtttacaaatgctcacgagggctctttagttccagttccaatcatcaatcctctgtggttcaagagaccagcatgatgtcccaatcacccatttgtaaaataggtttattaatatttttaggaacaggagccaaatgacacgaggcagtaatggttcctaccagagctgccctttgatcaaagtctattaaacttgacatcagtgcttttgttggtagcctgtgcttccctggaatggcaccaagctttgaagtgctttattttttatgagttttactagatttttttcccctctccttcagttctaataactggcttttaatcctatcatcatagccaggggatttgtctgtaaagaccagtagtttgctatggtgaaaaacagggcaaaaagattaggactctgaacttttcagataaaaacatgcattttgccatcttaagcattttgcagtttgtattcccagcacttctcaccaaaagcagtatttttcttttgtttttcaaaaacaatattgaacaaaagacaggaacataataactgagtttcagctgtataactgaagagaggaatatgttcttctatcttccactttccttatgacatgggcgtgttgttataattatatttttctcata

SEQ ID NO: 96240 - DNA, 1051 bp, Homo sapiens
ggcgcctgccaccacgcccggctaatttttctatttttagtagagatgggatttcaccatgttgggcaggctggtctcaaactcctgacctcaggtgatcgccccccttggcctcccaaagtactgggattacaggcatgagccactgcacctggcgtgtttcaggtttactttagaatgctcttggccaagaggaggaatccattaagttggttgggaggcttataattttatttttggtttacaaagataattatattactaaagcccatgatatgttggaacagtaagattttcttagtgggtagcttatgatttaaatgcaaaatcaagttacttagtgaatttcagctgtgaggtgaactgctcaaaaattcatttactttttcctcttgtaggctcaagttacagggagcacactgaacggtaggaaagaaaaaattcaggctgaggaaggtgataaggaaaaatgggatttcctgcagtttgctgaagcttggactccaaatgacagttctgaagagttaaggaaggaagctttgttcactcacgtaagattatatgccttactcttttctattttttttagtatcctgaaactataactttgtatgtatggttttaaatagcaactctcaattatttatggtgttgaaaggagacttcacataaagctggaaaccctcttagagccaaaaattaatattgttttccaacagttttagtacttactgttcagctcctcggataaacaaactgaataaaattcagagttcaaaagaaaatataggaggctatctttatgacactgagaatagggaaaggtatattaaatgtgccttaaaatgtgcaaatagtaaagaaaaagattcagatatttgagtatatcgaaatcacaggttttgttatacaaaatgtcctgtatataaatcacagactcagtaaagatatttgcattacaatgtccaaagtatatgaagaatttatacaactcaattagtaaagcataaacaagtcaacagaaaaataggcaaagagctgggcatggtgg

SEQ ID NO: 96241 - DNA, 2166 bp, Homo sapiens
gtataaccagagacgttgttttcttgctttataacatgacagtgtgagttagatgaagaggatgtaaatgctctctgcctggttgctatagataccatatgttggaaattgtattctcatttataaagtattttattagattttccagtggtaatgtgaatccgttcatcatcagagaataaagtgatttagtttatatacttacatcaagctgacttttgaaattttgaaatacctttcaaatgtgttttttgtagttcacctagctatgttgcattaaacattcttcatttgcctttcatgaattaaatcttaatttggcctaaaatagacaactaatttgttttcaagtccttcagtgttctccatttaacatgttcagaaatactttattatatattggctgtatgttacattctcaatttatttgctttatttcacttagggattaacatttactgcagcaagtcatgttgtatttgctgagttgtactgggaccctggacatataaaacaagcagaagaccgagctcacagaattggccagtgcagttctgtgaatattcactaccttattgcaaatggaaccctagacacccttatgtggggaatgttgaatcgcaaggtaaagcttgaatttaaatcaagttagcagcttacttactattaaccatagccaatgtgagttaagaggctgagttttagtgttttcaggcaaaggatacttaagcacatcaagataatgatgataatagagaccaagttaagaaaaggcttcagtagtagtaccttgtctgctctcctctgtaataagagaggcatgaacttccacgtactcctgttatcttccaagcccttctactactttagaggtacaatgatggggttggctagcaaggaaacgtaatgtttcaagccccaagtcctttgcgtaacctaagaataaaccttttctagaagaattcttgagttccaagctaattttggacagaaggtagcctgtacccagactctagaaaatgtaggaatgacattgcttgctctgtcctctcagctgtctcatttcctcagtcttgacaatgtttatagaaaggacttgactaaggattagatgatttctggctgggcgtggtggctcatgcctctaatcccagcactttgggaggtcgagatgggtggatcacctgaggtcaggagttcgagactagcctggccaacatggtgaacccctgtctctactaaaaatacaaaaaaattagctgggcatggtagcaggtgcctgtaatcccagctacttgggagcctgaggcaggagaattgcctgaagctaggaggtggaggttgcagtgagctaagatcgcaccattgcaacaattgcactccagcctgggtgacagagcaagactctgtctcaaaagaaaaaaaaaagggttagattatttctgggttagtttgtttgggcagccataacaaagtaccaatctatattgggtagtttataaataacagaaatttatttctcatacttctggaggctagaagtctgagattaggatgccagtatggttgagttctggtgagggccctcttccaagttgctgactactgctttctcattgtggaaagagggcaagaaagctctttggggtctcttttataggggactaagcccattcatgagggctccaccctcatgacccaatcacctcccaaaagccccacctccgaacaccatcaacattgggagttaggattttaacatctgaatttgggggggatacaaacattcagcccatagcactgtttttcaatgaaatgttttttaagcactggatataaatatttaaaatggccgatcatatgttggttaagtttcaaagcatataaatattagaataaaagtttttatgaagaaagtgaatagtataacttctccagttaaaccttttctcattaagcatggaaccattgactgggtaatggattataattttggataattattgctatggtttgaatgttcattccctctaaaacttactttgaaacttaatccccactgtggcagtattgagaggtgggccattaagagagatgattgaccttctttcccaccctcttctaaaaaaaagaaaaaaaatgattgggtcatgagggttctgccct

SEQ ID NO: 96242 - DNA, 1027 bp, Homo sapiens
taagcttcagtccctgatttcttactgttttcaatcttcccttttaaaaaaaaatgctcttcatctgatttttttgctttctgttttctccttaactctgttctacttggtcttatatataaacttttttgaaaatcaccttctaaacaaaactgccaactccttcttggccatagcctacttgactacctcctttccattgaaacccattgttgtgttgttttttaattcttctaattcttgtcttcttctcatttaattgctcagtttttccccttcttgtccctcttcttttacattttccttatatgtgggcttctacttccttaggctacctagagaacaatgcagctaaaagttcatatttactgattttcaagccatttttcttgctttattaaaagtgacataaattttaaataatcatttttatgacactaataaggtttaccttttaatatttaggcaggtgctgtaaaggattatattaagatgatgcttcagaatgattcgcttaaatttctggtttttgctcaccatttaagcatgctccaagcttgcacagaagcagtcatcgaaaataaggtatgttgccattttttaactaaatactttttagaatgcatatttttactatactaaacatcagttgtagtctcatagttgaggtgttttttgtcttctttagatgatggtatataaattatcacacatttttcttgaaaattatattaatattatatgatgatgattatatactattaaattttctcttttcttaactgatctcataattttccactgaccaaattatctggattgattaaagatatgctgccatgccagccgccccatctgggagggaggtgggggtcagcccccgcctggccagccaccccatctgggagggaggtggggggcagcccccgcccggccagccgccccgtccgggagggaggtggggggcagcccccgcccggccagccgccccgtccgggaggtggggggcgcctctgcccggccgccc

SEQ ID NO: 96243 - DNA, 1003 bp, Homo sapiens
acaagaaagacactaaccactgactagaagctctgcgcatgtatacaatttatagactgtggccttcaataaatggtgatctgaatgggatgtctccctgggaaacccctgatagcagtatctttagttttttctcttggctggtcagattccttagaaaagaatcactttatatgattctgctctcttgcctgaaggacataagcctgtttctgttttgggaagtataggggaaagaaggctgggacagaggggcagatctcagcatttattttgtaactttcatgtaatccccatgagttttgtaggatatacctatcatcaatataggattcctccatccaaataccctctattttatccactccagagaataagtctgtagttttctaccagaatggttatggtagttacctattatatggaataggtagagagaaggtaaatagcagtattgcacataatcaactacttaaacattatttcagcaggtcctcctaaccacactcctaccccccattccagaggtgtcattttctgaacctttttaggtgactgcaacgtaaatcaagtgcttctccactttccatagccagtttaggatctgtgagattggttaatcagttatcagtcattatctgctttttagcttccaaagttttgttgctattgacttttctccagttctctttgtccctttacacttgctatcttttaaacatagcattgagaaggagcagaagttaaatgtggtcagcctggtatctttttccacaatttctacataaccagtttttaaaagttaaaagatacatagattttaaacttaattcatgctatcctctttaattcgtatttgcttcatatcaaattgatttttcactcttagtaagtaacttggcctcaagttacctgttaatctgaactttttaaattttcttccttctgtgtcataattgttctatatgtccccctgttctctcagacctcactaccgttgtct

SEQ ID NO: 96244 - DNA, 1085 bp, Homo sapiens
gtgtgcatattcaggcaaattcattgttttaaaaagattgtaatataagcataaacattgttttgtactttccctttttgtctttttttcatatacataaatggtatacattatggttgcatgtcattgtatcattggaaatatactgtactttcggggatggcaggaagttgagagtttgccttgtacagtttatattttctctgtggaatgggaaggacaatcataggttcagagaaatggaaaaatagagggttaaaggtttcatgaaagttgatgtggtttgaaattttaccaaatgagaatgagattagtgtggtaggattgttaacagctctagtaatcatttgagatcagcaactgcagatttgtaatggaaccagttttctctaaggtacaatttctccagccacacccagcagcctggatacaggcatggaaaaggcttcaggcctttttgatcctgaggttggatccattcaagattggattttttcaacagcttatgatgcatggactgtgggacaagggaacttaaactatatttataagaacaaaggtaatgtatgaactcagaaatcaacagggctgaggaaagatgtgaagacagaaaaaatataatggatttggaaattagaggagtcagttgactgaaatgtattgatgcaatagtaaagacatagtgagtatgaatgaacaagcaccttcgaaggatggggtaagtagagagtagaatgtctcaatttaccaggtagaacggtttcttaggacctggttgtaaccatagggatagttggagtaggttttagagggtcattgaagacaatgagtgtgaggaactaagagggaactagaagccatgttttaagaagcattttaacaaatgaaaacatatctggaaaagggtgaccagaataatgagaggaatctcatattcagttcaaaaatgtctaatgttattgattgcctactatatttaagacattatttcagagctgccggcaatacaaagatgaataagacatagtacttgatcttatgaagcctacaggaatttgaaaacgagaagccctaaggggagcagg

SEQ ID NO: 96245 - DNA, 1016 bp, Homo sapiens
gtttttaagcagtgcattattattttattgtctatataaggttttaaaactaaaaatagacacgtgtaatttaagtgtctgagacatgttttatgggacaaaattctagtgtaacaatatatatgatatgatcctccttatgtgaataaaagcataaacatatgcttatatcaacatagaaagatgtataaatgtatatttatacaacagataacggttatccctgatgaatagtagtgaggggatttgaggaataaacagttggattttcttttatacttcctactattttgttaaatggttttatcattgtaataataatttacttgaaaatattacaacatactacaaacacttgtattattatagctttttatgcagattgaagctctctttccacaaaaatttggaagatggaccgactatgcaaaaagatactgtaatgcacacatcaggtaagttaaactattttccgtaaattttttcctcacatgtttactgtgaacattgctttattaatcattctttttttttttgagacagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacctatatgtaaaataaataaaagtaatagataatggcaaagttttcctttgtttttattttttactttctactttttatttttgaaattatttatttttattggctagatttacatgtaaattatacaaaagtaaaaactaagtgtttcttccactcttgtctctcagcaaa

SEQ ID NO: 96246 - DNA, 1105 bp, Homo sapiens
ggaatgcagtggcaccatgtcggctcactgcaacctctgcatcctgggttcaagggattctcctacctcagcctcccgagtagctgggattacaggcaccaccaccacacctggctgactttttttatttttagcagagatggggtttcaccatgttggtcagtctggtctcaaactcctgatctcaggtgatccacccacctcagcctcccaaagtgctgggattacaggcgtgagccactgcacctggctgataaaccttatttaaatgttcacatttaaattttcttaaaatgactcttctatcatcttttatagccactagggcatctagtttttatattattttgaaaatacactcttgcagttaaatggtggataatatttttatttgaatagtatttgggatatgttagataggagtacaactccagagtataagtttcctggaggatgttagttaaggacagaaaaactacccaatgtcttccaggtacttaaagaaacaggtttaggtgtataccaatatgtccaccacaaatacatatactttccttctggcttatatcagttatgcctggactgtttacaagtcaagacatggtaggatagaagctacagattgctgcagtggcctttgaagccagtctcctatatgttgctctcagtatacctaagttagttagtaatattaaataacctattactttcttcttcaggctcttctggtgtttgaatacagtgagaaaattataggtctcggccaggcacggtggctcacgcctgtaatcccagcactttgggaggccagggcgggcggatcacaaggtcagaagatcgagaccatcctggctaaaatacaaataattagccaggtgtggtgatgggcacctgtagtcccagctactcgggaggctgagacaggagaatggcattaacctgggaggcagagcttgcagtgagccaagatcatgccactgcactccagcctgggcaacagagcgagactctgtctcaaaaaaaaaaaaaaaaaaaagaaaattataggtctctgtattaagtagattaatccagggcttaaaatgcagtagccatagtggttctg

SEQ ID NO: 96247 - DNA, 1024 bp, Homo sapiens
tgtcacccaggctggagtgtagtggttcagtctaggctcactgtagcgtcaacttcctgggtccaagcaatcctcccacttcagcctccaagtagctggaactacaggtgtgtcctaccacgcccagctaattttttgtacgtttttttatagagacagggtttcaccatgttggccaggctggtctcgaactcctgggctcaagcgatccacctgcatcagcctcccaaagtgctgggattacagtcatgagccatcacacccagctaataatactcttaaataaaatgtttgataaatattttcttttaaaatattttaggctctattattaacatttatttattttttaatttagatgggtctaggaaagacaatccaggcaattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggtaagaacaactgtttaatatttaaggagaaaagtcttccttgtgtgtacctggtatatattcatgttttagaatgcaatatcaccaatagataataatttagaagtggagtaagtagtatggagaattttattttacattttaaaatatgaattatttatctaaaacccaatagtatattttagttctaagttcctttatggtatatttttaaagtaaatgtaaaatacgtatacttttaaagatatatgtagtatatctactttatatataccttaaacatatttgaaaccatcttaaggttcagaaataaatctcacaacttttcattgattgacttgaagctttgtgatcgtttattatcagcaacttcagtggattttgctttccaatttgttaattaatatgcaagttttgtgtgtgactcattagtaagtttgattttccttatttataattttaatattttatatcttgaaaatatttg

SEQ ID NO: 96248 - DNA, 1209 bp, Homo sapiens
ctctattggaaatagcactaacaatgtacaagaacaagaaagtggttctgctaaaatatatacccccttaataataagtaacagaacatagtatttcagtctgctatttctttatgcgggttttctttcttaattgaaatcctcactaagattttaaaagcatacctaaaagggtcctccaaagcaatctcttttataacaaacaggccacctattttaaagacaaacctacctatctgccttcaaaggaacaagctgcttataacattaaaaccggaaaagtttttagtttcgaaaaatgtcaatgagcatttttaatgcatagaaataaaaattgctttataaaagtaatcacagtataaaaaagtgaaactgaaattttatgtatcaggataattgttatttaattgctcttaataatttcatagaataaaacatttaggaaacctaaaattattctcctaagtaaaatggtgatttacaattttgaaaacattgatgaaatgtgttcttgaggttaatgtattctatttaattcttatgtagctacctggacatttgtactattgtttattcaagactttgattcttaatcattgatttagccttaatggtgatgaaacactgaagagttccacattaacaaattctattgttgttagagcccagggctttgaaccacatgttgagtgtagttattcctgtatgcctaaattacttgaagtgtgttgttgcttttataattgaatgctatgctgttttcaattcttttcaaaatactgaaatctggccaagtgcggtggctcacgcctgtaatctcagcactttgggaggccaaggcaggaggattggttgagccaggagttcaagacaagcctggacaacaaagtgagacccccccatctctacaaacaaacaaacaaacaaacaaaccaaaaacaggcatggtggtgtgcacctgtagtctcagctactcaggaggctgaggtgggagaaccgcttgagcccaggagtttgaggttgcagtgagctgtgatcaggccaggccacagcactccaacctgggtgacagtgagagcctgtctcaaaataaaaacaaaaactgaaaatctaagtacatgttttaaaagtttattttttattttattttattttatttttttgagacggagtctcactgtgtcacccaggcaggagtgcagtggcaca

SEQ ID NO: 96249 - DNA, 1038 bp, Homo sapiens
ggtataccttttttaaaccatctagtaagatgcagagactatttcctgttttgttcttcattagtgaaagttatagggcaattttctgctaatggaatcagactaatgaagcatattttcaagatattatcaagcattagacactagtttaatttttttaaagcttatgaacagaaaaggcagttcttcttaaaaattcattaggtttttggaatacacaaggatttatttgtattactctggatctattatgtaccttgaaattattacaagctttcatgtctttcctgtatattactgatgtttcataataggtaaaaagaactaaaacaaaacaaaacactgaatgttattttaactagtttttcaaagttataacatatgttgcaaatataggctgcttcacataaagcttttctcctctttcttccctattaagacactttaggacacttcggatatatccttccacgtgcttctgaacattgctgagtaaggatatgatgtctagagctgctaaggatgacaaagtagaaagatgacatgaatagactagtgaatcaaccaatcctagatctatccctctcttacgtgttatgtggtctctttagtgattaagccattttgagttgtatttctgttattgtacaacatcctaattcaaagtatttacaaaaccaggttttaaggccaatcacatttccttcagtttataatggctacatttgaagctaccatcctctgtaacttccttatatctgttgtgagtatttatttactgacaacagcaacaaaggttttaagatacttttccatttacaaagtactatctctcctcatttgatcacagcttggtttaattggcttagtgattttcacaaaaacacatgagactaggaaactgagtacagagatctagggtatttataattatatgctagttaacaagagtctactttaagcttttacagaaatgcaacagactaatttgatacgcaaccaagataaactcagccctctatttccacaggttttgta

SEQ ID NO: 96250 - DNA, 1056 bp, Homo sapiens
gactacagggtgcacgccaccacacccgggtaatttttgtttttgttgtgtttttttaagggatgggttttcaccatgttgcccaggctggtcttgaactcctgggctcaagtgatccttctgccccgcctcccaaagtgctgggattacaggcatgagccactgcacccatccattgtattcttattctttttattttccaccttagatttagcaacttctgggtgtgttttatgagtaccttatactactgtctgtatttctttacttttttcaaactttgtgatagttatatgatctcttccatcaaattgggccattatatggttttctatatttttaaggataacattgtcttagttccacagtcacatatatcatatactttctcttcaacattttattatgaacagtttaaaaaacatacaacaaagttgaaagaatgttagagtaaatgcttggtagaggcaacacccacagtttattattaacattttgccatgcttggtctatcacgtatttatctatgaatccatccttctatccttctgtcccatcagtcccttttattattttcattcatttcaaagtaaattgcagacatcattatactttcccatatatacttaaatatatgtatgattaaccagaattcgtatttgtttacagacttttttttctgttgagatttaattaatgaaatgtacaaaccttgacaaatgcatatactcttataacccaaacccatcatcctagaaagttacttcattccctttctcagtcagtccccactctcacattgatctgatgttttgtattttgcctgtttttaatggtttatataaatggaatccagtaatatgtgctgtttatgaaaaacttcttaaaattattgtaatcttactgagtgagattcatgtattagtagtttgtgtctattgtacacatttgtatttatagctgttagttgacacttaaggttatatatctggtgtttttcaccttacacctgcatcttctcagtttttccagcctagacatcacttctgtagattt

SEQ ID NO: 96251 - DNA, 1111 bp, Homo sapiens
taaacagaaggcagggtaccatctaaatacaaaatattattatttgataggcattatagtgtagttgtataataggacattttcttccagagttataagaatttacagatatatgacatttttatgtcatagaaaattacagtaacatctgtggaaaaccagggggtgaggaaggtgttaatcaggcaaagtgctatactgtggattcagctcattaaaaagaattaattttaatatttaaacaatttaataatattacattaatttaattagtataaatttgattttggagttaatgtctttgtattttataatttttttaaatgtagctttacctcactcttagaaaatctggtgtgatatgaaaatgtggatccataaaaggatgaattattaaaggattcatctttctctagcagattcatcccttattttaaaaattattcgatttgtgaaaaatctagtttatttataattttttagtaataaatttgtggtgttaaactggtgtatagtatatggtattatggctcaaaatgaaatagtgcatgctgagttcctagagagtgcattaagtaattgctttcaaactcagtgctttgaattttcttagtagcttactgtgagaatatgatttagtttatataaatggtatgtcaaagctatttataagtactttaatattatttatatgtgattctgtaacatacttagtaatatctatttcttatacccctcccttttttgttgtttctttgtttttaggatcatcatgcctagggttcataacataaaaaagtctcttacacctcacatttcttgtgtgacaaatgaatctgataatctgctggattttttgcctgacagactaagagcaaagctacttccattccagaaagatggcatcatttttgccctcaaaagaaatggcaggtaaagttctttgaagacatgctaaaaatgttaaattcctggaaagtgtattaaaaacaaagttctgttcaaactttcttttcgtgtattcacagtctttctttagtagaattgattgtgaccaagttagctttatccatttactatggttgacttatacttcatgttgaaatatatt

SEQ ID NO: 96252 - DNA, 2654 bp, Homo sapiens
gtttatatagttgtcctgacccgccatttacttgttgtttctgaaataagtctctaggtagtgtattttaacaatatctgattctcctcagtacagttctactatttacttaaatgagtcagtgaattccagttgaatttgccttgttctcaattgagtacaaaaacactatcttgacctaaaaagatagaaagtatttccttctttctttttttcaagtgttgcgtaccataccaagcaaattgcttagaaaataagttctactagattttgctttcactaaatttccctagccaatattgtcattttgattttaataacatggtattaaaaattatgtattgctggtgcggacacagttgcatgaggggtttctgccatcatcagtgctgtgtagcagagttagttcctctccagctcagccgcacaggtttggacatatttgactttttcccctcagtttgaattgaccaaagcaatggtgatggagaaggctagtcccctgctggttgggtgggaatttgtgagacagcattacacactgctgaactaggccccagacatgctgcatagattttatggaaggaactcttcttatgtccatgggggattggattcaaatagaaagctagcagatgcagtttatggacagaaagaaatccacaggaaagtgatgtcacgaaacttcagcaactgccacaccaagattctccatgttgatgcttatgccacactaaatgatggtgtggtagtccaggtgttggggcttctgtctaacaacaaccaggctttgaggagattcatgcagatgttcgtacttgctcctgaggggtctgttgcaaatcagttctatgttcacaatgatatcttcagatagcaagatgaggtctttggtgggtttgtcactgagcctcaggaggagtctgaagaagtagtagaggaacgtgaagaaaagacagcaaacacctcaggtggtacctgatgattctggaactttctgtgatcaggcagttgtcagtaatgacgtggaagaacatttagaggagccagttgctgaactggagcctgatcctgagccagaaccagaacaagaatgtgtatctgaaatccaagaggaaaagtctgagctagtattagaagaaactgctcctgaggatgctcagaagagttcttctccagcacctgcagacatatctcagacagtatgggaagacttgaggacattttcttgggcatctgtgaccagtaacaaccttcaacccagtggagctgttccagttactgggatacctccttatgttggtaaagtactagcttcacagccctgtacagagtctaagcctgaatctcagattccaccacagaaacctcaaagggatcaaaggatgtgagaacaacgaagaaatattcctccccaaaggggacccagaccgatctgtgaggctggtgagcaaggtgacattgaaccccaaagagtggtgagacaccctgacagtcaccaactcttcattggcaacctgcctcatgaagtggacaaatcagagcttaaagatttctttcaaaattatgggaacgtggtggagttgcacattaacagtggtgggaaattacccagttttggttttgttttgatgattctgagcctgttcagaaggtccttcgcaacaggcccatcatgttcagaggtgaggtctgtctgaatgtggaagagaagaagactcgagctgccagggaaggggactgacgagatgatcgccttaggggacctggaggccctctatgtgggctgggtggtggaatgagaggccctcctcatggaggcatggtgcagaaagcaggatttggagtgggaagaaggcttgctccatggcagtgaatcttcatggatcttcacgcggccatacaaaccctagctcctacagaatggtgaatttctttgaccagcctttggtatcttggagtatgaccccagtttgttataaactgcttaagttagtataattttacttcttttgtgtgttaatgatgtgtgctccttctccctctcttccctttcctgacctttagtctttcacttccaattttgtggaatgatattttaggagtaacggatttttcaagaagaagaagaaagaaagactgaatttccttgcttattttgcatgtacagactggatttttttcctaacagccatttccccaaaggaatgtgtcttgcgtattactgacatttggtacgtttcattcattggaatatttcttactttctgtgtgtttcaaaagcctgtgagaaatacaggatttgataacattttgaaggcaggaaaaccccaaattgttacttctttgagagtcacaaccactttctggtgtggagaaattgccattggaaaatttgacaattttgattctcgctggtatgtttaaaaactgaataaaaagaatagaatttttcttttgatattggatcacgaaacacttctaaaacctgtttttacagtgggtttggaaaatttgacaattttgattctcactggtatgtttaaaatttggaaaatttgacaattttgattcttgctggtatgtttaaaaacaataaaaggaatagaacttttcttttgatataggatcacaaaacaattctaaaacctacc

SEQ ID NO: 96253 - DNA, 1161 bp, Homo sapiens
ttctgacgtcccgctgctgccagcccgccgttaggtcgggttccgagtgagccaggctcgcctggcccgcggctgcggctccggctgcagctgcagccactgccttgtgcccaccgcccccacccgggggccatgtgaaaagcaaacccctcgaggcctagcggaggaggcaggggaaaggtttccgagtccctgccatggctgctgctgctgcctccgcggctgctcttgcagccccagggactcgggagccagccacagcaggcctgccaagagcgtggtactgctctctcgtgtggctggcgccggtgccccgggctcccccggccgccccacggccgcatcccctggccttgcaccaagagaattttcagcttcgaccggttggtaaaatgtaggtacattttccctgtggtaccagaaaaagcacaatgggaatattaaaaagaaagttgaatgactgtcagtgccacggtcccccgggatcagatttacacacgttttgattcctgagccttaggctgccaacaaatctttgtgggctttgaagttttttggtgttttgttttcttttgttgctgtgactaggtgcaaagggtgactctgttgagcttgtttttataaagaaacttaaattattgggactatcatgctccgtgtgtaattgtcctgggatagttaagtaaaaggtgaagaagaggtgctttccaaattaggattagtgaacagcaaatggtttttctaataaaattttctaaatatatatatatatatcttcatggttatagtttacctaattgtaactgtaagaaaccttttttagcttaaatatcattgatgacaaaaacttttaaatgaaaagatgattaaagtcaaactgaaagtctacccatttataatatgtgaaacaagatcttctaagtaataggataccagtctgacaggaataattggacacgtctcaatttctaaaaatttggcatatttggctatttttagggcattctgttatgatttcttcatcacattttgatggagtacgctcgtcttttcaaataccactctgcttttatgcctggaagaatatgtctttaaatcatggattctatagtctgtagtagacataactgtgatcagagataaaattctaggcccatttct

SEQ ID NO: 96254 - DNA, 1027 bp, Homo sapiens
caggaggtggaggttgcggtgagctgagattgcaccactgcactccagcctggcgacagagcaagactttgtctcaaaaataaataaataaataaataaataaataaataaataaataaatatgagatggctgttgtgaagagaaggaagtcagttttttctcagtataattgtaaactttaaaaaaaattaaatcatcttccacttaatccccgagacttcccataatgtttagtaatacggacatgtgcaaagaattaaatcgtataattaaacaaaattttgtcaagttaactttgcttctcaaataaggaagttatataattaaacacatttgcttgtacctaatgagacgttagcatcaacatgactgtatatcatttccagaatttaattcaattagttattggctgagggatgaaatagagatgaaactaaatcctggcctcaaactagttttgtaccttattttccagcaatttggtttttttatatctagattttatctttactattttccctcatcttacccattcttagtctccatacacacctattaactttaatttccttttctgagaattttgaaagccctatagtttatgatcttttttccctctttgccttgtgaattttatatttgtgagttttttccaaatttctacctgtcagctcacttctttaggcaaggtgtaaggtttttgagcccccttatttcattttttatttttttaagagacagggattcaccctgtcacccagactggagtgcagcgacaggatcatagctcaccacagccttgaactctgaggctcaagggagcttcccatcttatgctcccaagtaactacgactacaaacttgtcactaggactacaggcatatggctaattttttaatttagtagagacaggttcttactgtgttacccaggctggtctcccacctcctgggcgcaagcaatcctcctgccttagcctgccaaagtgctggaattacaggcataagccactgcacccagcctat

SEQ ID NO: 96255 - DNA, 1064 bp, Homo sapiens
gtgccacactgtttgattatgtacctttgtagcaagttttgaaatgagagctccaattctgttcttctttttcgagtttttttttttttctttttgcctttggctattccagatcccatttattattctatatagtttagggtcaggttgccagtttctgcaaagaagccagcttggattttaattgggattgtgtcaaatatgtaagtcaatgtggatagtattgccatttaaaaaatattaaatgagaaattttaaaaaatatttaatgattaataagaatgataaacattgcaagtttacatgataccatattttgtacaaaataacttaaaaaagaagaatcccattgttttaacatttttgcaaatttccttaatgtctggcttaaccgaagaagatggctgggttcacatacctgcttttgcattcactctgatatatgtggtttgggttgaaatataagaagacaattttggccaaacatagatacaaagataaaaaggggaggacctcatgaactttttgaaaggatcttggtgaccctgcagtggtcctcagaccacacttagagaaccacatgttgaatggaaacaagtatgtgtttggaaactcagagacctaattgaaattcacagctctgcctcttaacaactgaacaagttaagttacttagcctctcagtctgtttcttcatttataaaatgaagataatgacatctccttttagggattttgtaaggaggaaacaagataatgcctgtaaatgttttggtatgtggaaaccgctaaagaaattatgctgttttcattcatttatatttgtcgacctctcgctataggattagctaatttttttccagtgaaaggtacaaatagttgggaaatgagagaggttggaattttaaatatacttatgtagtaaaaacacatcatatagacattcagctgtcaattgttgactcccaaaaaaggacaccagaaaaaatgtgttgatcaaagttgtatttattagatttactggaataggggcaaacacaacttgacaaagtcttagtagtctc

SEQ ID NO: 96256 - DNA, 1028 bp, Homo sapiens
taacacttttatctagccaatgcatggcagtaggttagtaggagatgcaggcaaactgacaagtttgtttttcctcatagaaaattagaaacaaaattagaagtgggagaggctgcccgctgtagctgcactagcagcaggaactgataactaaaatcaaagaaggaaagagaattataaaaggtattaagtagtttaaaactattcgggaccatttagcacagaataaattgtccatgtacctagtagaatgaaaaactgccaaggttattctattgcactctggtattttgtttttaaaacaataatgaaaaaaaaacagtgcaacagtcatctagaaaatatacttattctttgactatgccaagtaattaagatattacgaaataattgagtgtacattaaaagttaaatcacgttgaattgcataggaacactgatagttatttcaaactcacattagtgaagtagtatataatttatagttttgtcgttttacattgtggggtattaggagaatcttttcaaatggaattcctagagtgattgctgtttgagatcggggggtgtatctttctggtttctttctagttctatagctttttaaattttttgagtgaaatgtcaaaaattattgtaaactgatttgagagttgttttcattatctgattcattaagcttcagattttaactcagtattaccttgaaggcaaatgtttattttaatatgaaaatgatagttcatttgttgatgctagtatttatgactgtatcataaattaacatgagctgcttagagtctaattgcaaaattgaaaagttagcataaattatccatcatataaatgaaaaataatttcagtttatttagtaaagaagtttttgtgtctaatgtgcaagggattttgctttcagcattgtaagatttaatagtaaaatatatgctgtaataattatgaaagcatacctacatctcttttaacttatggcatgacctaatccagaatttttttttcttttttggggg

SEQ ID NO: 96257 - DNA, 1051 bp, Homo sapiens
ggtttcaaaatgtgatgtttttacaagtttgtatataacctgacttatatgaatcatgttgaaagtggccgatgttaatattctgctattctgctgaggtttttgtatgtgttttttgtttgtttgtttgtttgtttttgagacggagtctcactctgtcgcccaggctggagtgcagtggagccatctcagctcactgcaacctctgcctcccgggtcaagctattctcctgcctcagcctcccaagtagctgggattacaggcgtgagccaccacacccggctaattttgtatttttagtagagacagggtttcgccatgttggcaaggctggtctcgaacttctgacctcagctgatccgcccaccttgccttctcaaagtgctgggattacaggcatgagccacgacgctcagcctctgctggttttttaaacaagtttattgagatataattcgtgtactgtaaaattaaccctattaaagtgtacagttcattcagtttttatatattcacaaagttatgcaactatcaccatatctaattatagaacattttcatctctccaaaaagaaaccccatacccattagcagtcccttccacattctccctcttccccagtcctcagcaaccactacttttctgtctctatagatttgcctattctggacatttcatatatgtgtaatcatatagtatgtggtcttttgcaactggatgctttatttagcataatgtttttggggttcatccatgttgtagcatgaatcagtacttcattccttttcatttctgaataatatgcgtttgaatggatatatgacgttttattcatcagttggtggatatttgggttgtttctgttttttggttattgtgagcatcactctgtaaacattcttggacaagtttttatgtagatgtatgttttcatatctcttggttatatgtctaggagcagaattgctgggtcatattggtaactatgtttaaccttttgagaaactgccaaacagttttctaaggtggctataccattttgcattctc

SEQ ID NO: 96258 - DNA, 1586 bp, Homo sapiens
atcttggctcactacaagccctgactcccgggttcacgccattctcctgcctcagcctcacgagtagctgggactacaagcacccaccaccacacccggctaattttttgtatttttagtagagacagggtttcaccgtgttagccaggatggtctcaatctcctgacctcttgatctgcccgcctcggcctcccaaagtgctgggattacaggcatgagccaccgggcctagcccaaaactgtcattttgaagcaacacttactagaattcatatagaaaaaaaaaactattaaaattcctctgcttagattctctaggtcttacaactttatcagctacctgtttacctagatcatattgctctagcatcctttttttttaaacccaaagaattcttcactgatcttgcttattttagaaatatttttagctttacttgtaagaaaggtactgctctttaaagattgaagagcataagatgaagactgaaatgtgggatcttactgccttttttctttcttaatcagtgacttttaaacctctatgaagatccagatctagaattctaggacaagtgcccttgtggttctacttactctacggtggtaattagcaatttagtaaccttaaggaagtattttgttgttagtttattgctctttttttcctctactaattttactttttttttcctttttactgtccatatttaacgtaagtatatcctttgtatctttttcttcccatactataacaagggtcttgaaactctttatctctgattattctactcctgcactttaaattgtaagtgatacaaatccaaagcatacaaactcaacaaaacaggagtcagagaatttactaaactcatcgaatgccaggtccagaagttaagaggcagccaggttcaggtctcagatggtgtaatccgagtcttatttcttctccacaggtattctgtagacagcttctttcatgttgccaggaaaaattggttactataaatcctgacttacttggtccttatggctcttgatcccgatagcagtgagccagtggcaaggatgatcatatggcatattctgaatgacccagcttaagtcacatgttcaacattgaactgtggccagggactggagtatagttcatgtctaggtcatgttctcactcctggggctggaagtggaacttaactgccaggcaaggctgctgacattgagtgatattattaccaggagaggtggaggaacaaggtattcaagagacaaaaataatagaggctagtaagtgtagttagtatacattgaacaaaaaacatgggcccatgtacaaaggaatgacatcagatcttagaatacattaaaactatgtaattctttgagttgcatggagcccacagtgctagagaagtacgtattttaagagatacagtggataatgataaatgataatggggctaaaagtaataaaacattagaaatatcgagttatagattaattggttcaagtgtaatgccaattctttaagcacacatcataagcagctgatacgaaaacatcagttttcacacattggtacca

SEQ ID NO: 96259 - DNA, 1027 bp, Homo sapiens
attgctatctccatctgttggtatgaagaagtaatgctcttgccagaataagcaagcttcttttaattttagcaaaaacagattaagaaataaggaattgtgctgttaattcattttctttgtgacaggtaaagtcagttggaagatgcaaaactgtcacaggaagttagctattacagacaaattgcctttttttaaggctttttgttagtaatactaaaagtgtcaaagagagtaatttaaaaatgatatattaaccatacctaaattatttatggcttgttctttaaggaattatagaaaaatatggttgtctcaactttttttcttcaacctgggatcaggcattgttgtgcaacaatattttaatagcgagaaatctcaaaaatcctgacagtctttgcatattcacagtttcatgggcttttgcatcattgcttctgaattgctaatgaagagctcaatatagcttctgatgcatttcagatattctgggtggtgactggctagagtgttactgacatcacaacatacagctgttgactttctattgtctgagtcctcctcggcaagtgctttagactgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggtatgtgactcaattcttttgctaaatttgtatagaatgtaatctgatacatgaagtattcatgttcacttagtaccataatttttgttagaggatgtgtgataaaattctactatattgaaagtgagagcattttaaaattgtctttgtttatttttgcaaaaatatatttgtttaggttggtggagtgaaaagtagagtcatttacttctcagctgtagcaccaatttcttctccccacccctcacatgtttgatatttcttgtaacttactgatagaatggtttacctgt

SEQ ID NO: 96260 - DNA, 1047 bp, Homo sapiens
aatggccttttatcaacgctgaatgtcattgctctttcttttgtctatttctgattcccaactgtgtaagtaattagggtcatgaaaatattaatagctattattaaaattagggtcttctatcagatgcattgcttcaccctaatgccaagagaatttcattatttttaagcctcagattttaagttttttcttgagaactataaaagaaaaaattaaaataagcaacacatactctcagttcttacttacaactgcttttatccatcctttgtcatattctgctttgctttttcatacttttgctcattttcatttcttctttttcctttaggattctgtttgtctgtgcgtctctatcttgccctccctctctttttctgtttgactttctgaatatttgtctctccctcttgatttatctcatctctccctccatcttccattctccctatccccacccatttttctccccctctccctctacatttgtctttcctactttgtctcagtctgtctcccttttttgttcatctacctggtgtttcagggtgtctctccctttctgactaaatctatcttaatctctctctctctctcttttatctttctacctccctccttcctcttttctttctctttctgtctttccttttctgcccctctgactctctctccctgtctgtttcagtatttcccattctctgtctcttgctttcccactgtgtcttggtctcttcctgtccctatctgttagtctctgtccatcattccctcttcctttgtctgtttctctatgtgcccttctttcttctccctctctcatccttttgctctttctctctacctttctgtctctgtgtgtctccctggctacacctctttcagtctctctgcctccgtccttccctctcttggcactctgctccctttcccaccctactcccagatctttctcttttctgtctaagcttcagtcacacacattcactctgcaaattttcattctcatacaggttttcagttcattggagccagatctgcact

SEQ ID NO: 96261 - DNA, 1043 bp, Homo sapiens
tctggttgtaggggacaaaaggtggaaatgaaacagaaccaacaaaatcatcatctctaaatcttgccatacttgcacagctgaccaaccctccttctgattaataactgagatctttaatacagttaatataatttattttttccaaaccgagttcctctaagccccagggtaccacaaaagtacttcaggaaatagagaaaagcctgaagcccagttaacactgctctactcatccccaccttctcacttgaacagagcaagtttatataataaatatatgtttccacagttttagttctccagaagcctatatatgaatcctacttaacccttattttatattttatatatgtatgttataaagtgacttggataatatatctgtcacattatataatatatattatgcaaatctgttacattatataatatatatgatgcaaatctgtcatcttataaatatgcatgtcattttattataatatacatagatataaaaagggggttgttagctaggattcatgtataggcttctagagaaccaagcagtccctaaaagcatgtgtaaactgtgaacatacacgtgtgagtaagcacatgtgattgctgcatttctgaggagaggatccttgggtttaataagattttcaagagggatcctttcatggcccaaaaataagtaagagtcactgctttatagtgtttataaatcattgctcaatatgctttgttaattttaaattttctctcttttcattttcaaatgcttagaaagttatgtagtacctctacaatagcagacacatcaacagagatcacatacagtttttggaagtagtttgaaaatatacagtgactgattactaggcacatcagatgtcagacttcagcttggggtcactagagagagagagcagaacatttttttattccagtactttcagaatgctggctaaaccacagctttccttaacaggtagaaaatgaatgacaaaaaaactgtatgcccccttgagctccaatgagacaattgtaaagaa

SEQ ID NO: 96262 - DNA, 1063 bp, Homo sapiens
tacaggcgcctgctaccacacctggctaatttttgtatttttagtagagttgaggtttcaccatgttggccaggctagtctcgaactcctgacctcaagtgatccacccacctcagcctcccaaagtgctgggattacaggcacgagccaccactcctagccctgtgtgtagtctttaaaagagattttacctcatgccaatcagatcatattacaccctgagttatttatttcagtcctgcatttagcacatacatggggagctctcagtataaccctggactatggtaggttcagaattaaggcaaaatacattttaccctcactagcactatattaggaggtcattaacttcaggtttagagttacattaatggccctgactttcttgcattgtctcttacctatatctgccaatatctaaacccctttagaatctcaccaggttatccccaggattatccaggatctcctcatgagctcaagaacagccgtttcatgatcttccagttttgtctttctctggcccactgcccactaccattttgctagtgtttgccacgaattagctcatgtccatgccaaaggttgtatctcttagtgttcccaacatgtttagtcttcagggtaccatattctctagaattttcttttttattttattattttatttatttttttgagacggagtctgactctatcacccaggctggagtacactggcacagtctcggctcactgcagtctccacctcccaggttcaagcgattctcatgcgtcagcctcccaagtagtgggattacaggcgcgcaccaccacacccagctaatttttgtatttttagtagagatgaggttttgccatgttggccaggctggtctcaatcttctgacctcaggtgatccgcccgcctcagcctcccaaagtcctgggattacaggcatgagccactgcgcctggccttctctagaattttctatgtaccagcaccatgccatcctcagagaagttaggcaagccattcacccgcttctgtggtgggcttggtcacctgggcaccagg

SEQ ID NO: 96263 - DNA, 1045 bp, Homo sapiens
agtgtttctgattatgatcttttttctctctctttatctatagatactatctcaattataaccctgactgcattgtagcttctcagtacatatcattttctttcctcttctctcttctgcttttaactaatcaatcctctcggcctcagtgacttattcaggttcacaaagctaatatatgttagaattcattgttactcagtgttctgactttcgtttaggaaaataatgtaataaaacaactgacagtaatatttttaatttctcagtttcatgtggagtgttccatttcccttggccattttgttaaaatggtttcttttgttttcattttaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggtaatgcttccctgtcattcagaaaaacatatttttcttacaaaatctcacctataaaaagcaagaagccagtgtcttaagtaacttcaccaccctctccctactttgcagctgtttgttttcggaatgaaccaattaacttttgtatgggttataattaaggaagacatggttttctttttttaattcagttcagtctgtctgtgactttaagacctacttctctttggcttttttaacttttgagctgtatttatcaattcctaaaatccatttatttatgtatttattgagatggagtctcactctgtcacccagactggagtgcagtggcgcgatcttggctcactgcaacctccgcctcccaggtccaagcaattctcctgcctcagcctcccaagtagctgggactacaggcttgcaggcacgtgctaccatgcccagctaatttttgtatttttaatagagatggggtttcgccatgttggccaagctggtct

SEQ ID NO: 96264 - DNA, 1154 bp, Homo sapiens
tggagaaaaagatttctaatgtcttctaaatacacatatattattctccagccattaccttctaccttgatctggctcggtccttaatgtttcttaagaattgccacaagtatatgtgcatcaaaatcactccatattctttttttaaatgtaaaaaaaacacacttatgtgttagcaatagggtcttgctatgttgccctggttggcctctgcctcctggactcaagcagtcatcctgcctgactcccaagtagctgggactacagctgggtaccactgtgcctggctcacatactttctatagctcttttctcactgtattgtgatcttttttttaatttggatgtatctagcacaaaattatatactccttgaaatcaagaattttgttcctgtctatattcaacattatttctggaacataacagacagtaggtcagtatcatgcagtaactgaatgtaaaaaagtttcaaactgtattaatttttttttcttaaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggg

SEQ ID NO: 96265 - DNA, 1036 bp, Homo sapiens
acgattctatggcttctcaaaaatttgtggctttattgtcatgcaagattttttctttagtaataaaacagagtaaaacttaattttaacataacctccccacattttcagtacagtagttttaattctattaagttctgtatctgtatgctgtatttttattgttttttattaatattgaatgagttcaactttttaaaacttatgatacattttccatagtatatttttataattatttctaggatttggtactctttctactgaacttgggtcatatgcacatatggtagttcttttaagcacatttacttttcacggtgctttcttgtgctgcgtaaagatgttggctacatcttgtagatgtagaaatgcttttgcatacttaccgtttgtacttctttggataattttcatgtacatcaccagtgggatgggatgatcctgtatcttcatttattataaggaataactataaaccagatagtttgtgactttctccacatacttttcgttagaatctaagagttaggcctttgagtatttaactctgtgctttatggctcgaaagattaaatgttaaaaacaaattagtgattgtgtttagtttattgatttttaaaatagctctcccacctcagagaactttgtatttttcatttattccagtagaaattagcatcctggcatccattatttttactgccctgaccttaactagacatggaacattttaattcattatcttccttacaattgccactaatctttactattacctagaaaagtactgagaattcgtaacctcttcaaggtgttttgagtctggttgaaagggtgtaaccattataatttttcttcataacaattattaattacaaagagaaaattattcctattttttaaatgtcagattttcttagttgagtgatatttaattggttatttttgtgctaatacatatataactcataaggattgctctgtttttttcagttctccaaattctagtagctggtaactctgacaacgtatt

SEQ ID NO: 96266 - DNA, 1031 bp, Homo sapiens
actcacctgaatcttaaattgtatcttaaggtcacttggcttggagcttagttaacaaatgcataaatccagcagggtatggtagttcacacctgtaattccagcactttaggaggccaaggcggactgctcagttgaggtcaggaggttgagaccatcctggccacccagtgaaaccctgtctctactaaaaatacaaaaattagctgggcatggtggcaaacgcctgtaatcccagctacttgggaggctgaggcaggagaattacttgaacctgggaggcggaagttgcagtgatccaatatcacgccactgcactccagcctgggcgacagagtgagactcagtctcaaaaaacaaaaaagcaaaatcctttcttagcagtaccttgatttgtgtttgattaaataaccagtggatgggaatcttgggtgccatctttagaattctgtctacctcaggtagaatttaatccacaataaagttttttaaaatatattaattgcactggactaagattctgaagatatggggttctgtttgactttagtaactaattctggactgtgaggtctttaagaccaggaactatgtcttattcatcttcatagctctagtgcctagcacagtacctggtgtacagcaggaacctaaaacatgtttgttaaatgaagtcaaattaagataattttacttctctgtatcttcctttatcttttcctcattttcatcaaagcctcctcgtagattaaaagtgagataaatacatgtgtaagtctatgaatattctcaagcattacgataggaacaatatacagcacccccattttatagacttttttttaaattagcatttgttagattaagtaatttttcttaatctcattgctaataagcagaggcagcacattggttttctgacatggtcagttcctaacctttaataatcgattacatttatgacacactttagagttttcaaagcccctttgttagctacgctttcactgaatcctttcaagaatcctgtg

SEQ ID NO: 96267 - DNA, 1487 bp, Homo sapiens
aagttggaattattcccattctttctattgctataattttcaaaactgcaaatgtttgtgttccttcttaacaaaggccttcagtagtgtttaatgatatatttaacttgcacatttcatctactgttatacatggcagaaactataaagaaacttagaaactctttctagggggcttttggatatgccctagatttctgaaatgtagtgttaattataaatacttctctttagtcaagctcaaagttaaagctagttcggagccttgcagtgtgtgaagaatctccaccaccccctgcaccagagatatcacaggagaaccaggtaaaaaagcaaaacaaatgttatttcaagacatggtggaactggagaatttttgtatatgatttaagttgtgtttgttatatttgttttattttgactaaatgaaacttattcaataatacttggcacccaagagatatatgaaaagttagaaaacctctttgcttcaatctaaggcttagagcaattattactcttctggaagaacttaggaatcatgtaattaattaggaatgtggctttaagaaagttataaattaatttttataaagttaaaaaatgttggtcgggtgcagtggctcacgcctgtaatcccagcactttgggaagccgaggtgggcacatcacgaggtcaggagatcgagaccatcctggctaacacggtgaaaccccatctctactaaaaaaaatacaaaaaaattagccgggcatggtggtgggcgcctgtagtcccagctactcgggaggctgaggcaggaaaatggtgtgaacccaggaggcggagcttgcagtgagcccagatcgcaccactgcactccaacctgggcgacagagcgagactccatctcaaaaaaaaatatatatatatattaaggtagcatttccagtgaatataattgtggtgaaatttgcccttttagttttaccttttagaaatttctcagatacttaatgcttgtttgtaaagagaccagccaagacttcttcttgataggttatttaacgtaacctgaatgcatggtgaaaccaattttcatattagcttggctctttaatagttatctagtatttctaatttctcacatatctattcttgtaaaatttagaacagtgaggtttaggcaaaccatttagtttgcattctttttaatgctatgactacttttctgttaatctcagctatgggttgatctctgtctcatgttacatctgtatatttatgcataaatatttttggatcctttaccaatgtttatcttgtgataactttgcctagtggctagttgtacttaataagagtttgagcaacttaaaatgctcctttatcccaaaaaacagtttccaaggaatttgggcaattttgtggttatttaagaagccatgactgatccatgacatgtacatcttttttataaagtaaatatcattatacatttggtgat

SEQ ID NO: 96268 - DNA, 2207 bp, Homo sapiens
gtattttgaaagcaagcctgtagtaatagacctgacaaaaatcaaattctttcacaactaaaatttctatctacctccaaattattgcctccattatattcatatctgaactaagctgtcttaatttgctacaaatgtagttaattatgtaaatcatttaaatttttcacccacggaggcattttgaacatgaggttgtggtgagtatataaaaggatctttaaagaatttagaggaaattaaacagacacatgtgagaggttaatttttttttaagaatgtgcgtggatatgcagttatataaactcatgtcatgcacattatatgggaatagaaacatcgtggtcacctgatttcattgtaacttttcctactttgtcgaatttttttcaatgtggggcatcttgttttatttaagatatatatacatcatgtgtaaaagggaatgggacttgttttcaaacaactttatactgggtttttgtgttgttgttttttagattccagtcaagaatacactgattcaactggcatagatctacatgaatttttagtaaatacattaaaaaacaatcccaggtaaaaattaaatttataaggtttccattgcttctagagtaccataattttgctatatatgttttcattattgagttagagtaatagaataagattgcagatatttgaagtacaccagaaacattttagttttttagggcaaagatgttgttggtctagtatatgcaaatatataaatatctttttgcattatgcatgtcaccatgatgtatgaattttgggaaatatagaatcactaagatatttaggctcttgattgagttagacatataccattaatcatgagaaaaaagaaaaataggtatctcaccatagtgcactcaaccaaataagaacttagtgtattcacttatgagtttttgaagtttttaaatgcaaagtttttgttccttcttgctgagtttataaatcatcaacccaaagatttttgaggtgtttatttgagtcagtactttaattgtgaaatctttcattttgtcagattactaaatgaataatttttaactttttggcaactcataagcactttgagacattctccctgcaaaaatggctacccacaaattatctgaccaacactttcatggagtgaaagatgccaaggtgaagaaatcttcctctagatgttagctttccagagtagtagctttccagagttgacatacgttgaaataaaaatgatgtcactagatatgggcacacggaagataagagagttgtttatctcttacacagtcttgcttcaagataacttgtttttattcaggatgtattgtattcagtactatcttgattttctgtttcgtatttaatatcaaccccaaagagaattaccaaaatgaagtggtctctataataggagctgaaggattataggtaaggatttagagagaaggtaggcaactctccttgactttttttcctccagttcaagtttattcctcagtagtcccaacagaaagataaatttatgagtctattgaacagctctaactatgtgccaagcattgtgctaaacattgtagatatgaaaaggtattacatagaagctctgaccctacagtattcactgtctctgtactagaaaaagacacctgataattaaaataaaacaaatgtaaaagaggtttacaggtgctgtaatagccagagaagggccacaacctctgaaaggattttggaatatgtcactgaaaaggtagtgcctaacctgaatcttgaattaagagtgttttatattggagctgtctatacagagagacatgggaagggcatttgagatagagactagaggattgccaaggcatagttatgtgagaggaagtgttatattcaaggaaagataggcatgtggcaagttattctagaaagtgatggtaaaggtcgggcgcagtggctcacgcttgtaatcccagcactttgggaggccgaggcgggtggatcacgaggtcaggagatcgagaccatcctggctaacacagtgaaaccctgtctctactaaaaatataaaaaattagctgggtgtggtggcgggtgcctgtagtcccagctgcgtgggaggctgaggcaggggaatggtgtaaacccgggaggcagagcttgcagtgagtagagatgcgccactgcac

SEQ ID NO: 96269 - DNA, 1029 bp, Homo sapiens
ttgttctctgaaatatcttctaaaagtcatttttattggaggtaatatttaagtcattttatttcttatctgttgcagacatttaaccaagagcatatgaaacattgggtggagggtggtcaaacagaagcattactattttcttctttttttatttgccactggtataacatcggttccctctttctctaaaattacttctggaataatgactagaacaatagtaactaaaagattgttagcccttcattttagcttttagtttattagcttgtttttattacttctttaataattaacagcatgtatcagttcattttaaaggttacacgatagaagttttagtttgtgcctacttttagatggttttggctcacctgctaaaagatcaatataccttgagaaaagtagtttacctgttagtttgagtctcatatgtagggcccctataaaggattagtaacctttaacttatgaccattataaaaatatctaacctcaattacagatttgaaaatttgaaagcttggataagctacaatgtggaataaaaggcagaaggtataaatcttaagaccttaggaaagttgtcattcttgtttttttaacaagtgctactaaaagcagggtatcttttttaaaataagtgacccagataatctaaaaatcctctgcaatctatagatgtacgtcttaaggggagagaaagcctaaatttctatcaattgctagtaaaattgttagattctgttatttcatgcagatagtggaaatttcagtggcagtgcatttcactgaagaacaattgaaatattcttatacctgctctttagctcaaacacagaaaatcaatttaaatgtactgttttatgaactccaaataagttgcctcctttcttgtttgtttgtttgtttgtttgtttttgagacggagtttcactcttgttgcccaggctggagtgcaatggcacaatctcggctcacagcaacctccgcctcccgggttcaagcaattctcctacctcagcc

SEQ ID NO: 96270 - DNA, 2166 bp, Homo sapiens
aaaacgagattctcatacttctactatcatatactgagtagaaggtggtgccagttactgagatgggatatactaaggagaagcaggtttggaaaccaaactgaatattgctataaattttgttaaaatgtaattctgtgttcagctttggatttgaaatcaccaagtagacatgtttttctgttgattttttttaaacaaatataaaaatgtaagttaaatatttaatgaatgatgggggaaatgttattacttagttttatgaaacttttgcagtgtaggaggagaatcaaatgcaggtctgatgtgtagactttcaggtgaccaaagcaggggctaccagttcttctattgaaattgagaataatctgcatagtgtttattttagggaatcattaacctcttggcctcgttttcttgatctgtaaactttggaagacaaaactgaatgatttgtaaagctgcttttagctttaagtttctgtaagttacattttttttttcacatgtatatgaaatttccaattagcacaggaaaattctagagccatgttatgggtgtgtgagcagggaggtcctttggggagtgataccattaatttgttgcagctaagagaactaaataagaccctagtgatctaaaggagcacatacaggtactccctagagtccttatttattttatatgttggaggtttttggttcacttagatttttatgggaaaatttaaaaatatataatggcagtttatagaatgggttgaaatatcctcttcttctaaattagcgatataattaatacttctctgccatagtcccatctacatactagtattagattcccatagaagtattcctgttgttactggcattgcatgttctttagaatactgtttctatggagttcagcatgataacaaagtcctgagcctaactaaagatgtctgttcttctgcttcctctccactttattgaatgaggaaataaaaactaaaatgcttttattatccacacattcacagagcaaactctaatatagtaatactaagcagatcaaaatacatttaagttccttcgttgtgtgtaagcaaaaaaaaaaaaaatgcatttaagaatagccacatgttgattattgttaaagttgggtgatgggtacatcaaaattcattacactattctctacattagtgtatgtgtgaaaacttctgtaataaaaagttaaactacaaaaatcatcttttgttttaaaacattaataaatattctagcatcaagattggggtaatactgaatgtatagtttttagggggtgaaatttagctgtataaatcataggctgttgacatttgtgattacttcattgctaagttttacatataagagtcttcatactttgtttcagggacagaatgatgctgctgaaattggaacaagaaattttagatttcattggtaataatgagtaagtcctgacattcaacaagaaaagaaattgtcatcaccattctccttgacttactaagttggtttttcttgtgcttctaggtctccacgtaaaaaattccccccaatgacatcttaccataggatgctattacacagagtagccgcttactttggattagaccacaatgttgatcagagtgggaagtctgtcatagtaaacaaaactagcaatacaagaatgtaagtgtcaagagatgtaactacatattatatatctaaataataatactttatctttctatattacctttcatctgaggttttccacatgttttaacagtctaattaagttttatgataaccttatgtgataggactgaaaaacacatttagtttactgggaacaaaatgcaacagcctggactcaaatatggcatatgaatgaggactggggcatatggtaaaaaaataaaaatccagaggacatagtatcagtgatgtttgacaaccactcttagggatttttaaaattaatttagacagctgtagccagccttagtcaaatttaaaaaaaaaaaaaaaaacacaagagagagagcagactttgtccgtgacaccctcacatttagttaatcttctgtcagtttaccgttctttccaaaagcctctgaatttactccttttctctcacaattcttaagaaagtgggactgttggtta

SEQ ID NO: 96271 - DNA, 1031 bp, Homo sapiens
tttgcttaagccatttgaacctcggtttgttcaataatatttatatcagtaactaacttctgagtgtttactgttttatgtgttactgacattttcatttcatcttcagaacaaccctaagaagtaggtacactatataattcccattttacaaataaagaaaccgggaaagagaaaggttaagtaacttgtgcaagtcataaagcagctaaagtgctaaagctcaacctttgaatccaagcggactgactccagagccaacattgtatttgatatggcctctcaaccataacatggaatagttagtattttctcatgagattattgtgaggactaaatgagactgcataagcatctatggatggcactaaaaagtggtaacttattttatttcttttcataaaatgttatgtttaacttctttgctaatattgttcattatcttttcctgttcctttgtttttgtttttgttttttaagacctgatcagaaatttaatgaacatattaaggatgataaaggtgaagactttcagaaacgttatatcctcaagagagataactctagctttgacaaagatgataaccaggtaatctagaacaattgtaggatttgtataggtgcaagacatactataccagtagttcatttgcctaaaaattatcctcttttctgtagatgagaatacgtttgaaagatgacagaagaagcaaatctatagaagaaagagaagaagagtaccagagagccagagaccgaatattttcccaagatgtacgtactaacttacttaggtcttcatgttagagtatattctaattacgttgtagggtctcagtctcccttttatctattgatcacatttatttttaatcacatttgttgcacataaggtcatcttttagaaatattgagatcagttttgcttgtgttattaatagtttataaaatactacattgcagtagttatataaaattttacaaaagttggaagcaggtagactacaggagtcattaaaagaatgttctcc

SEQ ID NO: 96272 - DNA, 1035 bp, Homo sapiens
agaaattgctccactgtctacaaaatcatatactctagatgctacttgttagttgactttctttgacaaataatttatttcttcttttgaaataaagctaattgattttgtaggttaatatctgttttcttcttcataagtgattatataagataggctttctaaatggctaattattttatgcatatatgccagaagagaatcaatttgttttttgtcaacatctactaagcatctgtcctgtaatatgtgttaatcagctacagatagaaatttcctctgtgttaaaaaaaaaaaaaaaagaagattaaataacactaaaatccagattgtaagtgaagaacttattcattcaacaaattttattgagcacctgtagtaagtgctatcctaggcactggagaacatattcatggacagttaaaataatttatccccaaaacaaccctatatggtagatactatcattgtttttattttacagataaggaacctgagattccaggaggctaaaatagagatcacacagctagaaaatggcagagttgggatttcaacccaggtctgctgaactccaagcctatactaaatgtccttctctctagtttataagatagatgaggtatctgcccttgatgaatagccaagtaatgacaacagggtatgtggtttatatagagacatgaaggtgtaatagatgacacagcagataagcaccaaaaccagaactggggaagggatgggagagttagcttccaagaagtaaccttacaggagtgaagagttccaagtcgagagtcagtatgtacagaggcccagaggtaagggagaacttgacacactttaggaattaaaagatttaagaggaggccaggcacagtgactcacacctgtaatcccaccactatgggagcactgaggtgggtggatcacttgagctcaggagttcaagaccagcctgagcaacatggcaaaaccccatctctacaaaaaattagccaggcatgatggtgcacgtctgtagtcccagctact

SEQ ID NO: 96273 - DNA, 1535 bp, Homo sapiens
tgttaaaagtaagcataggatctccaaaccagaaaaaaaattccattattatttatttgtgtacccttatcaccatttttaacttacattattacacatgatttttgttgtcatcattggtttacagatggcattacgttatatttgacaaaagctcaactttttgtatctattcttttttctagtccctgtgttcccaagagaattacattattgacaaaaggtgagggaatttttaacatctgttttggtaattgtctgactgatgctaataaaaattaaaatgtcctattaaaatgccaacagactccaagacgaggatgccagtagtacccagcagaggcgccagatatttaggtattggaagcatgttttcaatacagtattgaaaaattaaagcatttttttctttactttttgttcccctgcattagcttttcaaggttttatttctaaattacagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtataaatatctacacaaaactgtgcagtcaagtcattagttttcctaatgttgtctcaggtccttatttatcagatggcttctaattatcctaaaatataaaatcactatcaatagtaccttgaccacctccggagcacttaaggggtaatatgtttcttgacatgaggattcactctctgtcctggacacagatttacaaccatcaattaccataaaaattcttctctattgtgacataaacttaattaggtaggttcaatgaaacattatctcttgattgaatgcccataggtaattggaaattctttattacttattcgtagttggtagaaggcatggtttctcacctaggattatttaacactgattgcattttcagctaatactatcaattattgattgcattttttatgataaagtccttcattttccattaaaaaaattaaattgctgaggagattttgaggaatttaaaaaacaaaaacaagtaacttacaaatgactgaaaatttcaataatctcctcattctactacctgcttccttggagttcattggctcataacatttcttcttttcatttcctctaactggcttcaatactaaagaagctcatatgtttttaggatccttgaagatctttatttttatcccaaaataagcgtgaaagtcaaaaatgggtgtttccctgtccgggcgcagtggctcatgcctgtaatcccaacactttgggatgccgaggcaggcagatcacctgaggtcaggagttcaagaccaccctggccaacatggcaaaaccccatctctactaaaaatatttaaaaatcagctgggcgtaatagc

SEQ ID NO: 96274 - DNA, 1634 bp, Homo sapiens
ctgtatagtgtatcatagttgtttcattcattaaagattaattatccatcccagagtcaattctcttattcaaaacctaattaactatatacataagatgcaaatcattttctttctttgtctcggccaccttttttagccattatgctaaaaatcagtgacattttcagtccctgtataatagaaaatggaataaattgcagggatgaaggcatttaaaaatcagttatcaaattagttcagtaagaaataaattttaagttaacaccagtataagtacttggaatatatttcatggtatctctgtcccttgattagataaaatattcaaagttgattttacattttgggaaaatgctatgctagtaaaatgagaaattagattctgcaattaaatttgacagttatttgtcttaatacagaatttatcatttatttcttacactgaatctttctgtgttcttatagataaggggtttctggtattaaagattttgggcattttgctgtactaaattctttttcctgggggaaaattatctatatattcctaggtgttaatctaaaaggtaaaatgtacataactttgtccttttgggaatgtgggtaatgtgctttttgtggctgtctgtggctggtgttgttataaatgtgcttaaattgcatgctttggcagtgatttctctgacaacttacgtaatcagtttgctgtattaaacttgttcgttatggggagggtaagcaaacgtggacagtaaattaaaaagagccaatgcttttatgtagtaactgcatgttatgcaatgtaaattttattgttgttttaaaaacctgtgttttttatatgaggtttaaaaaatccatatttttcattactcctcttctaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggttggtatccagaaaaaggtgtttcaggaattatctgaaaatttaaggatacttattaaatgtattttctgaatatgtgtagtcagctttttattattcatgaataattaacattttccaagaactttataacaaaaacacttaatgctagggaagtttcaaagacatttatatcagaaagcatttttttccccttgtacatctgtgatatcatctatgccaaatactagcccaattataatttttaaaaaagtttatttcctagaaatgagacaactacccacgaaagagctttgtttgatataacaattttttttaaccaacattgatttttttggatgatacaacaattttatacttgggaaaatcggatacattttatgaaaaaggactgaataagcagctttttttcattatataatggaggggggaaaaataattatctttcagaatgtgttgattttctactgaggaaaaggtaaaggacatctt

SEQ ID NO: 96275 - DNA, 1138 bp, Homo sapiens
agtaccccataataagaaatgcagtaaaacatttgaatatttaagtgagggaaataaagactattaatagcctcatgtcagagcaggcatttcccaacctaaggaaatctttgttttcaaatattagggtttttttttaattgtggttaaaggattttggacatgctttgtaaattgttagtaaaaggacctattttccacctgtattctaagttatttttttccctctttttgaatttttcaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggtgcacatatccatgattacataatgctaagttgacttgcctttacatatttgggactaaattcgctaattataattgagatagcctaagtatctcttagaactttaatattctgccactagtgatattccactcactactcataggaaaagagataacttcaaaggtttttcccctgataaatactgaaaatatgttggaaagaagggaattgttttaatcatatgagcctgtctggtgagtattttatccctatttcacaacagcaagaaatggacaacaggagaaataaaaacaaaactgtgattgttcattggcccaatgagcaaagtgagttgttttaagattccacagattaagcagttagaagaaactgagataggctgctcaggttctgcaaggtactcttcatccattctacctaccctatgaaagacaaagcagttctgagttagaattcccaaaagtactctcagtaatattttgagtttgtaaaaatgtttagaatttacacattcattttcacattcagtctttttcccctacagttgtattatccatctttggggaacttgactataccagtatgaactcctatttttattctaacttttttttttttttttgagatggagtcttgctctgtcaccccggctggagtgcagtgaagtgatcttggcttactgcaagctccgcctcctgggttcacaccattctcctgcctcagcctcccaagtagctggga

SEQ ID NO: 96276 - DNA, 2193 bp, Homo sapiens
cagatcacctgaggtcaggagttcgagcccagcctggcccaaatggtgaaacccccgtctctactaaaaatacaaaaattagtcgggtgtggtggtatgcacctatagtctcagctactcaggaggctgaggcaggagaatcacttgaacccgggaggttgcagtgagccgagatcaggccactccactccagcctgggtaacagagtgagactccatctcaaaaaaaaaaaaaattaaataaataagtgagtatcccttaaaaaaaaaaaaagaagaagtatgatgataaacttgaactggagaaatttcattaattttgctcacaaatgatatcatttgtattgcagggttgaagaacatacaagtttaattacattatttaatggtgtgaaagtcataaaaaataattgtacttctggcaattaagactcctaatactgggcaaggcagttttttaaaaagaagaacttacaagttatggatatacttctaagaccatagaaatcagttaatgtatgtagaagagattgcctaaaactatttccacagactcccatattcccttcccaatcccatttggttacatacaatgagctcgcataaaacttcttccctggctttctctgccttggcttcagtcagcttggtcccaaagagtttcctctttattatgctgtcatgtagttgtctttgcagtgccatgtattttaccaggagctttaaaacactaattttcatttggtttcatttttatttaaatttcagtggaaataatgttaatctggcaacttttaaaaactctgggatttatctgtgattatatatttcagattattatctcttagaactttgtctgatttagtgataagagacagttctaaatgaagatgtaggccacctagtttagaaacagatgctttaatgagctataattggaattcttgggatattcatcaaatttcataacttatttttctagcattgctccaagttcaggtaatgcatcatcagatccagaaacagagactcaaaagtgattctcaatgaataccttttgcacaatctgaaataatttatcaatgagattgcaaataaccaaacaaaataatgctatgatttccaaagccttcagaagggctacttttcttagacctaacgtaaaaccaattactttaggtggatgttgttttgcagccagttgcaattcaagtaggaaaaggatgtgctaaggctctttcttccctaaatggtgtcagaatttcactttcatcaatcaatcttctagcccacagtttttttcattactctctgaaattcgggaagacattaattcatacccttggtgctcatagtactttccttaatcccccagctgactaaaacttttgtttcatctgacacataggagatcaagtcatctgaaagttatgtcttaatggttatctgacttaataacacatcaagtagcttgttcttgagagttctaaagctatggcacctcatgtagtataatatgtactatcatctgttaggaagctcacttatttctagccatgagttttgtgaggaaccagaggctacttcatagatctttcagcttttactgaaagatttttttaatgctttaattatagatttttttgctttcttttaagcttatctaagcttttgttttttagaaaccgttgtgttgattttgtggtaaaagtgcaactcaaatcattattatctatctatgatgtcatagacaaacaatgtctatcttagttgacatagaagttctctatttaaattattgcctgaacaatcttaattccattagtttatctaacatttttaaagtattgtctctgaagacaacatgcagagatattgttcagaaggagatgcatgaatatacattttaactaagagttttcatcaagtgagattccctgggttcctcatctacttgcttatgtggctgtctacaagtcacttaatttaccttagtctaactgccttctgtaaagtgggttgctatagtctttaagccaatatgtatattaccgtttttgtaataaacagtataaatatgagaaaattaaacagatgcaattttagtttgtggatgaccagctgtattcccaagattgaaaagtgattacaactttaaaaaaaaaaaaaaaaacacctgtgtttgagtgcccct

SEQ ID NO: 96277 - DNA, 1512 bp, Homo sapiens
actagtttctcagctcctaacatgtactatcttaatagaaatgtgttaattacaaagaaagtgtttatcttccttatataaaagaggtgtttgtgtgtgtgtgcatgtgtctgtatgtatatatgtgtttgttgttccttaggctattattcttaatagttcccaccatatatatatatttgggtttttttttttttttttagacggagtctccctctggcgcccaggctggagtgcagtggcgcgacctcggctcactgcaagctccgcctcttggattcacgccattctcctgtctcagcctcccgagtagctgggctacaggcgcccgccaccatgcccggctaattttttgtattttttagtagagacggggtttcaccatgttagccaggatggtctcaatctcctgacctcgtgatccgcccgcctcggcctcccaaagtgctgggatatatttttttacccagagcttttttcttataaaattgctaaaagttaggggctttggtcccaaaagactgcttaatttcaccttatcagtagggtaattggaatagttattgtgtaagttattactgtctgatagtaagaatgaagtttttcatttataatttagtgttatactgcaaaatagggcaaccctttcataaaaccaggaaataatgagaagtagttttgcttttactgacttaacccgggggtctttgttaaataataggattcaaaatgcctaagtcacctgttcccgttaatctataataaagaaatattttattgcaaaaaattattctcctaattatgtaataaattcaggcgtacatgtttttgaaagttttactgtattagagttgcttcactttgtattgtttttgttgtttcctatgttgttatattttaaatgactttataaatgtagttaaagctattgccaaaaaagtgtaaatttccgttttatgcaattcttctaacgttttattctgacattaacattgtttgccaacctgttattctttagcctgttcatcctctgcagtcctcttcacagcctgttcagtactctacagccccttacccatccccgttcctgccagtctcacccacccagcaatactctgtggtactatatctctattcacctcctgcgttgtttctgtgggtggatgtgtgatgaatgctcaagagtgtcattaatgtaatatgatcttttgtgattttttttgggtcaggtttacatatgtatctaaacaaagtatttctaattcatactagaaataatttattccataaaatattggttatagtggcttattatggtgattgtttaaccttttcctgctttttcataacgaaagaattttcaggttgattattctagtcctaagatgttttagcaactttctcattgaggccactgcaggatctgtgctgccctgggatggcagctttcatctgggtttaggcattctattttctccccaacactgtagctccagtagacccagtaccagt

SEQ ID NO: 96278 - DNA, 2169 bp, Homo sapiens
tggaataagaaaatgacttttttccaaggtgactctgagagtggtatacaattatggtacttctgttaacaatatttgatcatataacattgaaattacagttcataggtacattttttttccttttgacaccattcactgaattaggctaatagtgttaaagtgtcaaagtgacagttggggaagagaaaaaccatatattttcaatcattaaatcaggcatctcctttcagtcctttatcttctccatagccgtaatttactttggaaaatccagcagatctagaaactgcagacatgtcaactttgatatgatgactcaattgccacaattttgtaagtcatttttttcagtgttgaccttttaacaaaatgtggtatattttattgccagtctgtggtttcttgggaacagggagcattttaaccctatataatcatttcagtgatatttttctggaacaataagagctggtccttatcctgttgaattagagaaatgtttgtcagatagcacataaatcataacccttgtcttggtagggcaccatttagtaaaagcataggaaactgtcatttgaattacatttgtcaaattatctgacttccagaacagattgaaaaacacaagggaagaatggaatgtatggccaaattatttttgaaagattagagaaaggactgtagtggattttatgtatttaatttctgcaaataattttcgtggttagggatacaaaaatgcatagaatttgcattttgccttctaggaagaggggagatagtttaaagcaaatactaattagtaccttgctcattgcttggtctttgaagtcctttcagaaaatattaattgtataatatgaacttggccaatttcacttctacattctaatgttgctttcatcttcatttaaataaatgtcttcattttttaatgtgaaatgttgtaccctactcttttctgcatgctgtgcattcccactagatatattttttaaataatttataatttataatattcaacaatagagttgtcatttttttgaagctttaccctattacataattgctgttgttgatatatataatttccataatgtgtactattgcatcttatttaaaaataggaagtatttttctttgataagtttggcctatgtgtagaaggcttactaatttttgacttcttccttttttagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacaggtatattgctttttaaccttttctttcttgtggaaacctctcacttaagatcagttttaacttcaaagaacttatttttaaattctcatgaagagaatttgtgagagtatataaacaaagcatatactcatctttccgcctctggagattttcacgcacatgctaagcaaccatatgacaggtaaatgctccagttggttggtaaagtatgtgagctttgaggggttttttttctgagaggtatgggtttctaaaaaactaacctaagggaaacacaataaagtgtaaatccactgtaaaagtaaaatggtaagactgggcacagtggctcacgcctgtaatcccagcactttgtgaggctgaggctgactcacaaggctgggcttgagcctaggagttggagaccagcctgggcaatgtagcgaaacttttgaatatttaactaacttttaatttctgaaacagaccccacttggttatgatgtagtatccttcttatatattgtgggattcagtttgctaatatttgttaaagatttttgcatctatgttcatgaaggatattggtctgcagtttgcttgtaatatttttggttgtactatccggatggtagtagccttaaaatgagttgggcattgttccctcctcctttattttctgatg

SEQ ID NO: 96279 - DNA, 1029 bp, Homo sapiens
ttggtctcggttcttaccaacgatataatttaatttttttttccaaacgatgatgttgttgcatacctgtggaaagcaaaatgattctgtgaaactatacttttagttttgcaaccatttgataacttcaaagattatcaatgtattatatctttagtcttagctttccagataacccagaatcatatggttccaagttgattaagctttgttaccagcagactatggtaggatcctgatgaacgacactatggaagaaacttgttaggataaacagtcttcaatgtgtgcatattgttgacagaatttgaaggcacaaatttaagagtaactagggtgtaaaaggcgagcaaagaaaagtcagcactactgggtaagcaggtgagggggcttattgataggagagtcggctatgtcaaatagggactcaaggcacaaagtcaatttctttactgacaactttcaatccaagtaataggaattttgtatttgtaaattactaggtagtggctctggctattcttgttttttcattgatttctgtgagcatttcttagtatgtattgtgtgattcagcatagattcagacattgtataatacctacaaatccacctatttcccttttcccttctccattaacctgccgccactgaaatctggagccaaatatatctggtaagtacccacagatttccttgagttgtatagactcttccatggaatagttctttaaatagctgtgagcaataaactctgtgtgactgtttttgttagaattggtttttgtatatgtatatgtttatttcaggcacaggagtgagagaagaggggatgagagatgagaagggataatcaagtgtgatggcaattgcatctccttccaaatacacccatggggctggctttagttgaacttgcccacctactaaaatagtgccacagacagaagcccaagattataagcttgaggttttaacaatttggtcttgtagatgcctagttacaaataaatttggctttagtaaaat

SEQ ID NO: 96280 - DNA, 1075 bp, Homo sapiens
gttgcagtgagctgagattacgccactgcattccgggctaggtgacaaagagagactcagtcacaaaaaaagagagaactccaaagaccactttcattcatctcaacaaggagagaatagcctagttgggaagatagggaatagcctagttgggaagataaaatacacgtattttgtgtattttatctgaacacatgtaaacaaattggtgatagtgtacagactagtaactgagaggatcatgaaatacagcaatgaacaggttaaggacttgatttgaagccttctgggaagttagaaacctttagctcttcaaagaaaatgatgggcgtaaattggttaagatgacattctgagaatgaagaaggatataagcaaaggtgcaagcatattccatataatttcagaaaattgaaattaaagtgtgaaatgtgaggttgtcaaatgttgttgagcaccaagtgtatgtccacttttgagaaccctttaccatagaacacatctacaaaagaaagaaaagatacttcatgaaaactgggctttccatcttcattttctctcacatcccccatgcttctgaccccttctcctccatccttgagcctaggcacatgagcctgcccttcgtctgtttccccatagttaagcattaaacaggattgacaccaagcctgaagccttcctttctcaaagactctggttctactatctaatccaatacagagttcagcatgtaagatctgcccttaatctttgggggcttacatctagtaagagaaatgtcatttttaaacaaattacagcctaattagtatagtttttttttaattagctggatattgaaaatattccagagctaaggtagtggtcataatttttacaccatacatttttacattttaacattattttctcattgtatttaatgtaattctcacattggctgaatattgtaggaagtattgctctggccagcaatcaataatagtcatctgctttaaagtgtggctcctactacatttgataaacaagctaggtagtgataaactgttatctaaaaaataagccagaaaag

SEQ ID NO: 96281 - DNA, 1109 bp, Homo sapiens
tacaaaaagcttctcaatttgtgatgtgctgaaatacacccacaatattgagggtgctgtactgaatcatagttaacatgtgcagtccacttcttcctttccttctactgctgctatcacagtactatcctgattctcctttctcagaagtattgatactctctagggttatttcctatgccttctgtcattactcttccagctgttcctgtttactccaaattacctttatgataagtgagatgtttaggcctacagagtccatcttaatgcctgtttaaacacacaatacttgtagtgtgatgcactagggcttcaacctggttttcttagttaatagtaaaattttattcagaaatgtaaaattactactgttatcctagtgttcagaaacaccaactagttgctaaaatattctgactatagcatcctaaattctgattttcagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccaggtaagatggttttgttcattatcattttgaaacgttacatttttgttacctaagattgacttataaggcttgaatttgaaatcccgtcagccagattaataaaagaatttgggccaggcgcggtggctctcccctgtaatcccagcactttttgggaggctgaggcacggggatcacccagtttcagaccagcctgaccaacatggtgaaatcccatctctactaaaaatacaaaatcagctgggtgtagtggcacatgcaaaaatacaaaatcagccgggtatggtggtagcatgcatcccagctactcaggaggctgaggcaggagaatcgcctgaacccaggtgagtggaggttgtagtgagccaagatcgtgccattgcactccagcctgggcaacaagagtgtaactctgtctcaaaaaaaaaagacggaggaaaaaaagaatcagtgtttaaatattatttgctaacttctgcgtattcaaa

SEQ ID NO: 96282 - DNA, 1048 bp, Homo sapiens
ctcacgcctgtaattccagcacttagggaggctgagccaggcggatcacaaggtcaggagatcgagaacatcctggctaacacagggaaacctcatctctactaaaaatacaaaaaattagctgggcatggtggcgggtgcctgtagtcccagctacaggctgggactgaggcaggaggctcaggaggctgaggcgggagaatggcgtgaacctgggaggcagagcttgcagtgagctgtgattgcgccactgcactccagcctgggcaacagagtgagactccgtctcaaaaaaaaagaaaaaaaagaaaccatctgttaccagtgtttattttggggagttgcagatcacatgcttctataatgtttgaattattttctaacaagtacgtatatgtaatcaggaagaataaaaaataagcctgcccaaaatgctgacccattttcttgacgtattgtaattgcagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggtaagtgcacatgaaactagtcacaacttcagagaatttaagacatccattcccagtcacttggtaatttatcttggtaatattgcctttctattttccatagagctgcatcttcacctacactcaggcatgtctatttgtgaccatataccctcctaaccttaatgtatcattgctaattaataattattaattcagtaattacttctgtttagtaattacatgatcacattaaaatcactttaacttattcttagaatccattcctctatagtaataatacacagttttctacattttttcggtattttaatttctacttagagtaatatatatcaaaagtttatccaggccgggcgcagtggcttacgcctgcaatcccagcactttgggaggccaatgcggaaggatcacttgaggccactcaagaccctgt

SEQ ID NO: 96283 - DNA, 1029 bp, Homo sapiens
aaaccaacaggtaggaaagacaactaacctcctaggctttgttgcagaacatcatagctccctcagagtgtaaggggcaaccctgagcccacctgttggcactgcccaagaagagctctgtgcctcagccagttggtttacacagattatcactggctccatcaggagcagagcaaaggagaagatggtgtgctgcttggcagagcagtaattctctagtgccacccaaagacaaggcagtggctagggattggggcactcttgctaatgaaggaccgtcagcaagtgatcggtcataatgaaggacaggaatgccactgccacaggcagaatccagaaggcctgggactgattttcttctgccagagtgcaaaacccaaactaaaggtgttttggtgttaatttgttaaacatccaaagtgtgtttttcagcattattaacgttgtttctcaactatttgtgggttttcagggtcagcctggcagcaggcatggaaaccgaggaaggagacaagctaaaaaagctgcatccacagaccttggagcaggagaaacaggtatgtctctgaggggcaactagatgtgggtctgcaaactggtgacagtctaaaaatacaccacagcacagaaatgggttttcctcttcctagaatcctgcaaaaagtcataatttttgccatctctgatttagggttcttggatatgttcctatgaccttgtgtcatttgagatgtgagagtatatatggtaagatgcaggtaggtttaggagggacagaggggccacagggaaatgtgtgagaggaacaagtagagtgaaactcttagcctcttagttctttgagaaagggtttgtccttacatccatgtgggagaaagtctgagtgaacaaatatgttgcctctctgtggtaaagtaccttcaagtttatattttaactttctactcagcagccttgtggtgtggttagggcaagtgcttttattttattttacaatggaaatgtgaagttcagaaaaatgtttgagat

SEQ ID NO: 96284 - DNA, 1023 bp, Homo sapiens
atgcctgtaatcctctcactttgggaggctgaggcaggtggattgcctgaactcaggagttcgagaccagcctggccaatatggtgaaactccatccgtctctactgaaaacacaaaaaattagctgggcatggtggcgggcgcttgtaatcccagctacttgggaagctgaggcaggagaatcgcttgaacctgggaggtggaggttgcagtgagccgagatcacaccgctgcactccagcctgggagacagagtcagactccatctcccaaaaaaaaaaaaaaaaaaaaaaaaaaagatggccctaacagttttaattttgtgtattcgaatggtcatttcccatgtcatatttgggtctgcagtgcttttttacccaacttttttggtaacaggaatgtattgattctgtaccttttctattctagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatg

SEQ ID NO: 96285 - DNA, 1076 bp, Homo sapiens
gttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgaaggaggcaggggttcgagaggcggccgggacacccctccggcctaccttcatcctcttgtatacctcagccgccggcccgccctccccgagacgcgggctcctgtcggctcgcacaattgccactactaccccgcgccccagggacggctgcgactccgccgccagatcccccagaggggccatgcagaccctcagcgccctgctccttcaggccccgggcgcccccagcctttcctcagtgtctgcgaggcccgggctgccggcccgtggctgttcagcgcctccccggttcgtttgagatacagtgggcctggccccaccgctgcgtctcccggcagccgggccggaggcaccgtctggccctggtctccaaagcgccccgaggcccgccgaaatctccccgctcggggcgacggacgcggccagcaggccccagccgcccagccccgctcgtcgccccgagcctctcccctgcgcagccagacccccgcgaccctctccctgacgtccctctctgtcaccaaggaccctctttgtgctgcttgaacgcccgtttcgttactgctgtttagatggaggtaggaacgggccattaggcaagcagttgggttgtaattagttgtggactgtcgggaagaaagctgtgtcatcgataagcaacaaagagaaaccacctgatgttcacggttactggtgttagtacgttcctgaaacgtaaacttttgagctgaatagaggtttaatttttctttatggcagtcttggtaggggatctagtgtgaaataatgtaagtttaaaaaaaatccattagtttcaaagaaaatagacgttcagtccttggtttcttccctttgttgtcttcttaggctaaaatctacacgactttgag

SEQ ID NO: 96286 - DNA, 1056 bp, Homo sapiens
agactgttagcaatctcacaaaggagtctctgtctgtcccttgacctgttccaaaatccagctagcttttttagagctttagccagttaatccccaagactaagtaggattagtgtcactctaggagtatgtagatactggactcatgaaaccaaaacacttacagattgcttagagctttcttcataactctgaagtcagaacttgtgattttcttaggtctaagatctcagtaataatataccaacttaatggaaaatttgaaagatgtctttatagttggaagacgtgatctcaagagtacactttggttcatagaactgttcaagtgggaaacgttttaggcaagtggtctttagttagtgacattttcatggatgaattaaagaatattgtagagttgatgttaggagacgagagattactactacttcagctaacaaattaatatgattttcaaagtattgtggctgtgtaaagtaagtgaaacaaaacgatattcatttaatacttgggaaggtagaataatctgacgagactgaagtaaaggtatctgttcactggctaatgttgctaggtaggtaggccaaactttgttaatgatagacgccattttctgccttttttggtgaatgtagaccacagaagcctttaggttttgagcagttgagatttattttacatcggaaagactggctgtatgagggtctgcaactctttgcttctgagttcgtgttgctctctttaagtgccttcgcttaggatactgccgatacaaaggatatgctgttttctcctaaaatcttaggcccacctaactttatagttgataatttgattaaaaataagaaatgaaagataccagagttagcaatcagtcatcccactcagtagtattaggaaagttgtcattaagcattgagtaattccattcagctttccaccactgctgttcaagcagctgctgccaccactaggctgagtctaggacagacactgccagtagggttgagacatctgggaccctaatcacatggtacagtataggtgagggag

SEQ ID NO: 96287 - DNA, 1028 bp, Homo sapiens
gtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacaggtaagaaggaacagaactgttgtttccgtaaatggtacgtcaggaattggatttttttttttgagatggagtctcgttctgtcgcccaggctggagtgcagtggtgtgatctcagctcaagtgcagcctccgcctcccaggttcaagtgattctcctgccccagcctcccaagtagctgggattacaggcacctgccaccacactgagctgatttttgtatttttagtagagacagggtttcaccatgttggccaggctggtctcaaactcctgacctcaggtgatctgcccgcctcggcctcccaaagtgctgagattacaggtgtgagccaccgcacccttcctaacattggaatatttttggagcccctctgtatattcaggaaactgccatgccaaaaatcttaaaaggtagtaagtactgtctttgtcacctgtttttgtaaatagc

SEQ ID NO: 96288 - DNA, 1042 bp, Homo sapiens
ctgttaagcattctagcacatggttcatttttctcaccatgtatacctaactgtgtagcatgtctttggagttctaatataggaaggttaccatttcattcaagccaaatacgtgactgccatgttgtccctgaagggtaatatatttaccctcatgactaaagacctgtaattatgcttgccttcaaattacactgactacattattatcttaacagaccattggcaatgatttatagattgatagacatttgaccattaaccatgccattaataaactcgtctagacttacattttatgaagttttattcttttaactgcagttttcgttgcattcaaaataatatctggggcagattatcaagtttttggatcataaaactttttctttaattcagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggtaagtcttaagtttccagacattcgtgaaactgtttttctgtgcacagtagctttagattactaccagactgtgcacacaaaaatagattttagtgactcatagactaccaatcctgagcttccttttattagaaattgtaaatgaattaaaatagttaagattaaaattgagttgatttttttgaagtgatttttattcatattttgttaatttatgacttttatcagcattcaaaaagcagcttttaaagattccctagaaaataagctaagtactagtacctactactagtactaagtacctactagtagtaactactagtactaagtacctagtagttcttctgtagtcacaggcacacttttttgcaacattgaaaggatttaggcacatcataaagcttagtttgcaacaattgcttttataattcatcagctgcaatacatattaaaaccatcccgccaggtgtggctca

SEQ ID NO: 96289 - DNA, 1113 bp, Homo sapiens
ggaagtcctcttcattcttaattgtttataaataagtcattcttgaagattttgcgaaggatttaaaattgaccctttctgtcaagctgactggagctttggatagtctctagggtgctaagttacaaatgttttagtagataatgtcggcttgcataaataacaaaggaaagattagttggcaaatggtcacactcctctaatgcttattaagtcactaagaaacacaatggaaatggaatatatgatttggctggctggcttgacttagagatcagatgaagctaaactaccaaagactgctaaagtctagtactgtgttagtagatataatggtctcccatggactttccttactttagatggcattaaaagtaaaacttagttgcctgtactgatggaagttggaaacagcttgtattactattgtttttattttatgacatcttccccttgctccctctttttcgtatcagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactga

SEQ ID NO: 96290 - DNA, 1006 bp, Homo sapiens
aggattcacagggatgactgtggagccatgcgtggctgaaggctccaccacccccatcctggccaaatgtgagggtctatggaggaagcaccaggggcagcactggcctctaactgcctcccatttctggcatacacactccttcacgcattcatttagccatcaacactgcgtgctttctgtgtgctgagcacagaggcgcatggatgagcacataggtgatgcattcccaacaacatacaggcacaggcaccccccgccccctacacacacacacacacacacacacactttctcattccatctccatcttttcctttggaaaatcctgctttggaatatttggtttagtgataaggggagaaacaaaaaagcgtacttctgagaggctgttagtcttgacagtgcttaggttctaatgaccctatttaactactattttcaggacacggtcgatttcctctctcttgatttgtcttatgaatgccaaaatgaggcaagtctgcggcagaagctgagtaaattgcaggtaatttgagcccttttccacattaatgatgaatgcagcgaaggtttcagagagcagattagacatttaatgctttggctactgcataaactgaacttccatcaacagcagagaccggctgagttgtgtctggggagatttccattgcaagcatccctagagaacatcggatgttaggcagtctttcctagaagggatacaagggttagcttgttaaggtgaatatttacatagatcctctgcttgcttgtgtagaaatctgccgagaattgagattctggggttcattctgagttttaaaaaggcaactcatcaatgggggtgatggttccataacgataagcgtccacttaacaccactgaactatacatttaatggttatgatggtaatttttttttttgagatggagtcttcctcggttgcccaggctggggtgcagtggcgtgatcttggctcactgcagcctccacctccc

SEQ ID NO: 96291 - DNA, 1014 bp, Homo sapiens
gaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgctt

SEQ ID NO: 96292 - DNA, 1050 bp, Homo sapiens
ctcatgaattttacttcttagtaaactccagttccataaagccttcccctttctacagaggaaaagttgttatatttcagaatttttgcttgctgttgcttcattcctaatttatgcttttagtttctgttggcaagcattctcagaggtggtgaagcataagaagatgaagaaaagaccttcatactttgaaatcttaatagctttaagaaacatatttcttataatctattttattaggtttctctccttatggataaaataaggcatgctttaatacaagtgatatgacttgttatttcaggcttatgctagaacattgcggaccttacgtcaccagatgtactttcggacggcttgacatttatctaatctgtacattatctcgttgtatatgtggcagagatttacccaaggactgacagtacgagttgctaggataatttgaatgtgtttttttgttgcagaagaggacgagtcagcattaaagaggagcgagcttgttaactggtacttgaaggaaatcgaatcagagatagactctgaagaagaacttataaataaaaaaagaatcatagagaaagttattcatcgactcacacactatgtaggtgcagaagtgcgcgtgctctggtatcagggagggagggagttcatgccctgtatctgcaggttcactagtgaaattttttttgacctttgtttgttttgaatcattggagtgtagtcagaagtatgagttgtaaaataagagagaatgaacagcaggtaaatgacttatttcctctgctgaaacaagcagaatttaggttaaatctcagaaggtgggattgaagtcttactagttaggtgttttaagcttctgtttcccatcctcatatttgcccttggtcgtactgctgtcacctactttctatgtttcattttcctcacattcttagttcccaccttacccaacccaatagtcaatcttccatcttacttgcttggcgaaaccccaaacttggttaaatataacttttttttttttttgtatccttatctaagcag

SEQ ID NO: 96293 - DNA, 1005 bp, Homo sapiens
cctgacctcaggtgatgtgcttcccttggccttgcaaagtgctgggattacaggtgtgagccactgcacctagccggtttattttgtttttcatttttattttttggcagaggagatcatgtgggaatgtatgcttgttttaaaattagtgttaaggctggatgtggtggcccacacctgtaatcccagcacttgggagaccaagacaggaggatcagttgagtccggtagttcgagaccagcctgggcagcatagcaagaccctgtctctaaaacaaataataataataatttttaaaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagcttattgtcaggcaaagctttgtaggtccttctttttaacattctgggcctattttaataattttgggacctgataacatatgaagcagcacatacaaatgtttttacaaatgcaaaattactattcccttacaatggttctgtttaaaacagctggacccctagggtatattttaacagtaattaattgagcctagaaatctatactatcaaaaggccattgcagactagaaatggagtaaaatcctcatgtagt

SEQ ID NO: 96294 - DNA, 1597 bp, Homo sapiens
gtgctgggattatagacatgagccaccgtgcctggcctagttcttatgggatgtatatgtctttggattcatatgatatgtatatatgtttatatttctacaagtacatacctaggagtggaattgttgggtcataggttaatgcatgtttttctgccaaacagttgtgtcaatttctgttttcaccgctgtgaatgagagttgttctaccttcttgacaacacttgatattgtcagtcattttagccattctggtgaatttatagtgctatttctgtgtgtgtaagagagagaatgagagagggtgtttgtgagaaaaccaaagcaacactgtgagagtgtgtgtgtttgtgagaaaaccaaaatacatactactgtgatttcattgggagaaaatctgtttggtatatcaaaaaaagtagcttaattacttcatcattattggtttaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtgagatacttgttcatgtgactgttttggagttagggaccaaaacattttctgagatgtcatgtggtagaagtacacctgctgttggctaatagtctatggtagcaaaacggaaaaagcagatactgaattctattcactgtttacaagttaaaatgaaattaaatagttgatataaaatatatatacttggctgggcacggtggctctcgcctataattccagcactttgggaggctgagataggtggatcacaaggtcaggagtttgagaccaccctggccaatatggtgaaaccccttctctactaaaaatgcaaaaattagccaggcgtggtggcggctgcctgtagccccagctacctgggaggctgaggcaggagaatcacttgaacccgggaggcggaggttgcagtgagctgagattgtgccactgcactccagcctgggtgacagagcgagactctgtctcaaaaaatacatagatatttgaaagactaaaagaaaaggcagcaaaatggtgataatagacataaatcccctgggttttacccttatttgtattgttgttttgcttctgaattgaaaacattttttcaagcacattagaacagaaaaatactagaaattttatttattttgagatggggtctcattctgtcacccaggcttgaatgccttggtacactcatggcactgcagccttaacttcctgggctcaagcagtccttctccctatcctctctaatagctgggacatatgcccacgccaccactcctggctaattttttgagaattttttctagagacaggatctcgccatattgcccagactggtagaattttttattttgtatataatactgcaagtggactttcagattgtgaaatctttatatctctgatccctcacgttcctcccaagttagtttttgtctttactagtagagtttatacatttgcttctaatttatttgaaaattcttatatgctatgtataactgtatgcat

SEQ ID NO: 96295 - DNA, 1043 bp, Homo sapiens
aaaaatactcattctggttgagattttcacactgttggctaacttgacttctggaaggtgttactaggtattgatcatttatcatcttcacttgattattcatgagattgcagttggctctcactgtcccaaagaaatttaatcatttaaaactaaggattatgggtgattcttgtgtaaaaaagagcatctgttctccattactgcatactgatatactgatccctctgtaaccttggcatgcttccttaatatggtgaattccttgctctgaaaagctgaggatcctttagatataaagtttattgaaacagcttttttttccctgcaaagagtgtgagttaattaattgagcctcaaatactgagcattaatttatttaatgagcactgacatcctgaggtgtaaaagacattacatcttgttccattgcttcagcttgttaagcagcttttagaaatggtcatttgcttaaatactaagccttttttcaggttcataaaattagtaacatggaattcacaagcctccttaatattagtttcttttgaaagacattacaatagtaatttattgtcactggcttctcaaagtttcaaccctctcaggttccctaaatgtttccacctggaaggctcttaaacttaggtttaccgtagctctcatcaaatagaaatgtttctctaacttgagtgatgatctgaaacagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtatcagagtcactttgatatgatgagagcagagataaacagatttgttgcatgtttttaatctttggtatgggacatactagaattcactgcaaatacatttttatgtaactgttgaatgctcatacgaccatggaattcttccctttaaagagcttggtaagcatttgag

SEQ ID NO: 96296 - DNA, 1050 bp, Homo sapiens
tcctgcctcagccacctgagtagctgggattacacatgtgcaccaccatgcccagctagtttttttgtagagacagggagggtctcagtttgtcgccctgactggtctcaaactcttgacctcaagctcttctctcacatcagtctcccaaagtgttgggattacaagtgtgagccactgcactttaccctactattgtttttaaagccaatcaattccttcaggtatagttttagagtggggcaatggtatacatttaaacgtttgattttaaatccacctgttcccaaactttcatcagaaacttggtacccattaatacttctttaagtggtatattagagcttgtttttggcgataaatcatttcttattgcctgggatagtctggagaagatattgctgtgactatcaaagtgatttttttgttttgaattaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatgataaatataaattactgttttacagtgattgatgcattgtattggactaactctgttctggacccaggattcttacctggacataaacccccaaatgcttgg

SEQ ID NO: 96297 - DNA, 1079 bp, Homo sapiens
tttgtgccccttttaggaatattttgtacataagcataatactgacaatttcattcctgctggtttaacttcataattttattttggcaatcttttaccagcacatattagatcaactttggttttttattaatttcccatattcaattgtgtataccacagcttgattctttagactcctgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaatcgagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggattacaggcatgtaacaccatgcgtggctaatttttatat

SEQ ID NO: 96298 - DNA, 1029 bp, Homo sapiens
cttgctctgtcgcccaggctggagtgcagtggtgcaaccttggctcactgcaacctctgcctcccgggttcaagcaattctcctgcctcagcctcccgagtatctgggattacaggtgcacaccaccacacctggctaatttttgtattttcagtagagacggggtttcaccatgttggccaggctggtctcgaactcttgacctcatgatcagcccacctcagccttccaaagtgctgggattacaggtgtgagcccccacactcggccgttgttgttttttaagagacagggtctcactctgtcacctaacctggagtacagtggcaatcatggctcactgtaacctcaaatgcccggccttagtgaagcgttcttcctgccttggcctcccaaagtgctgggattacaagtgtgagccatgcatccagcttgaaagacagcttcttaggcttgatttgtttggttacagggtgtgtgttgtattgatgaatttgataagatggacgtgcgggatcaagttgctattcatgaagctatggaacagcagaccatatccatcactaaagcaggagtgaaggtatgtgttatctacttctgttctgctgcatcgtccatagccttgttgattaatgtagtactagagaagttcacctggataaaattcattacttcagtgtgtaatgctgttcattaaaatggaaaatacagccctgagaattatttattgaaactataaatgttgtttagagtactgtgtaaatgtattgccatgataatagaggaaaatgtccatgaacaaagcttttattttctttgataaagcatgctccaattataacaaaaataaccaaagatcaacagattgattatatatgtatatatttatttatattaacagagtatttaaatgaaaataagtatgacagtataaccaacactagggagaatctaaactttaaaagctacagattcaagtagcttttaagcagtacacaattgtaaattgaaaagacaactctttccctg

SEQ ID NO: 96299 - DNA, 1010 bp, Homo sapiens
ttaaaaaaaattgatatttttatcaggtattaactctgaaaatacaaaaattagccaggcgtgatggcccacacctgtaatcctagctactcgggaggctgaggcacgagaatcgcctgaacctaggaggtggaggttgcagtgagctgagattgtgacactgcactccagtctggtgacagagcgagaccctctcaaaaaaaaaaaagaaaagccgagggagagaaaccttcccatttagtctgtggcatgtgtcttcatgaattgcttaagctctcaaatgttctttcagtaatttaaactcttctgctggttttcctgggaagggtgctgtataatcacatattaatgagtctttatgtgataaccttgaacaggcacgtggaggagttcagccccagagctgtctacaccagtggtaaagcgtccagtgctgctggcttaacagcagctgttgtgagagatgaagaatctcatgagtttgtcattgaggctggagctttgatgttggctgataatgtaagaacattttacactcttcagtataaagaagtcagaatacccctaccctatcagtaaaggcctataagttaccattaaaaagatgtccttaaaaacagcattctcagctgggcgcggtggctcacacctttgtcccagtactttgggaagccgaggtgggtggatcacctgaggtcaggagttcgagaccagcctggccaacatggcgaaaacccattttctctactaaaaatacaaaaattagccgggcatggtggcgggtgcttgtggtcccagctactcaagaggctgaggtgggaggatcactgagcccaggaggtggaggctgcattgagccaagattgtgccactgcactccagcctgggtgacagagcgagactctgtctcaaaaaaaccaaaacaaaaaaaacccagcattctttagtaaataattcatagttttcttcatctagaatttaaaattgtgatagttgatcagcatgtcctg

SEQ ID NO: 96300 - DNA, 1249 bp, Homo sapiens
ctcatcaatgttgagagcacgggatggggttaagatttgatgagttttaaaaccaaatcttttgacgtatgcctttctgatcttgaaaaaaagtcttatttgatgtcttacataaaagctcaatgcttttaagtgcagtggtacaaattatccacgctgttttttgttttaaagtttcatagttcctctgttattcttctggaggaaatacaaataaaaagatttagtaatctgggaagtaaacttctgagaatgatgaacccctggcagtatcattcagttaacttgattctgtgtcataaatgggagtttggaaaatagttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgtttttttttaaacctttacagtcaataaattgtgaggttgacttcccatgctatgttgtgtttgtaatgaagtttcttctcctttatgctcttttgactgcttctatactaatgattcttcctttgttctctaccattagtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggtaagaattccatccatttgtaccataaacttgaaatcaaaataatgattataaacagccacaggtgatttctgaaagcacataaatcagactgtgaaagtttttagtgggtctgaaagaggtcatttacaaaaggacaggtacatgatttcacttatacgaggtacctgtaatgtgcaaattcatagagacacggtaggatagaggttatcagtggctgggggaatgggagaaatgagttatttaatggataaagttgctatttgggatgatgacaaagttctggaaagggatagtggtgacagttatacaacataatgtacttactgccactgaacttatacactgaaaaatggttaaaatgataagttttattatgtatttttatcacaattttatttttttaaggaaaagttattttgtcatcttatttcctggccttatgac

SEQ ID NO: 96301 - DNA, 1211 bp, Homo sapiens
cccaggccagagtgcagtggcacgatcttggctcactgcaccctccacctcccgggttcaaacaattctcctgcctcggctccccgagtagctgggattacaggcgcccgccaccacgactggctagtttttgtatttttagtagaggtggggtttcgccatgttggccaggatggtcttgatctcttgacctcatgatccgcccaccttggtctcccaaagtgctgggattacaggtgtgagtcactgcgcccagcccgttctgttttataattttaattttcatttttttggcatcctttagttcatttatatattttgttctggatacatatacgtcatataatttaggattgggcacgttgactaaattattcttataggagagtccaaagaataccttgtctcttgaattttttttttaaacataaattatctttgaataccctctcactaaaatggaaagattcttagttaagagatgaatgtttactaatgggacatttgtctttaaacaggattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggtatttatttaacatctgtttagatcagagtccatctatgataataattcacttctaggcccttgcaatagcttatttagataatgttcaactcaatttttatgtaagttaagcatcatcaaaatgactacaaagttaagcccaaaactgttcatgtaaattataattgttagtatatacatttgttttaactttcagtaacttggaagttccttaagactgacaagatgtatttgtcaaagaataaatggtaactaggtggtggtggttgtcattatgaactggagttaagaaaacttaaagaaatagcaacttgttagtgtaagatttccatttgctgcatagaaaggaaagcatgaataggacaggctagcttggaagcaatgaggattatcatgattgaagtaaaggagccaaattggagatcatctgagagatgattt

SEQ ID NO: 96302 - DNA, 1069 bp, Homo sapiens
gtgggataggagagaactgaaagagggtcctaaacctagagtagataatagaagtgtcctacacagttaagttctaaggtttagttgtaaccagatgaaattccttaatctcggctgttggtaggtatgtaaagggaaggaggccttggtaaacctctaaggtatcagctgacttttttgtttttcagagtttacccttacctgtgtcgggccttgaaaacattcgtcaaagaccgtaaagagatccctcttgccaaggatttttatgttgcattccaagacctgcctaccagacacaagtaagaaacccttctctggaaaaaaaggaattcaccaaatggtataagtaccacttagctgacagtcagaaaacttgagaggttgccttgatctgctattagctggctatttaacattatacaaatcacttttacctccctgagcctcagtttccttgtctgtgaagtcttttggcttaggttttctacctaaatcatgcaaaaaataggtttgttgctgtaaaattactttttcataattgataatcacaataattataaaacaagtacttataaaattgatgctgtaaaataccaggaggaaaaaatagtggtttgcattcagattttgtagaaggttgacttttgtaggagttatacccacttatccagaaagtttagtgttggagaaatgtattttcctatggagatgggattagatgtaaagggagtgaagcaaatttttaggattatcacattttagggcgccttttagggaaatttgggagaaaattgatcaagggagaaaatatgaaattctagaaattcctgaatctctggaaatttttgttggtttaaatgcataattttcaaacacccctttggcagttattttaagaataaatttactggataaaattgaagtgatattttgaaaagttaaactactgaaattataaaattaccaaattacttcacataaaatgggtttgtaaaggaagtgtttctgaactttgagtacaaaattttttctcatgataggattattatgtaacacatgcttttttttt

SEQ ID NO: 96303 - DNA, 1198 bp, Homo sapiens
gggctgtgaaacacctcatttccatgtattcttatttctgttctgcttcttaaatccctgactaatttgttagtttgcaaattccctacagaaatggaatcattgggtttgagactgaatttcttgatttaacattttccaatcttaattatacatgacagtagtaaaagaagagttagttgttgggtttttttgttagttagcagttaaacctcacaatcatggtggaaggcaaggaggagcaagtcactgatgtcttacgtggatggcatcaggcaaagagagcttgtgcagaggaactcctctttttaaaaccatcagatctcgtgagacttactatcagagaacagcaggggaaagacttgtccccatgcttcaattaactcccaccaggtgcctcccacaacatgtggaaattcaagtcgagatttgggtggggacacagccaaaccatatcagaagggaggagtaacttgccccaagttacagaactgccaaacatgggcctgtctgagcctagttgttggactttaaccaatgttctgaattatcattcaggttctttgtactgcctgtgtccttaatctagttgactcgaatgtacctgcaggtttcagagcagcgatggagaaattaaatacttgcaattagcagaggaactgattcgtcctgagagaaacacattggttgtgagttttgtggacctggaacaatttaaccagcaactttccaccaccattcaagaggagttctataggtatgggcatattaatcttctttactttgaataggggttgaaatccgggaagccagctcttcttggactgtaagtgttcacttgtgtagcagaaggtcagctttcacagttatttcccactgagaagaggcgctttgatactgccagtggtcgttttagtactgctctgaacttcatgtaggcctttgtagagccgaacgtttttttgttgttgtgttttgtttgtttgtttgtttgtttgttttttgagacggagtcttgctctgtcacacctaggccgaaatgcagtggcgcgatcttggctcactgcaacctctgcctcccgggttcaagcgattcttctgcgtcagcctcccgaatagctgggattacaggcgcccaccatcacgcccggctaattatttacattttttaatagagacggggtgtcaccatgttggt

SEQ ID NO: 96304 - DNA, 1247 bp, Homo sapiens
tactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaattgtagtttttgtgtaactttgtggccaactgattttgtaagtggtgctaggcattcataatttggtaaaagaaaaaatacacaactagtttatataaataaagactaatatgttgtcaacatgtattcatttcaggatattagtttagatgggcgtagggatagagctcttaaagttgacagcttgggtcggttgacagagttcatttcacatgggttaaaatatattgcagaattttgtttgatttttaactggaatggtactgatacttagtgaatgtcagtaaaatccagtcccatcttatccgtcaaaaagaaatttttgtgtaagaattagttagaaacactttccctctagattattacaaatgttgatgctaatgttaattttacatgaccacaaatattggggaggaacaaaacataacatatttttgtacaggaagaaaaaattacatgcagaaaaatatgagggtcaaaaagttaggaagttacccctggaccacgaacatctgcccattatgtttgaaagtt

SEQ ID NO: 96305 - DNA, 1733 bp, Homo sapiens
tgggtattgttgatgctgctcatttccagatcatgctttgagtgataagggaatcaatattgtgcctgctcccaagactaagacatacatacatatcacagtcatagggaataatcaaataattttcacaatgaatgatcagattgtcctataccatcagcaaatgggtgttaattatgtagtataaatagtaactgtaaaaagagagaaaatggagtttgctagagtcaccataaaagaaaattcaaactgagatgtactttaaggacaaagtaggatatatagacaacagagatggagttctagacaggaagcagagtaagtaaagagcaagaactacacaagaaaacaaaaataagacaagttagtattaagaagtgagaaatataggttaggattaacttacgaaagcataaaggttttagggtttttttggtcattttatgtcttactacagtagtcatttgggaaccattgtaagtttctgagcaaggatgtattataggaatattagtgatgtgaaagatgagtcgaactagagtcaaaaagactggacaggaggaaaaggcactgaggatattaaggctggactggatattagctggactgagctaatggctcttaatatcctcagtgccttttcctcctgtccagtcttcctgactctagctcgactcatctttcacatcacaaatattcctataaatgactactgtagtcaaatggaatacgtatgttactttattggtagagtttcacttagtttgagtcaggttttaataaaattgagaagaactcactatcttggtcataattgaatatatttttaaatattgagaagacacctcaggatcttgcattcccccagggttctcatgaacctctcttattaatttacatttggtacggcttttattgcacgaccgtaggagtttataatgaacttgctgtccaagataatgctcaaacagatggttcatcagaggtccttccagccctgtaatatgaaaataataccactggaatccaactaaataaaagtttgtatttaaatccctatttatccaaaattgaaatcagtgtttgctctctatttcttttattaacttcacagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtaaaaagtattttatgcacctagatggacttaatttcaaatgtttgggccctttaaaaaaaaaattcttcaatttaaacatacaaacttaagtttctatgaacatatatataaagatttaccagttagatgatccatttaattggttggaaaaatctacactcagaatactgcttctggatccaaatcatttgggggctcaactaattaacctctattgtgctagtaaatttaccacattgtgaacagtccaactgtattttgttgttgtttttgtttcctttatactgacatcccgaatgtctcaagaaatacagcatgtgtttcttttaacagtttatttgggaaacagtatgagggtagtgtgtaagaggttggattcagcaacatccagatagcctgagttcaaatcccagctctgctccttctctgtgtgggccttgtgcaggttatttaattctgtgcctcagt

SEQ ID NO: 96306 - DNA, 1037 bp, Homo sapiens
tacacaagtatctgcaattgtattgttgtaatggttaaaataaaaatacatggtttttattcatttattgtcaaataccaaaatcttacttagaacattagtatgctgcacaaacattgctatgtctcactttatgggttggttgcctttaaaaaaaacagaccattcacaagtaagttgtttcactaattgttaagaaacatttttcttttatggaattcctacaaattaaaacatctgctcactaaggatttccggtgaaattcctttatatgatcatatatagtcattgtattccagcatgcctttttgccttgtatttattcgtgtcctttcgtcttctctccaattattagaatttaaaaatgttgaaagcaagaattgttaggtttccacagtgcctagcccacagagttagtgcttagtaattaagtacgttgatttaattagattttattactgtcttctagacatcaactagtcaggcagtcttccgtctccagtctggcatctgccatctcttccgagaaactttaattaacaaaggttttgtggaaatccaaactcctaaaattatttcaggtatgcttcaaaatatttctcttaatttttaaaaataaatttgctctccccagagttgctttatattaataaaatttttaacttgagaatcccaagtgtccattaaggtttattgccatgagactactattttgaagaccatcttatatagcaacaatcatatatcaccaaccttaataagtacattttcttattccaggagtccttttgtgataatgattgtaatgtgaggcagtaacacacaaagcaagattcttgttacagaacttacaccaggaactactttcattatatagatttcttttgaaattagtattgcagttttgttttgtataaactgcattgtaaaatcagtaaatactaatgatgggaaaatttccttaattcttgttgcccaggctggagtgcagtgttgtgaattcggctcaccgaacctccacctcccaggttcaagc

SEQ ID NO: 96307 - DNA, 1039 bp, Homo sapiens
atcattaaaatatttgtctgacccaaaacaatttttagatttaaacattaaggaaactaatattattagtatggtttataacttaaatgataaagaaggcctttttcctgttcatttaggtatcttaaggtaagggtaagtatagtaatgataaattaaatatataaggtatttgtacattccttgtcagttgaaaataaggttgttatatatttgcattgaaattaacatatgttgcattcattttatgtactatagtttagaagcatttaatttgagatagatttaatatataattaccctattaaacatacttttcttttgttatatacattctgtaatcttactgataagttggatcattgttgatttttaccttaaccgtcaaattcttacacacgtgtagaagtcagttgtagtaatcaatatgtaatggggaaacagttttaaaatgagtctataaaaaaccgattttgtttctctttagatgtgttctacgcaagagtgtcttgttttgatcaggagaagaaaaaataccattaccatttcttattttaactatattgtgttgttctctcatgtaatgataatgctttttgaaggaggaagaaatgtagaaagacaacccagcagtaggtacaaaaagtttctcagactctgatgcagtctgcttagtactcttcctctgctaaattaactgactaacctgggcctgaggacattattttcctctgagcaaagtcagagagtttacaggatactaatcttacccgtttgtcttgttccaaccagcagagatagctagtctgaattcgctcgcacaatgtgattgtttgcagtaatgggtattcttgctagtaagatacataatcaaaatagttgaagatgtattttgaaatatttgtttttctttcttgttatttacttttaaagaacatcttatatttagtaattcctttttgtttaattcttttcccatctacccctgtgattggtggttttcaaattaaaccatttaaaagctagaatcttctagaaa

SEQ ID NO: 96308 - DNA, 1062 bp, Homo sapiens
agagaagtttcgtaattttgtagtataagagattatcctggcaatatagttttaatgccaatatattgaaacttacatgacatttcagtggttttgcagtgttttcccaagtatggtacctttaccactgaaggtacacagtgatttctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctcaaaaaaaaaaaaaaaggaaaaagaaattctgcgtaaatctggccaggcatggtggctc

SEQ ID NO: 96309 - DNA, 1070 bp, Homo sapiens
ttagacaacagagtcattgatcttagggtatgcctcatttatttattaagtgaagcaattatgccgcattagagaggggcagggataccatacctgtctcaggcttataaagctaaatggtatttgcctgactgtaagtatgataatacaggaaacaatttccttttctgactgacccttcccctaaaaagaattgcaggcaacaggagcggttaaatactagttaacaggatattgactttctttgttttaaaatgacaaatgaatttgaagccagtaaatgatcttgcttccaggtgatatcttttttagacaagttattcagcaagtagaaacataacctttaatatcactacaaagttatgaaaaaaattacatgcacatttgagatcaaccaggtggagatgagtaattaatgcttcaatcctttgaatttgattggagcaccaaattaaaaatatagaagcagttggctctggtggtttatgcagtagtctcatgggtcttctgtttccctttctggtttggttgcaagtgaaagagagtttagtggtttcatcattgttgtagtaaaaccattgcatctttcttaatattttgaccacatcttccttttttacttaaatattctactcaagctcaaattttttgtcaccttaagagttcttcttggctattctaccatcatgtgagtctacccttattatatactcatgttattcctaattatttgctttttgtcttctaccttttccattttaatttgtatatgaaaagcaagcagtaatccaaagtcctcttgatactacctagaaacctcaggtttttcatgtatgttggccacaggagtgagacatcattctttatttatttgcccttgctagttgttcacacaagttattattggtttgtgcctctagaatttgacctgaggagtttttgggttttgggttgtattgttttgtttaaattcattgccaccattgaaaaatgggttttcacattaaaatctggatggcacttcttaaaaagaggagaatctggaacatgagctagcatgctagatagga

SEQ ID NO: 96310 - DNA, 1136 bp, Homo sapiens
cttagcctggtctcgaactcctgggttcaagtgattaacccaccacagcctccctaagtgctgagattataggtgtcagccacagcaccaacccctaaccatagcttttttgacatagctagaccgtaagccagtgcctacaccccagtcattacttattacattggtaggcatcttaaaatttacaaataatttttatatatgttaccttatttgactgttctaacaaccatagaggtaggcaaaaaatattattatccccattttaaacaaatcatcaaggtgaaaaaacctgtatcatcttgtttgatttcagcaagtagtttcaattaaagatgtatgcaaacattgcttcatgcttaagtcaactgtagattgttttttaagaaaaagatgcagattttgtgtgctttctactatttttggtaatctctcacttacagatttatgtgatcagtttggctgaaccccgtctgcccctgcagctggatgatgctgttcggcctgaggcagaaggagaagaggtaaaaattatacttatgaaatattatgcttccgctgtatatttagtttgcaaaacattgaaaacctgatgtactaagggtgtctgtgaattgattttgagctccattgttatttaaacttactcttaaaatcagcaattctcaaaccttttggtatcgagttgccttttacattattaaaaataattaagaaccctacaagcttttgtttttattggtatatatatcaatatttacagtattgggaattaaaacatttttaaatatttattactttattaaaaattatatatacattgcatacatgtttgcatatgtagtattatgtaaataatgaagctaataacattttatgaaaaaattacagttgtccaaagcaaaaaataattattgttaagagtgacattgtatttagcagtccattgccttaaccactcagctccctcatccttcggatgacattctgtttatataaccacaattctttgtgatttctggcttaatagacaactagattctcatattgcctctgcattcattctattgtgataatacacatcatagaatctttagcagactgctcagtatactcatgaagagtgaaaaacaaaa

SEQ ID NO: 96311 - DNA, 1050 bp, Homo sapiens
ttattaccttaaaatcttttcagttgaccgtcttctattatttaattccatcacataccagtaattgcatttattgaagccagtatttctcattataggaaatgctgatcttagtgattctcaaaaatagggagggaaatgttctttaataaataattaaaagactttttactacttttcccaattcggtactggttttattaccttttatgtccagagtattttataagtggtaactaaattatggcatctaaaaaatcatctcttcaaggaatctcacaaggtatgctacgtaatagcttattctaagtaggttaaatagactggctttatctcaagtggcttactgtattaaaaaagagtttaacatattcagctttactgctgaaacaccagaggagttctgacacctctgatgagatgattcaagttgggaattttttctcttgacagcatcaacaaagagagcattgtggatgtagaaggtgttgtgagaaaagtgaatcagaaaattggaagctgtacacagcaagacgttgagttacatgttcagaaggtaagttttttcaaaatataaaatcgcatatagaaatagatttgggttctaatagttttcatgtcaaatttatatgttcttactaattaatgtaaaatactgaggtttataaattagttactgaatcaattagcttttgttatataacaaatcaccccagtacttagtgacttgaaacaacaaacatttatttgcttacaattctgtgatgcacccaactgagatggctcatctgctccatgcaacattggctgggctcactgataaatctggcacatctctttctgtggcttcctctcatccagcaggctagcccagatatgttgatattcaggtaccaggagggttcccaaaggcaagagtgcgaaaccctaagaacagacacttttcaagcttctacttgtgtcacatctgctaaatattccactcgtcaaagtcacacagcaaaacttagatttaaggggtagagaaatagattctagcccttgatggga

SEQ ID NO: 96312 - DNA, 1391 bp, Homo sapiens
aacaatatgaaattattatttaaagattttgctgaatttctactaaggttggcaacaacagcaaaacatcaagatacatcagtgttactggggaaggtagtatgattcctggacatttgggaaactattactaaagggcctattattttcagttgttgttgtttttttgtttttttttttttcacagaaactataaagcaatctagcagctcatgagcttctaagaatgaaaatgtattatttcatagtgagctgatgatgcattctgagatatttaaatttagttctaatttgtcagtctgtaacagaactgtctagtgcaataatcattaaatgatcttattagctatgtgatggtagtctaattacttaaccttgtagagtctcagttttctcatctgtaaaatgttgataatacctaccgtgtaggcctttgtgaagcgcaaatgagatagtgtctacctaaagcacttcacacagaacctggaacataaaagggaattgctaaagaaataatagaaataatactttagggatttagttgttaaatctcttttcttttttctcttttttctttctttcttttttttttttttctgagatggagtctcgttctgtcacccaggcaggagtgcagtggcacgatctctgctcactgtaacctctgtctcctgggttcaagcaattcttctgcctcagcctccagagtagctggggctacagggccacgccaccacacccagctaatttttttgtatttttagtagagactgggtttcaccatgttggccacgctggtcttaaactcctgacctcaggtcatccacccaccccgacctcccagaagtgctgggattacaggcatgagccaccgtgcctgggctaaaatcactttcatttgagctataaaaataaaagtgtgtttgccaggcatggtggctcacgcctgtaatcccaccactttgggaagcagaggcaggtggatcacttgagcccaggagttcgagaccatcctgggcaacatgatgaaaccctgtctctacataaaatacagaaattagccgggcgtggtggtgcctgcctgtagtcccagctactcaggagtctgaagtgggagggtcacttgaacctaggagatgagtttgcagtgagttgatcccagtgattcttctctatatgctcaggaggactcgtcagagtcaaaacctgatactgggacccagcagcaagagataaactgctttttcccccgatttatgtctccatttatttgcaagatggtgacctctttgactggagttgtgtgctgttaaatattttttcacgtgtctcctatacagaaattataccttcacccttgattttcagatcatctacggtagccatttctc

SEQ ID NO: 96313 - DNA, 1050 bp, Homo sapiens
tggacattaaagcatgtgaactcatacacaacaaagtgggagaaacaatggtgtttatatgttaattccatgaagccctatatttaactctattccctctggccatataccaggtggaaaaaagcaaggactgtgctattaaaaatatcaaatcagatagttccagctggggtttcttaatcatttaaaaggcaaaatatgaggtcacttttaatatcttaagtagataacgatcttagcatttactttagatattaaatctgaagtgcttatcttttgccttactggctagacaatactactagcagtttctagctttggagtattttccttaaaagaaacattggaatttaatacggagccaactattttgcctcaaattgtctgtcttaggaatatccaattcatcaatagagtaatctaaaaagttgattcactaattggatttaagtgccacaggactcttcacacattattttaatcaatttgttggaaagatcaattttctcatggatgaatgcatataaaaatgaagcaattgaatgagttacataggaaggttggcacatctaattccctagaggttctaggaacaggttcttaattatatatctgaaatggtttgaggtttttaaatgaaatttgtctagaagcaggaagatgcaatacccatctatccaggcctgtatttctggatccccatcttatctaatatttaatagttgatcctgaagttgagatattatccctttattcttttaaaaaaaatttttttgtatgtgtgccattttaaagtaattaacagagtagtttgtgttagttttggttaagtgttataaagccagtttttttttaaaggaagtcctggaggcctttttgtattgactgttagagaggacagtgagtgtaaacacaagtttttaaagtttaaagttacagtgcccactataaaggactacaattaatgtgaaaagtagttttaaagttaaaatttatatatcgctgtttgtgcttatataatacttcccactctccccaaacatagaggta

SEQ ID NO: 96314 - DNA, 1111 bp, Homo sapiens
ctaaggtctcttagattctggattcacactctagtctctgtgtcatcctgcctctctgaaatagtgtgtaatggtgttagatcaaaaccctccacattatagctccatttagaatacagtttgttagctagacactgctcccaaggtattacgagtcaaaactaaagggaaaaaagtttagtttaaaaaatagaactgggccaggcgtggtgactcatgcctgtaatcccagcactttaggacactgaggtaggaggatcacttgagcccaagagttcaagaccaacctggtcaacatggcaaaaccctgtcgctacaaaaaaaaaaattaaataaataaataaaaattaaaaataaataaaaagtggatctgattataaagtaataaaaaatatttttatgtttgagtgataaattcctgctaaaaattccaaaggaggaatttatttttaaccattagtaacactaatgagtttgtctcttccactataaagcagtagctgccttctaaggaatcaccctattgttaaaaagcatgctctaaaaataagggggagggacagggagttggaacctagagagtttcatgttttcagtgacagttattcttcctgaataatctcaataagaaaaattttgatagttaaaaacatgaaacctaacaccactagaggcaaatctaataatcaattgcatctacttttgcttaggctttgggcttttttttcttatcagcactgccattaacacaacacaatacgttttgcacctttgtatcactctcttgagaagtaaggcacaaagtcactcaaaaaagcagctgtgtggtgtatgccactgatgttgaaaataaaaccacagactcagaatttaaaataagaatttatcttttactaagattgtggatgcaggaaagaatagaaaggatttggctggataactaatactgttccttaacacatctaattgcaggcgctttgttagacacttgtaccaactaaagtcctttcctagaattgctccatcaacagcaagggagaagagatcttggaacatttaggtatgggtgtccttttagattagctttttgtagagtgtgctaatgtactgt

SEQ ID NO: 96315 - DNA, 1043 bp, Homo sapiens
tactttcaaatggtctcccaaacagaacttagttcactaatgccctcataaaattaaagaacatctttttatcattattttattaaaggctttcatccaaatgggatgatatacgggcgatctttttttttttttttttttttttttttttttttttttttttgagacggagtttcactcttgttgcccaggctggagtgcaatggcgtggtctccgctcatcgcaacctcctacccggttcaagcaattctcctgcctcagcctccccagtagctgggattacaggcatatgccaccaccatgcccagctacttttgtatttttagtagagacgaggtttctccatgttggtcaggctggtcttgaactcccaacctcaggtgatccgcccgcctcagctgttcaaagtgctgggattacaggcatgagccaccgcagccggccatgggtgatctttcttttagacaagggaagaatataggtaatttagcctagattttttaattcctgaagtggaactccataaggatctagatgcagttcaggcttaactaaattgtgacttgatttttttttttttaagcaaaggacatgcagctatttttagtccctttaaaaaatggactttatataaagtagcaatgtgtaggaaaaggttgagctgttccaaattataaaccttgtcactggttatatgtaagtgaatggagccaattttatacaataggttcaacatgtggtacatagataactattattaaacttttggcactagcatgttaaggaatcgagcctgaataattaccagtaggtgggttaatggcttttgctatcttgcgaaaaaggaaaattcttatggctaagactcgttggcaaaaaatgatgagtttttaggttttgtagttggttaagataattttcttaggaacatgattttatgttccagatgggtcagtcagtttgtcctttctgtgtgatgtaacctatacttctaagatagttcagaaatcctgatccttcttggtaggagaagtctactttt

SEQ ID NO: 96316 - DNA, 1205 bp, Homo sapiens
tagattatgtctgtgttgacactttgtttgcaacctgtcttttttaacttgtgattgctatctgatttgcatttcaaaatactgtatgttgaaagtagtaactgtaagtctgcttgcatttttgctttcctttttctttcttcttttggttaaggcccattctaaatgtaaaatataatgctcagtttaaaaaacaaaatcttgtgatgttttacaaaacaatctgatgtgtaaagtggtcttggagagattaacccattttttatgaagaagtaatttcccagaatttgatcagagacttaagaaggatctgctttggaggaaaaagggatgtcacaaggatacataataacgaaatatattatgaataatgtttttcagaaggttaagaataaggagtaacagttctttatcaaagaagaaggaataaagaggcccaggatatgtaaaaataaaactggttatagggcttgaagaaaatgatctttaatagacaatataagttatttggagtaaaaaaaaatgcgagactcataaaatatgaaggactaggaaggtgataaaggaaaaatgaagaacgtagaacatgaaaggcactagcctgtcaatttaaatgctctttaaaatgtactttggtaggaagaaactctgtagatggaccaccccatagtgtttgtgtccttgtttttaagcactgtgttagcacttttgtggttgcagtattgaaacttccatagtagtacagtgcctttgcatgtggaatatactaactattgaatgaatgttgaaagtgatctcaagttacttgaaatttgtttaataaatcaatgcaatgacaaaataattttcttgatttagaagtttttttgaaattggtgatttgcctgtgttcttataacaagttgaaagcatttcttgttactcatcataggaacttgagtttctttaagggttgtcagttgagtgtgagtattttgtctgtggaagccaaatggatagtatacacatgcatgcgtgcctgatgagtatagtaaattttggcccacttttaaagtagagagcattttccttctttgtaaaacctgaagttgcgtgtccttaatacatttgtgttctttctgtctttttcagggaaacagtgcttcttagtcctacgtcagcagcagtttaatgtccaggctcttgtggcggtgggagaccatgca

SEQ ID NO: 96317 - DNA, 1054 bp, Homo sapiens
atttccgtctggctccctaatttttctataaggagttctgagtttgtggtaagcaacatgagaagtaaggtcatcttagaatactaaatgaggaagagtcactgaaatattaatagtactaattatgaatgcaacttttttgtccttcacacaatttaatctccttctgttgccctcaggcttcattgtgtgactgtatctctctactctggccagggttatctttttctttaaattgttcagtaagcgccttaaacatgtctggttttattttggtgtaaacacaaaatccagcaccctcctgctctaaaggagaggattccaacaggtagctgtaaagtgacagaaacttaattgtttcatacagatcttaagttaccttgtaaaaactagggcaattatttttgtgtactcttaatctgcttaattacataaactatcagtgtacccttacagatagtataggtctagatacaaggtagacattgtggcagagttatgccattttatagctagaagaatcttagatcattttagaggtaaagtaagattgaaataaaggccacttatctatttaataagtatattttgttaacagattggaccctaggtcttctgtttcctgttcctaactctaatctgtaacaagaaatttgatattattatattgtcagtgtcaaactcctgtaacctggtatcctgaatctggtttttagaaacaggaagctggtgaattttttgatgatgttttacaaaaggaaagttgtagttagcttatacccagcatctccagtttctaaaaactgtggacatctggtgctcagaaagcttacccaaaacgttggttctctttgaacatttcttcctgtaataggaagttaataaaactgtggtacttcatcctactcccttcacagaggaaatttatgtccctgctttgaagtagtttcatctttttgaagaaggtagttaagatgtgttgtacatatgtgtaaattttatctgagaatgttattaagtatggtaaatccatctaggagtggtgatcttcaaa

SEQ ID NO: 96318 - DNA, 1049 bp, Homo sapiens
aatggcgttggaagcttggccctacttccagcattgccgcctactggttgggttactccagcaagtcactccccttccctgggcctcagtgtctctactgtagcattcccaggtctggaattccatccactttagcaaggatggacgcgccacagagagacgcgttcctagcccgcgcttcccacctgtcttcaggcgcatcccgcttccctcaaacttaggaaatgcctctgggaggtcctgtccggctccggactcactaccgaccacccgcaaacagcagggtcccctgggcttcccaagccgcgcacctctccgccccgcccctgcgccctccttcctcgcgtctgcccctctcccccaccccgccttctccctccccgccccagcggcgcatgcgccgcgctcggagcgtgtttttataaaagtccggccgcggccagaaacttcagtttgttggctgcggcagcaggtagcaaagtgacgccgagggcctgagtgctccagtagccaccgcatctggagaaccagcggttaccatggaggggatcagtgtaagtccagtttcaacctgctttgtcataaatgtacaaacgtttgaacttagagcgcagcccctctccgagcgggcagaagcggccaggacattggaggtacccgtactccaaaaaagggtcaccgaaaggagttttcttgaccatgcctatatagtgcgggtgggtggggggggagcaggattggaatctttttctctgtgagtcgaggagaaacgactggaaagagcgttccagtggctgcatgtgtctcccccttgagtcccgccgcgcgcggcggcttgcacgctgtttgcaaacgtaagaacattctgtgcacaagtgcagagaaggcgtgcgcgctgcctcgggactcagaccaccggtctcttccttggggaagcggggatgtcttggagcgagttacattgtctgaatttagaggcggagggcggcgtgcctgggctgagttcccaggaggagattgcgcccgctttaacttcggggttaagcgcc

SEQ ID NO: 96319 - DNA, 1132 bp, Homo sapiens
aggtgaagaaggaaagagagagagagaatatatataacgcttttaggtgttacctttgatcagggcgattgaccaaggtcagctttcttcaacgtgtattcagaggagggctcatgtcctataaggtattcattggtgttttacgggggaaatttttaaaaagtggggcagggaaatccactggtcccacccatttgggaagtgtttggttcagcaggtttctctggtgtagctcctctcagagcctttcgtaaactggagtgcattatggagctccaagatggggccatagtatacaatttctccttacattattttattgagatattgtttattcaaggacaagcagtctgagaaatggagtttttgaaataatgatccaggcctttcctgcaacactgagctgtttctttccttttcttttttaaccatgcaacaaaacctttattagcattttgaacaggttcagctattactgaaacttgtaatttctaaacttaagttggggcaaatggctatacggcagagtaatgccatcactgggcactgcgaatgcaagactggagaattaacagccacccctcaggtgcaggaccaggtgcagggttgactctttctggatgttgtagtcagaaagagtgcggccatcttccagctgcttgcctgcaaagatgagcctctgctggtcggggctgggggtgggggggtgccttctttatcctggatcttggccttcacattttccatggtgtcactgggctccacttccagggtgatggtcttgccagtcagggtcttcacgaagatctgcataccacctctcagacacaggaccaggtgcagggtctactctttctggatgttatagtcagaatgagtgcagtcatcttccacctgcttgactgcaaagatgagcctctgctggtccggggtaatgccttccttatcctggatcttggccttcacattttcgatggtgtccctgggctccacttcaagggcaatggtcttgctggtaagggtcttcacgaagatctgcattttgacctgttagcggatatgacgaggctccgaaacaccagtcatgtccagccacagggacaccaccacatactcacccaacaaagccagt

SEQ ID NO: 96320 - DNA, 1024 bp, Homo sapiens
actgttgtaatggcagatctatttttatactagttactgtcttgataaaatgtggaaatatatgacttatcctatatatataattgcattactaatcacacaagaatgctagaacactgcttggtctaaactatgcaattttgaaaacctcccagtgaaattaaaaatttcttacatgaaacttctaaaaacctaaattataaacctcgttgccattttcgctttgtagaaaatcataaagaagctttataaagttgcactataaaatattttaggtgaatcaaattcaagcatcaaaggtctcctaccttaacatagcattttgtccatcacttcttgtacacgaaacctgccgggtttgataacctatctctattgcccaagacttcgaatgatgatgtgctttgtaactttgatgtttaaaggtgactcgctcatttgaatcagagttaaaatccagaacagttcttccgcttggattaatttctttaagatgaggcagtctgcatttactccatggtccaaccttaaggctaaatgtatattcctcttccccaagaggacaggaaatgggagcatcacaggctcttgactcagtcagatttggacattgcaaaccaccaaagagagggggagctatgaccgcgcgagttctatgctgcaatttcttcccacatcccttgctacagttggaccatggtaagaactcagatactacacaatcccggggacaaggaatgaggcaagcctgttctgtaggaggctgaagggcaaagtgttcgcatatttcatttgcaaccacagttcggttcagcttctgaatgcagcgcaccatccggtgctgcagtccatgctgagccgtcacacactctgcagtccgaggcttgacttcaccgcgagcgtaaggaacaagcacacagtggtgccagtcagaaacctcccactgaaagaggtcactgtgccagtcacaaactcggaaacaacttctttcctttggaggcctgttgctctcaccacagttaga

SEQ ID NO: 96321 - DNA, 1033 bp, Homo sapiens
aaagtggcagcagatggtccacagagctaccttcacttgcaggatactgaggagattcccctgcagaaaccctaagagctggtcccagcctctgtaaatatgcctctggtgacactgagctcattactcaccattgctaggcagctataatggaacatgtattctaatgttaggccaacatctgtcatctttttatttctacctatttgccttctggaacaacacagaaataactacctctccttctcaaagaatccttagttaagtatatttaatgaactctgatgtaataaagaccactttggtgtatcgaattttgcttgttttttactaaacttactcatctcaatatggtgttattagcagctccactatcaccctcctctaggaatatctctacgatgaaggagtgaaaagctgtttatccctaaagagctgtctcctatcttctttgtgatttcacatatctcctttttcagaaactctacttctctctccttccaatccattctgatgaataaattctatgctgcttagctgtctgaatgtgatcaagattagaattacagttgcagggaaaaccagataagtatgtactatatatctaacttaaactcactttgtgccagagggaaatgtgtgtgggctttatgttttcgttgtacaggtgatctctcttgctcttagctcacactaaggaaagaaaaggcaacatgcttagtgtatggttaggaataggtttcatgagtctagcccactgagttggcacaattgcctctaatgctgcattgagaataaatctcaggccaagttggactttaccaaaaaataacatcttaactattgaaagttattgcatagtctggtacagggcagggtcaatgtagttggtacatgtgacatgcatttaccaagattcataaagcagaataagcactggtttggagtcctgcaactgaagttcaaacttctggtatcagaaattactagtttagtgactttaaactatcaacatctctgcctacaattttct

SEQ ID NO: 96322 - DNA, 2304 bp, Homo sapiens
ctccatggggcacttcatctacctggaaagttctcgatttccaactggagcctgtatactgctggttgtgtctcagcagttattacagctctgggcttacaacgggagcttagcaaaagttccaccctggcttcctagactgctacagctccaagaaaaatcctgtgcgcacaaacggccgccgcctttggcgtctcccgcggattagaccagttaggaggtctcagtaggcttttaggcaggacaagttttacgcctggccaaataagggtcagactaagcaaggcgcctccgtgcgcctagccagagcggtgccggctgcggaacctgccccgccgggagcctagtgccatgcagcagcggcggcggtggcggcttcccaagcgcggcggcaaatccgggcccgcccggaagtgcccggcgctgtaggagggagcaagggcccaggagccgccgccgccgccgccgcgcgcacgcgccctcgcgggctggagccggggctggagtcgtaactcggaagccggagcccagacgggcccgcggcgggggggtgggggctgcgcgggggcgggagtggcggaggtggccgcccctggcggcgggtttgtttatcccggggaagaagtttaggagcgggagatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaggcgccccttcccctccccccagtccccgcggcagccccaggcgcttgctcccctcccccggctctccgtagaccggcggcctcctgctcgcgcctcactgcgccctctgctctctgggtcccggacccctgctcgggcggcgagctccggcctgctctggggactacctcccacgcccccggaccgcccttccctcgcgcggcggcaccactttccccggggttgcccccaatccctccttgatttcccagcctccaccttccaggatcccctttagttttacccccgggcctcgccccttcttttcctctggcttctctcctcctctatacctgtatacctccacacctgcccctttttacctgagtgctgcccaaaggcagaaactgcatgctctgccaccgcgcagcgtccactttcatacctcctcatcccaaatacagacacttgaaactctcgtccctgttagcccattttaggcagagttctcagcttcgcagaccgctcactacctccagtccggtggtcatgcctttaacctctctttaacctgctttctaatacatttttgctcacttataccagagtacatcaagctaaccgcgcggttcggggtccaagtcttcaaagagcccacttgtattcctgctgctctcctttttcctaattctttttgagtcaatgtatttgtatattgattcaacataaaagaaaagggaaggtagcattttctctctcaaagcagtcacacaacccagtagaaataagattcaccatctgcttatcctaactttcgcttgtctctttcctgactgaactctgtcattcagtgattctttccaggcttctgatgctttgtctatttttgaataatcttgggcctagtttgacccattgtggtactcactttcccacttgcaattgaatccactgtttcttggactagaaactgacagaggtaaaaggttcataccttgaaaaattacatctctcctgccacgatgagattggtggaatatttcaaattaccatttcatcattcttgtgagaaatgttgcctagtggttaagaactcttctctagagctcagactagtatatagttgccagggtgtaaacccttgctctgccatctaccagctttggctttggggaagttacttaatatttcttcgcctcagtatacttacagctgtaaaatggggttatgatatgacatcacaggatggtgctagtaattgcacaagtaaatacaagtaaagtacttaaaacagtacctggcacagggcaaatatctgataaatgctatcatcacttcttggtttgacttgatctggcttgtgggtagattaattctaagacaggaaggtgggaatggaaagctactttcttattctttgacatttaacaaccttttttgatatagatagcatgtataatttgttattgtataaattaattccttctgatttgaaaac

SEQ ID NO: 96323 - DNA, 1027 bp, Homo sapiens
aatgtatacttttctattccataatgttttataaaagactaattatgcataggtaatttctgattccttctgtcttttaagagctttaagccattgctgaaatttgcaaaactttgtaggccagtgctcaagtaaatttgtttttagagactgtagtgaacttgaaggtactgctttggcattaagagtatctggatgatcctgttccttttatcgtgtttgtgttgcttaaaaatatatacatacctgcgtacatacatgtacacagacatacatttgggtcacaacatttggtttcagctatttgtaatttttaccaaaaaaggcatggtcaggttttgctattttgtttattcacttaagcacattggaagttgtagaagattttatctggaggacctctgagagctagttcaaattatgaggttagaggctgtctttgtgttgttcttccttgtttctacatggcctacattagtgtaggttcccccaaaatactcaaatgggtcaatgaataagagagaaagagagtgaacaaatgaatgaatgattttttaaaaaaagaagaggctgtgcaactttccgttgtgagtagtcacctaactgctagtctggcccattgtagtttactaccctgtttatatattactataatttgaaatcttacctcttataactgtagttataaactgtgatgctaactgaataaagttgatttttaaaaatcctaatactgtataagactattaacataggtacactgggcttcgtcttttcttatatgccttgtttatacaatattattaatacataatagaaaaaattggacttgtcacaactagcatgccatataaatgtagttgtttgcaaatgatgattgtaaaaaatggtttccagagatccagaatatctttaatatgttatgctataggaaaagtaatcaggttctgcagtgacctgtagttggtattttaaaagaaggtaattgcagtgtgaggaaattatttggtgatgttgagtaaatctt

SEQ ID NO: 96324 - DNA, 1833 bp, Homo sapiens
tactttgtgaaagtgtttttcttgctgtcccttttttattaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcaggtactttctagttatggggtaatatagtacatttaaaaaaatgcatttatgcataaaataatgatacataatcttgttacagctcgatctccagtttttaacgccatgtttgaacatgaaatggaagaaagcaaaaaggtaaacatggcttaaaggctaatattgaatttatataaacgtaaagtagttgggtgtatgttttaaaagtaatagtacaatgttctcattgtcatactgtgataagcagggaaaatttttacaaacaggaaaaaaatgtgttctataatagaacaatagatgtagctcagtgtggatgtgcagtcaatattccagagaacagctattttttatgcccttctggtaggtaaattggatagttgttatccaaaaggatagttatccaaaggactattctggtccatagctatttgagaagtctctgttcaaggtatatattctccctttgtaagactttatggattgatttttggaatctgttttctagcaacaaaaataacatagatgacatcagtattattgtataccaactgtaatcaggatgttacctacttgacttccccagatgtttctcttttacttgtcatcatgaaatgtaattatgttagagatcagaggttgattctttgctgtttgcataacttgtgaaccgtagggctccagctggacaactccagagttttttcatgtggctcaattttattctttctgcagaactagatgctgcaataaaataactgctttctttctccaagttttggtttggggagatgctatgatcagccttctgatcacttccaagttgggagacatcaatgatgtcatatactattgacatcaaggggtcagaaaaatttgctgtcatttagttagatatttagctttattgatctcagcaaagaaactaaatacaaaaacacgcagtaaaaaagcactctttggacttgactatttttcaggtaagcaaggaagtgccagtatatgataatacatgccatttttgcaaatgggagaattctgaggtagtgggctttattgttacctctagtaccttgccctacttttgcttaattctgggaattaagaactgtttgttacaggatcttaggtgttgtattaggacctagggattcaacaaagaaagggttaatagccagtgtcctttagaatactggtcagaaacttaacacagatgtattttatttggcttatagttttctgtttgtttacttgttttttttttttaactttttaattgaaaaattggggctcctttttccacatggtggtgcttggcttggtctgaatatcaggatatgggctctccagctggtcatggttcccacctctccgatagtgtatgcttttcctcttggacttgtccacttcactttgccgaagtacttaatgaagtttacctacctcaattttaaagtagaatttagaaatatctgtgtatgtatatttgagttatacactattttagtgtagatttagggcttttaaattactgtcaaagattcactttggttcatttgtgtgtactttttttttttttaacatttttgtgttgtttttcgatatcagaatcgagt

SEQ ID NO: 96325 - DNA, 3799 bp, Homo sapiens
ttaataaatgaaaaaggtgtaattggtatctatgtgattctaaacaactaattgaaattttgaacacaatgacacactggtattaggctgatgcaaaagtaattgcagattttggcattacttttaatggcaaaaaccacaattacttttgcaccaatctaataatttgatgtttgccaacttaaaaaattgttttgttggtatcagctactatttagttcagcagacattactctagcatcttctgtgtttcaagtacaatgctagggtgctgcatataaaaaaaatttcaagggaaaattcttggtcttgggaaagttatctaatagagatagatatataaatatatcatttcattataatatggtaagtaatacaatagaagagaatatgtacaagcacttgactaaccctggaaatttagaaatggcttcctggatatagctgagtcttaaaacacaaataggagttagcagaagtaagaaggaagtagcaagcattgcagacagaagggacagcatgaaccaaagtatagaagcgtaaagtagtagttgatcattcatttgacagatacttatcctttattatccagtaaattcccaagtcacagtgcacagtatagagaatacagtggtgagcatgacatatattttccctgccttcacggagtttatggtctagcagcagattaaacagctaattgcagtaaagcgtgatgatagggaatatgtagcatacccataggagcatatagcagagacttaacctaatctaggaatcagagcacaaaactaaatgccggaaatattgtagaggttaccttggtgaagaagagggaagagaggaagaaaagtacaccccagaaaaaggaaatgagatgcgcaaagttttaacaatgagaaagagcagtatagtgtgtgtgtgtgtgtgtgtgtgtgtgtgtgtgtgtgtgtgtgtgtgtgtgtgtgtgtgtgttgcgggcggggaggtagttaatgagaagaagctggagaaagtaggcagagatcagaccctgaaaggccatgtaaaataacattagaatttttagatattcagagtagtaggtgtccagtaaagggttttcacccagagtgggacatgattagttttgcatttttaacaatctctgcatgcagggtggagaacgaattgtggggaggttgcggtggcaatagtagttgagaaacaaggttgaatacaggtagaccagttggaaagttactagagtagttcaggcaagagatgaacggtggaaattagacttgattggtgacagtggggctagagagaaaagaaagtaagaaatattttgaagggagaatctaatatttggatattatttggatggtagatggcataaagtagagaattgaggcaaggaagggtaactagatttgttgcttaagcatttatttacggttattgtttggtgagagcatagtgtacatagggtacaataagcagttcaatatcagagtataaaatgccagatcatggaagtgggaggtaggaagtggggggtagagtaagaaaccaaacataatatgatgctgtatttctctttctaaaaaacttggatatgggcagtggggaacaatgaagagggcctcatatagtcatatttgtgttaccaagggaacattatggaagcttggtttaagaggagcaggaaactagaagaccacttaggagtctgttgtcataatccaaacgtgagatgatgtgggccttaaactgggattcaggacatctttgaagcctttcaaaccttaaaataaggttttgatgattggagaggagagtctagggtgactgccagatttccagcttgcatcactggatgatggtggaagctttaggtgactggaaaggtaggaggaagaatttggggttggggagagggatgatgagctctcatctgacaatcctgaatttatgggtcttgaggcacatccaagtgaaaaaaacaagtggctgcgaatgaaccttgtgtggaaccctagaatttagcaaatcggtagttaacatcattgaatttcatagttaaaattgtgaagagtggatgagatagaattagtaatgcatgttaaggggggagagtagagtccaatatttgtaactcaagagaaaatctgccttataagaggcatgtaaaagaagagaaagggactcttgaaagagctggtacagaaattgtaacaatgagagttgaactatgaagacccatgtcacatactttaagggagccgaacttccagaaaaatttaatagtttcagttgccacagaagataccagtaagataaagatggtattttaataaaagcaaatgatttgaatacataggtaaaaagtgttcaaatattttgaaatttgcaagtttttaagaaattaacagtgcaatagtgcattttgaaaagtattctttagtaaatatcttttaattctatttttcagccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttgtcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaatttttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattgaattgactcctattttctcacactttggaaaagacacctgaacaataaatgaatcctggatagtctactctccttcaaacaattaactgatacttgcctttgggagatgcatacaaaaggagagaacccttagactat

SEQ ID NO: 96326 - DNA, 2766 bp, Homo sapiens
gaaaaagtgtgtcactggaaaaaaacgcatatacctatgtttgcaaacataactattcttcagattaaaatttgtataatttgtttatttaatgtttgaattcaggacaaaagaaaaaatgaagcttgaggtgttttcaaatagaccttatttttgctatctctttgttaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatactctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaattggcttatcttgtgtttatttgaagaatacatactcttctttttcaggttggtatgatgctttgcaaaagagccatgtatttgatacggtaaatcatgcatagtaattgtcttttctacatagggg

SEQ ID NO: 96327 - DNA, 1010 bp, Homo sapiens
cattcttttccctgttagggccttagcatatgttgtttattctacttgccatgctctttatactgctctcctcattcttcagttttagtataaatatcactcctcaaagtgcttttttctgatcaccttctctaagtaggtcagtcacctgctattctctctcatagcaatttttttcaaaatattttatgagtcataattatatatttatgcacttatttagtctggctcctccactggaccataagccccacgaggatagataatacatctgtttctcttgtgacttatcacctatccagtgcctagcatatggtaggcactcaataaatatctgtgaaatgaatgactgaaacaatagtattatttctttttttttttttttttttagaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtttaaaaaatcatctcttttctgtatttttttttttacttagataatatttacaacattggaaagtgtcctaacatgtcagtatcatgtatacatatattaaaattggaggtgtattttttttttgcttgccccaaatcagatacagacccataaaaatatttataaaataccttttttgtcatttagctgagttacatgattatgtctctggactagttgaatgagttttgacaaactactcatgtatttatctttctgtaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaa

SEQ ID NO: 96328 - DNA, 1043 bp, Homo sapiens
tgttggtggggaaacagtgagaggtaattgaatcatgggggcaggtctttcttgtgctgttctgcgcatgtctcatgagacctgatggttttataaagaggagttccctgacacaagttctccctctttgcctgccaccacccatgtaagatgtgacttgctcctctttgctttctgccatgattgtgaggcctccccagccgtgtggaactgtaagtctattaaacctctttttccttataaactacccagtcttgggtatgtctttatcagcagtatgcaaacaaactaatacaccaataatgatgttatacaatgagagatggatgcatgccttatttttggtgcttctgtaattataacattattaaaattattattaaagtaatagagaaacttccatacgagggcagattaaagtctatagacttttagggggaaataaaactttacatatatcataaacaatatgattctgatatttacaaatttatttacaagtataggaggattagaaacacaattttaaagtgataactccaagaagttactaaaactgaaaactactaaaagaaaaaacttatgagtactgtagatggtaactttattcaattccatctataacaagttcatttagtctgagagtgaaggaagagttacataagcttatgaatactggattcatagaagactttaaaaatatttttggctaggtaacactttcacataattcagcaatcaaaaagcataaaaaaggaataaagtgagaaatgtttttcttctctttatctcaatagtaggattctttaaaatggaaagtagaatattcggagtctatcattgctaatgaagatgaggtatctgcaacacatgtacattttaataaagtgtgagggtaatgactggccattgtattaccataatgaaacatcatcattaacagttggccaatgtaaagaggacctgcagcttcattataacatctgagagattgggttcttaggcccgtttcccgggagtccacgttacctatggaagagtca

SEQ ID NO: 96329 - DNA, 1050 bp, Homo sapiens
cacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttc

SEQ ID NO: 96330 - DNA, 1074 bp, Homo sapiens
aaaaaagcaagttttcaaataacattcttcattgttagcatacacatcccataatgatggatttttataagcaggtcagtgttgctgcaattgcttacagattttttttaatgatacacacagaaaaatcagggactgaaagtcacaccaaattatttaaacaattgactagttaataatatgcaactgttgtacgggtacataaggctatagtaccagttctttgaaaaaaatctcatcactaagtatatcacatatgcattgtgttacattagaataatgtattttaatcacccaaaggagatgtctaaacagcacaactacacagtcttatttagcattaaacatccttgtgagctgaggtaaccttataaaatcatgcttaaataatgtaaaacacgaggcggcacagagcaatatgcatttttaattagtaaagtgactaatatcgagtgtgtgctttgaggtttttgtttcattaaaaatgtatctgtttttcctgcagctgaatatctgtattctacacctgaacagctttcaaaaaggctccagaatttctgcaagagaccagatattataagaaaacatctctataaggtagttattgagaagagatttacatggtataaatgccatattgaagtacaaagaaaaatcttaaaaaaaaacatttaattaacatactaatgtttaaaggaaacatgctagggagggatattagttgttacactaacaaggattaattaaactggatgccagttgtattaacctaggtcttatgaaatacgtgcacttaatgcacagtacatgcttttttaaaatttactgttttctaagatgactgtcctttacatttagcccctagaggcttataaaaatgaacctgaattaatgtaactcattagtttaaaaggaagtaaaggaaagattctacaattatactaatgaggataagcctttcttcccatcataatgaaatctttagtcctcaaaaattcaggtgaatgacattagtgaagtttggtgttcatttttgaactacttgaaaggtgatttttaagaattgaatatttc

SEQ ID NO: 96331 - DNA, 1041 bp, Homo sapiens
tcatttacttagtgttttgcaatccttaatgtgcacagctggcagctgaatgcaggtttgatactaacagtttagacatctttagatgtagcagatggaaaattttacacaaataaagtaggagaaagtgtgcaattaggtttttatctgcagttatgtgatgcatcctctgttttagtttagaacatcaccttagtgggtggtcatgatcttttcttgtatccaggccctaccttcttgacaccacatttgatgttggctaaatgcccaagtaccaaacttttgtttttgttgagtgtgattgaaatagggaatgcaacaatcagcaaagcaaaaggcataccatcagtgagattgtaacagtccagtacattatggttacattccttgctagttaagtcactatggtaaaatccttggcaggatttttttcaatagtttattcatgatgttcattattatgagttgtaaagagtatgagaatttcatttttaaaatgtcttatggaatgtatcactttcttagatcttgtagacatgctgtggaaaccataacataaaatatgagttacttacaataactaattttaatcccatctgctaagtatgacaacattagcatttccacttaattaaaaacacccttaaagcagcaatgttttaatcactccattttatttactctcctccggtgtcacttataattgtaactttttattttttaataatgagggattttttttctccttgcatcacacaaaaaagtgctgtcgataattagcagtcttctgttattagtagactcaggtgtcacaactgtgtctcatcctcattacagtaaaaaatttcacctatcagattcattattgctagataatgcgactgagagcctttgcaggccctccagaaaagtaattcagccaagcaaaattatcagctaattatatttagaatcaaaagcccaacaactatttgcagataaattgtatgaattgaagtgaatagatctgaatattaagattcatagatttggcagatgatt

SEQ ID NO: 96332 - DNA, 1029 bp, Homo sapiens
ggctccccaaccagcagtagaccatgaaaaaaattgatactgtaggaagtgaaaccacttttcctaacacatgccctaaggtaacacaagttatattttgtgtgtttatttccagggagcatgataaagatccagaaagcttttttaaggtattaatgcatcttaaagacttaggactcaatttccacgtgtctgtacttggagaaaccttcacagatgtcccaggtacctctgttgaattttctaatgtgtatttttatagatgacataagctctacaacgtaagtattaatttccatgtttccctttgttagaataatcaagatgagcactgttaaccaaaagattatacgatggcattaaagtctgattcaattaaaaaaatacttaagtaagcattctttgatttaagttgagaacgtgaagtcatctctttgatcaaatatagtttatacagtgcatcttgatgtaaataaaatatattgctttaggcatcttaacacttaaggaaagtgggaatttgtaattggatatacaacctctcacctctggggtcactggtttgaatcctgctcacattggtattggctgaaatatattaccatctgttaggtggcctatgtaaagcattttggcatctaacttgtaatgtggaatggactatagtccatgtcatagttgtcgttggtccatgccttgtttattgaacttgagaaagacaaaaatcggaagctgatagcagcagatcctctctttattaatgccacacggagccttttcaaagagccatttccttcaccctgcatcctcacagttcacatttgggtcagtaaaatgaggattcataagcacacaagttatacaagtattcatgtcttttaagctttgggtgttcagcattatttgaaaaatcaaatgtacaagcaacaatatttcagaaataacctttgccattgtgcattatgactcctaaggaacacctaaagtttactttcacttagcaagtgcttcttgattctagtacagtgt

SEQ ID NO: 96333 - DNA, 1033 bp, Homo sapiens
ttgtttgaaacatcaaaaaattggaaacaatttaaatgtccattagtaggataattactttatataaaaactgtgaaatgtattagaactattttaaaatgagatatctatatgtgctgatgtagatagatgttctgttatatatttggtgaaaatgcaatttacatgactgacgttgatctcgtttataaaatgaggaaggtattgtaaaaatatgcttatacaaatctatatgtttgcatatgcatagaaataggtctggaagcctactcgccaaacagtagttggcagcggttacacttgaggaatgggatcaggtagggtgaggagtgagagctttgagtgcttatttcatgtatttctcaattatttggattttattacaatggacacgcattttgttaaaattgaaatatttattaaataattatagattcacgtgcagctgtaaaaatgagagtcccctctggtactctgataatacatatattgggtcttctgtttttatcccataggtccctgaagtttggttcttctttttttaaagtctgttttctttctgttgatcacattgtataaattctattactctcaagatcactgattctatcctgtataatcctttctctaccactgagcccatccagtgagggttttgtttttttttttaattctgttacattactgtatttttcagagctgtgatttccatgtaatacttgctgagattgaacactttagaacatggttttaagctccctggttgtcagagtaaagcaggaaataagaattatacatctttctatccaagaggtagaaatacaacaattcttgcaaacatcaaagagtctcttaaactggaccttggggaaatttctaactagaggaggtggactggactgctggggcagctctcaggataactagtaagcgttttgaatgtatttcctacatgtttcttggaggaaaacaatgttaaatccaaatgattagtcagtttgaatttacagccccaattaccacatttgacaag

SEQ ID NO: 96334 - DNA, 1260 bp, Homo sapiens
gactcttcaatgaaaatctaaaacgcctatattttctttaggagaatttatgcaaatgttgtgagctgaactcctaccctttagtggtagatgctttatcatctgatttatgtaaatttgctcataaaaatacagtttatttttaattggtgaatatgaattagaaaattaagattctggttcagcattcatcaaacatccccagctacaagcacacatttatttagacccctgatcgtatgggtggaaatcgtataattgaccagtcaaaatgaatggtattcagaaggaaactatggtttctactacaaatgaccagggttgtgtttcttgttcaacccccttagtttgagcctcccccatccttgtactttacatattcttgtcagtattttgagctgctttaactccctgcttgaaaaggggggttttctttacagtagcctgcaggaagctctttagaagcaggaagtctgttgcattttcaccttggccatgtatctttaccagagagaaggcattgatgattgtttccatgtaaacctaaaggagaaaggaacactggagagggcaatttggattcttagatcttgtcattaccttgcctaacaaaacaaaaataaaaccctcctctatcataaaaaaatatgcccatgaaatcatgcagttgcagtagccaactctaaaaatgaagtgatgctgacctcattgtgttagttccacactgggatcatgaatggtctaaaatatagtgtcagcctctaacatatctcgtactaagccaaccaaatgtagagcctacttgctagaatatgtatcaaaatcaaaagtgacattttctagaagacacattctggctttaaatctgtgttaaaatgtctgtgcatgagaacaggcccttaaatgcaatgcttgcccctctcctcattctttctcaaactgagcttgtcaaggattatagtgtgcaacatctgctgacagtagataaataactgacagtattttagcagagttgctgggttctctgcagagtaatttgttttctcctttctacccagtctttaatgttttgttataaacatctatagcaaggcacggttagtagaaataacttatagagaaagacctgtaaaaaacaggctgcaattggcactgcttggtttttttttttttaactattttctttccaaatactatacaaatgttgtaatattaatccaggttccaacctttatgtaagcattctctaataattattat

SEQ ID NO: 96335 - DNA, 1047 bp, Homo sapiens
gaacaagtatggcctgaaaataagcactgggccatgtggtgattggaaaacacaaaatggaaatccagaaggatgagtgagggaagagtgataaaccatctctgtaatcttatgttttatggtatgtgcagtgcaagttttatagccatagaaactctttggaaactattcaaagacagcccagtccaatttcaaacttttgaacttctcttagtggctactactttttacactttttctggaatttttgtataacatctttattttttctcagttttatatataatcattatgtacttacaggaaggtaaaggacaaattttacatatttttttccactaaaagtatattgcattctttttttgtaacagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggtaagtcaaggcatgccaatttagtaagagttgtagaactggtaaaagaaaatatattctgttgattgacataataatttgttcttcttattgctttagaaaaagattattttaatgtggtggtattactaatgatctgccaaggtggtactactaaatatcttcacatgaatggtcatgtgcttagattaaatttgaattacaggtaattatttgctgcaatttgctcaactaacagtagtgggtaggcacttctagcatatcaagtcttgttcagaaagtttcaaaatataagaatcagattccattttatgcacacaca

SEQ ID NO: 96336 - DNA, 1080 bp, Homo sapiens
acggcacatgaatcaacatgaatgtccaaagttgacttgttttgtgttaaccttattgcctgccttctgactacctctgtgagtcaactgcaagtactctagcctctcgactatagcagaaataagctaaggtgcccagagcacttcttttgcttaccatcaatcttagtggcatttaaaactgctctcaaatctagtcttttcccggctgatatgaaaaaggcaaaggcctttggttattcctacaggtcgatcttaggtttgtgtttggacatggggactgtggtgaggggtatacatttagatctagaaagtgcttgttccagctgtgtctttaaacattgcccaacatagtactggggttttgtggcaatgcttctggaaccatactggcggacagaggtgggaaggaaaggagtctgaggggatgggcagcaggagaggggctctgtttctgtttcacatattggctattggttggaaaggagttgggggtggagatcccatggctaataacagattggaaatgattatggcaatccgaatatttctaaagttagaaataggttctgatggagtttctaagagatttggaaacaggaagaagcattctgtaagatgggcagtagaatttacttaagaaaaatggggaaattattaaatgggaaacctgacatatgtggattactgtttttcttctgaccctttcttttctctctttcacttcttacctcgggaccttttctcttctcattagcacctccaccagagttggaactgggaaagagaaaggaagtgttcagacatgtgcctatttgcatagtcacgtcattgaattaatgccaggacagcacaaacattctgtccagttctatagaaaagccagtttcaccccatcagtaaggtattatttccttttttttttttttttactagcatagaacagtttattgccaggcttctcttaactgtacattataaatagtgtctgattaagaatgttctggatgggttaattagtgtggtgactattattaagcaaactgcttgttagtattatgcctatttgatcttggtatt

SEQ ID NO: 96337 - DNA, 1075 bp, Homo sapiens
ctctctttttattgttttttttttcaccgttcctgccgctgccctttggcaacatataggacatttttcttttgacatcccatctaaaatttcaaggtagttgtcatgctctaacaatttaccttattgtctacatagagttaatttaatgaaagatctcttagttctgttttgtcagcagagaaacaaaaatacgacaatggaagaaatacaaagcctttggaattaatttgtattaattttgaggaggacttaatttgaaatctaggtattattatttgataataaaatatatagatttgttgttctatgtaaatgctctagattgtgggcttccggaagacagaaatttgttttataactctttatttcttccttctttcccacgtctgcaataccaattataaacttactatgtgcctgctatatctttactaaataggtggcttaattatatctagaaatgtaaacataatagatttatcttagtaaaactaatatagtatttagctcagacattccaaatctaagaaatattggtctctgatgtttacatgagacattattaggctgctgacattatgtatgactctattctgaatgggaaccccgcaataattcttcagcctaacaaaaaagagccattttgacaagtaatgggtttgtatagactatgtctattagtactaggaagcaaagtttaaaatctcagaaagttgctgttgaatgtgtatgtaaagtttttcaaagacatgccaagtttggattttgctcactaaaggttagggttctattagtagataatgctcattattttattccatttccttatttttaccaattatttacatatctttttctggccattgcattttattgataatagtgaaaattaaaataaatatattgctctaaaagtagtttccacaactcgtatcagtaacttcagtttttgttctatttttaagctgcttgccacaatattgacaggcatccgattgtgtgaggcttagttctaattatagatataggctacttcacatggagttagatatttctatgagactaaacaaaa

SEQ ID NO: 96338 - DNA, 1036 bp, Homo sapiens
agtgagtggcataaccatcaaatttcttattgtcctcgctaaatgctatagaagtatgtgtgcatgcacacacctccttgtaaagcttatgaagagcaaaccaggtaaaccttttgattctcctaaatcagatgaggggaaataatttcttagaaacaaatcattatatattaatttttaagagccaatttaaaaaaccttaaattttgtcctgatgtactgtattagaaatagcaaaagcttggaatttgccaggcatagttttaaatcctagtccttccatttcctaagcatgccattttggcaagatattatgtctttctgaagcctcagtttcctcatctgttaaatggagattaaaaagaccatcaagaggttgtgagacataaataaaataatgagtgtaaaagcatctagccaaggtggtagcagtggaattagtgaaaagtggtcgaattcaggatatattttgaaggtagaacagaccgaatatgctgatgaattagttgtggggtgtgagaaaataaataggcgtcaaagacgagagccaaagttttggcctgagcaacttgaaggatagagaagaccatggtagaaacagatttggagggattggattcaggcatactgagtttaaagtactttttagacatagagaaagcagtttgctctgattggaaactattttgtgcagtcacctaggctggagtgcagtggcgagatctcagctcactgcaacttccgcctcccaggttcaagcaattctcctgcctcagcctcccaagtagctggaattacaggcatgtgccaccacacctggctcatttttgtatttttagtacagacagggtttcattatgttgaccaggctggtctcgaactcctgacctcaggtggtccacccacctcggcctcccaaagtgctgggattacaggcgtaagccgctgcgcctggccagtgcttggtcatttcttaggcaggctagatggactcagaattcccaaattgcatttgaagaataggggacaccatttt

SEQ ID NO: 96339 - DNA, 1060 bp, Homo sapiens
cttcttgctgccctgcctgacttagaactgtgttctgccttgcagttgacatcaactggttgaatgaccttggacaagtcaagttactaaaactctctgagtcttagtaaatgagaagacggactaagtgctcgaatctagttttaaaattctgtgagtcttcaagatagcctatgtaactgaaaatatgtatcctatcttttgaattgtgctggtaagaaagtaagattgtctttacacagacacatacactctgacactcctttacactgggatttgctacagtgaaaccaaaaaaattagagatataagttatagggaaaatgtgaaatacacctcttttctgctttttttctgggcatcggattcctatttttcctccacataaaactgactgagcataagcaaagtaaatactaagtctcattcttgatcattcacagcttgaacttggattgaagttgcttgctctctgatccagagtttttggatgcatggcttttcgtgtgagcaaagaaataaacatactaaaaaggttgtagaaaattgtagatttagtagaatctctgagatgatttactctggggctaggtttagaatggcaaacagatgcaaagctttttctggccttaatttttgagttggctttattcttgtctacaagaggcctagattcttgctgttctcctcacccctcccttttttgtgcacttctaagatttaagagtgtgatatgtctgaaaaagatttgtttgattagaagaaagtatgcccagagaatattgccatattatcttgtatgattcattttattaacttgccaccatccaaggcaggaggacagagtatagaatttgacataggcaacattcagcctcccagaaatttagagaagatgttgggcctttcatctccgctagatggccattgagatgaaggcttttcctgggaggaggtccaaaatcatctcagatgtgtaggttttggagatgattcaaaagggctgcttcgtggaacgtgagacattcccaaggtcaaatcagtttatttaggcatgatt

SEQ ID NO: 96340 - DNA, 1030 bp, Homo sapiens
cattcaattgaacagtgcattatttgacagagcagttgcctatcatttatgttcaagaagtgcacacaatatattcaggactgacacaactgtccagtagcacttcatttctggttctgtctcaaatcactgctacctatggacatttggctatgtttgttgaaaagatgagctcttgccgaaaacagtactgtctgaggttggaaatctaaaatgctgctgttagctgattgcaaaaacataaaacacatcaacagttttggcagtagaattaaatgtgtgaatgaattgaataaaaggtgaaaacagcacttctctcttagccatggttctatgcaattggggccattaaacacagtttatagagtcctatcactacttctttgtaagggctacagtgacctcaagttccctttgtgtttctctttcttttccacaaacatctatattaaaaaaggaatccattaaataaaacttctgaaagtgccttataagatcaaaacacatccaaggagccaatacttgagaccttgaaaagaaattaaacattaaatttgggttattcccatgcttaattaaagtagaatgagttggatatagaagtatatcttgtcatgtaatcagaaaaagtgacgcttttaacatgtgagtgcgtgttacgacccagattagctatgtagcattctcttaaaaattcaccctttcttattctcgatttctcctaatatgtacacatgttctgacttcccatacatccagcatctttggtgacttcatttcccgtaaactttattacctttcacaagtttcatgtagaattttttctgcttagatgagtaaggtagaatcagtgagaaagctctagattgtaactatcaattataatactaattacaaaacttattccgtattgcttacctcctcaaaagttaattgcgctttccaacctcaaatgttggcaaaacttgagcttttcactctttgcaacatagcatatgtcaaaaatagctgtacttcaaggaggaaacta

SEQ ID NO: 96341 - DNA, 1050 bp, Homo sapiens
gactttttctgacctatattttttcagttgaaaactgccttgggagtcattgtgtatcacaaaagccacccacttatttccatcttgccctacatggcactggtttgaagtagtgaaatacatttagtgaggtaacataaaggtctcaagttgtgaaagtgcaaatttgtaaatatataggattcttaatctctcttttttttttttttggctttttgaattctaagattcttagttttttaatctattgtttatattacctggtttttattttattttatttttgtagtttattatttttttttaatagaccgagtctcaccttgctgcccaggttggtcttgaactcctcggcccaagtgatcctcctgcctcagcatctcaaagtgctgggattagtggcctgagccactgtgcccggcctgtggttttgctatgtgagaaagaaaaaacttcctaccttgatagcacagtataaaacagtggttgtgacagtgctgctaacttgtataaagtttaggattatgattggttttaaattttataattcctgtttttctctttttctaagaattggtgtcaaaaaagatacacttttttccccaaagtaatgtgaaaaatttgcattgtcccgtgttgttttcacctattaagtgagcagactgtttgcctttacccagaggggttctgaacactctcgagtctgcagaaatcatgttggtagcctggaatgatattaataattttctgtctgtcctgtggcatcaatttatcattccatatgtccttaatgtgaccaggtatgtggcatttgcttgctctttttccttgtggaagtttatttctaagtgacccatttaaaaatcccttcagtttgggactgtgcacctcaggtgaacaccacttgcctatctcaagaaggcacagcctaggagtttgttttccagtgcagtgatttgtgtagtgccctgatgtggtgttcataaggcattctttcttttcttttttcttttgaggtggagtctcactctgttgcccagcctggagtgc

SEQ ID NO: 96342 - DNA, 1075 bp, Homo sapiens
aaaatgctcagctggtcaatattatctgttccatagatagcaattatatttccctaggtgtgtggactcattggctatttactatgaattgtaagaggtggtttttctaccctttgacttgcagataaaatcataatgtctttttgggtttactttcatgagaaggaagttgagattttcttaaatgcatatctttctgcttatgcagaattgctgagtgtttttgagaaatttaaaaggcaaaagtaagaaactttgtgcttgttgcatctaaaagcaagtctgtttgtgtgtgtctctccctttgtaacagaaggaatgtttcttatgtttctgtcttcagacagttggcacacatttcatctcagcagctgctttctcttaaagtgcagtagagtgtaggactatagtgacaccagcattaatacttcacattctgctatcatatgctgtcactgggaaatatggatctaggttacatgtgtttgcagactttgtactgctgaattatgaaagctgactctgttggtggattgtgttgtattcagagactgtgaactgaacaataaatgaatgcagtaggctgtttagagtgctatagcatgctttcctttcagggactaattgagcctgagctttaaaatttaaagtgccaaattgtgctggaaaataccttaaaataaacattaaataatttttgtcaaatggcatttttatatgctatctttgactttaaaaattttttagatcctcattttttctactgttgcataaatccttgcacttcagatacgtaaaacaataagcatattgcagacgatcaaagaaaacttttttcccattcagataaaaatttgcaaagaaaatcattgttaaaattgcttactatggttgtaaaaattaaaataatgtttcagactttgtgtctttttataaacagtttaaaatacaacagccaggacagagctagtaagataacaatcattcttttgcctttgtgtctgagctatgcctacacacacaacacacaggcacatacatatatatttgtgtagatagacacaaccatacatat

SEQ ID NO: 96343 - DNA, 1047 bp, Homo sapiens
tggctaaggtacaaaggtccatgggatttagaggtgggggagatgtcacatttcacctgatttggcaactcctgaataaaactttggaaaatgtcttgaactcccctgttgcaaatattctttgcaccctttcacagaaagaagactaaatgggccgggcacggtggctcaagcctgtaatcccagcactgtgggaggccaaggcgggcggatcacgaggtcaggagatcgagaccatcctggctaacatggtgaaaccccatctgtactaaaaatacaaaaaattagccagcgtggtggcaggtgcctgtagtcccagctactggggaggctgaggcaggagaatggcatcaacccgggaggcggagcttgcagtgagctgagattgtgccactgcagtccagcctgggcgacagagcaggactccatctcaaaaaaaaaaaaaaaaaaaaaaaaaaaagaaagaaagactaaatgaaagtgaattagcaatcagtatgtgaaatattgtagccaagtcttttcaaggaattcctgaatagatgagacattaagcaagttaatttctaagttcatgtctaattaattctctgatagcctacctgtataagtaagtcaacacgatgtgcatatagaaatcagtaagattaatactggatgtctccaagtataaattcagaatatattgataacattggatattatcctgtttctaaaatgtgtattttagaggaggaggaatttcaggaacttcctgtataaggaagaaaatttaagttccaatggttattttagccccaattcaattcaattattagttgaataacagccaaagtgatttggtgatgtatatgacttacaagaatcaagaataaatcatttttctatgcttattctagtgttacttaatttactgtgaacagggctgtatttaatctttcttatttgagtggcatacacaagcaagaaaacttggtgagtcatttgaataatctggctggtgtaactgtgaatattcttgggaatgatggaaaggttaaatgcttt

SEQ ID NO: 96344 - DNA, 1049 bp, Homo sapiens
ttggttttccttatattcttagatatatccaaagaggaactctaaaccaaaaaagattagttgtccgacttaaaacagccttggtctaagtaatcatctaaagttctaagtaggatgataaaatcatcttttcatttgatgatgggccatgtggaaaaaacaaactttatttagttatctgtgttataaaataattttcatacctatatatcaggaatagatactcaagtttacacctgtggtctggtaagtcaagtttatgcctgaagcacgctcaaatgttcaggttataagactccaaaaaatgccttagagtgaaaaaggactgacagacttttaatcatggtaatgctactgtcacttttgaagtctgtgtaagttatctattactgtacctttatgacagaaaaagtaatattctaagaacaatatgtgataatatgattgggaaaatttggtatagtatggtatggtgagtagctggacactgtttttccatggcttgtagttaagatataatgatagtgtatcaaattctacttatatggcttttaaatccttatagataggtaatttaacaatttttaaaaagtaattgataagtaatctaattatatggtgtgtaaaaagacatataaatcatttattatgcaggtcatatttgtctttcttttataggatattattgttaagaggggtgcgtgtgtgtatgtgtgtgtccatgtgtctgcacgtgtgtgcaccttcattttgggtactttgaggcagttctattgcctttcacattgggcttgcaaccccagctgcatatgagaatcttgtggaagtttcaaaaatctttatgcccaggtagcaacctagacaaaataaatctgaatttccaataatagaactgagatatcaatacatctttaagcttcccaggttaaggaccactgataaaatacgtgaatacttagtaaagtatttacagcttgtacacatgtagataattgcatggagaagatgaacgaaaattttccttctcctaatacagaggagagtttttt

SEQ ID NO: 96345 - DNA, 1095 bp, Homo sapiens
ggaagcaaatggtgtcagattgggttttcatttggaaaaataaatcaacatctgagagaagcaaatggtaattaagtttaggaacacaaggtagcagaaacctgttactaaatcaaggtgagaactgaacaccggaatttggtttgtttgaggaataaactttggtacatagaataatagggccctggctctgaaacctgcaccagggatagctcccagtgatggtggcttctccatggctcttcagttctttcccattcagactgaccctctatctagagcttccactctgtggcttagtaatgcctataaaatcaggaaaatggaccctttcatcctgctaatgttaatattagaaataagtttataagcgaggtactgtaaaattcattttgcatatcttatttaattcgtatgacctaatatgttaggtattataactcacatttacatatgagaagataaagttaagtaatttgcctgtagtcccatttcaaatgaatgatgacaccataagttaaactttgatgtgtctggcttcaaagcgtgtgttcttaataactgtaccacaaagttacatgagactgagatcactggtatggcacttgcttcttataaactaaagtggctataggaacattctgggggtttaaagcatagttgaggaggaaatttagaacgcttctactagcagtctagggtgtggataatttgtatgttcttctgtcttccagaatcattatggatagagttgttagaactcagagacagtttcttgtagtccttttgataggatccaagttatttgactagaaaacaatgttttagtttgtttagagggaattcctgtattcttacaagtttggttaaagtaatctgtaaattactttaaacttgtgatattttgattctagatcctatatctttgtcttattccctattttatttcctcttattacgcactggtatcaatgggtgtaaaagatcttcttgcactctaatttagagaatatgaaaccataagcttgcttttagttggatctatgactctaagattaaaaagacaaggactgaaaaattatggatcatatttca

SEQ ID NO: 96346 - DNA, 1057 bp, Homo sapiens
tacagtaaacccccacttaacattatcagtaggttcttggaaactgtgactttaagtgaaacaacatacagctggtcctcaaataataccattttattcaatgttgttttgttttaaagttgatgagggaaaaaaatgattttgtgtattgtttcacttaaaattgtactttccaagaacctattgaagccgttaagtgaggacttagtgtatgactgtatgcatcccctcaaatacatactgtgattggtttttctgccttaagtaaaagccagtcaaaccacaatcataaccaggttggtaaaatatagctcatagcagtggtttttctatgttaagtggacatcataatcacctggagagctttaaaaagtcctgatctctgagtctgttaagtcagaatatctggggttggaaccaggtgtttgtttgtttgtttcttgttgttattgtttttttttttaagttcacaagttattctactgtgaaaccaaggttgagagccactgactgaaagcagttctaccaaattacaaactgtggaaggtccacataccttcagtagcctctcttggttgcatcatgacaccattttcagtattgccaaaattatattcctgtctgcaagtgtcctcaggcaatctatagtaaaaaattatgtctccaagaaaatgaatttgtataattttctggctatcctgatgaaaaataagaaaatgttaaaaattgtatttatccttgatctctttctccatacgtgttggcattcctccatttcccattgacttaacgttcaatttttctcttcactgtttttcttgggtgacattgggaatttttaccatctgataaggcagatgtattttcaaataaaaatgtcttaagcatttgttcttcctactattcctttctttggcagaatattcatatagttgataaatagtttgctttctttaaataccttttcatataatctttgtagcatgtttcatgggtattttaacctagttttatggtttttcatgaaataaggtattttctaaatatgttatgctga

SEQ ID NO: 96347 - DNA, 1901 bp, Homo sapiens
ccaaatctgttatctgatagctggggaaactacagtagagaggtgtttacctgagattgttagagcactatggcagcagaatcagaatttagaagcaaagagaaaaaacttcatgaaattgttagaaatgtggtactagagtcattcactgcattagtagttagtagaataggattagtcaacattgacaaaatagatccatttcttcaggaatagatggtattcagaaatttcttagaagagtctcaaatatttcagttgcatcacaacttgtggctatttttcactgaaaataattttatttctctgatctgtaactcattttgagatgaaaatgcatatgactcagtgaactccacttgctgatagcgtattttgttcttccagtaaacactgggctactcatataaaacttatttgaagagtgaggaataagagtttccagcatttgaaactcagaacctgtaagttattttcttgtctctcttttctgagatttgataccacagatcctgagtgaatcagtattatgtacaaccatcaaaatttttaatgctttctctttgcaagttttatataaattatttatcttttatgaataaatttttttcctaagctctccctccaggtttgtcttcagagcctatttaaattttccattgcagggtggctgtagcaacactcctgttctgcctcttcctgtggctatcaggtgaatccttctttttatccctgagtcctgttgggatagctggctgacgtcatgaggcgtgggctgatgttctggtcagttcagagtatgggatagggtaagggagagtttcatgtgttataatgtggtacagggggaagaacataaacttaggagtcagacttgggttccagtcttagccactttctagatgtgtatcttggtcaacttatgtcacctgttcagactcttagattctctaacattaagtcctagagatcaagtgaggatcatgtgagagagaacataggtaaagtgtggaatatattccctgcacatctctctgcccttcccatgtataaggtcacacctactcctctgtttcactttatcaactttaatcgccactcacaggcatctaaactgacctctttttgttgctacctcaatttctgatgctttgagggattattaaagtatatgactcaatttgctattgtatggataatccacataccactaccatgttttgtcagtgtgttcttccatctcttccctcatgactaacttaattcaattcaataactttttacaatgtaagtcctagtcattttcagcaactttttgcaatgtaagtctagtccttttatagaacttgggatactcatgaccctttcctgctgcttatgggtaggtttcacctgctctgttttgtttacattttttttgtgtgtgtttgttatgttttatttagtggctgttattcagcattagcactgtggaagagggctgttatgatcaataacaatcagctattcatatcattatatgtaatctttgagtacttgactctgattgaaaacctgtttctcttcatgcttgtaagtatttcttttatatgtcctgaatgtgcgggttgggttgagggtgcattacttctaactgtaggtagatgattaatatgcaggtaagcgttaatgtgttaatagattttttgtgtgtgttctaaaaagagagagtatgtcttagatgtatttgtcagaaaaaaagttagtataagattttacagtttagcacaaataatatacccagagctaacttgtgtcgggttcaaaaagccttctagttattaccaaaaagattacattagaattttgacccttcaaaaatatagtccttaggtgatagagcctttctcctcccagttgat

SEQ ID NO: 96348 - DNA, 1048 bp, Homo sapiens
ttttgatagaaaaaatgaaaatggtcctaaagaagcagaataggaggaatacttcaaagaaacagctgtgggctcaggctgtgatttcatgtgtaagaaaacatcttttttttaattttatttctgaagttatgtctcatttatacaaactctcttgcctcacaacttagcttatagcatgaaacatgtcttatagggcagtgcccagcccatcacattagatgttaaggatggagcaggctgcatctgcgcagcatccaacttcttccgtctgtccccctacaagattctctactgaaggagtatccatgattttcatgtcagtagattgtcttcacttccaacaaattggatcatataagaatgtgttatagacttacagcaaattacaaagtagcatttctcatccttgaaaaagaccaactcctcccaaggaattccatgagggagtcatgaatagagtgtatcaaaatgggtatcatcttcttcaaatcatattcagctggattaaacgtgaagcgagacaaatgctcaggttgtcaggctgatatttgtatatatttatcaattgtctgctttctctgtcccattatggaaaaagttaaaatttttttcattatggttgcatataattaatataaaaagatcaaatgtttatgtttcctgtggagatcttaaaaaaacacccacttgtttattttttaatgaggagatgaatggatgctatatccttaggagtttaagtttagattttgagtaaattaaagcaaatatactttagattcagaaatatatactttatctgggtttcaggtccaacttagttgtcacagagtatatccaatgtcaaccttgctatgatcactacaacagaatttcatatattttcacgatcatttcactgtctgttcctatttcccaccacattggattgtcagagttgccacagagtaaacaacagtgggtttttcctgtgaatttcctcaatttgtagtagattttacatccctggaatagggattatataaagagcatttctgctttccta

SEQ ID NO: 96349 - DNA, 1045 bp, Homo sapiens
gcaaacaactgatttatttaaattgagcagaaaataataaaatctttaatctcgaatttcattgtgtttaactgtttcggattctttaaacatatatgacttgaaatgtagatacaatgtgtattggaaacaatcgaaacgtgtacaggtccttttcccaaatacatggaatggtgttaatgtgcttgcagcatagagccgttttggttagatgattatagtagcagcttacttgtacttttggtgaaatggtaagctaatgatgtagctgttaatttgaatttagcagacattttaaatataggtttctcttacagagacaaaagttgcaatttaaagctctttggtggtctaaaaacagcttaattctgtagtagcatggtaataagtactaatccagcttatacagtgattgtagtatgtcatgtttgtgaaagattgctcaactgctttctctgggttttatgttaatttaaaaatattaaacataaaaccttataacatcttcatgctgagataaactgttcaatttaacttgtgctcaagcagcagctgtcaggaattatcttgttcctagtggtttttgctatcaccttgtgtcctttcctgctagagacacactgtgggatgataaaatgcaccttgttaggatttattggttaaataatacctgaggcaggatgagcatttgtagcccagggattagctgctgatcaagtgatgtcattcattgtattattatcaatttttaaaaattgatagtagggagcagagtaaaaattgcctatggatcacctgcattccttttgtgggcatattcattacttctttttgggtgttgttgagctaaatatttgagaaattgcttattgaccactttaccgttttacgagcaagaaaagcaaagagatgatggagataatttccactatttaaaactagtgagggctatttcaagattaattatacaaatacagtgaattttcttttaatgattaaacaaactgaaagaagtgttggcgtgggcagtctcaaatggggaata

SEQ ID NO: 96350 - DNA, 1055 bp, Homo sapiens
agtacacatattataattcagaaacagttttgtgttattctatttactgctgtctcttcaccctctttttgtttctgtgcctttggctttccctagctgggcacagtcaggtccactgatgccccctatctgcaaactcagtcttgcacagtacctgagccattcttacctgagtcagctgatagacacatccttagcttcagatgcacacctgctcgttgatgtgacttatagttttatccatccaagacctggaattcgtccgcacagctgtttgggctcctacgttcttccagctgacattcacccctaggtctctcttgttgccagttgccatgagatcagccctaggcctttactttgctgctctttcccttatctctcctcacctttcaactgccacctttagctaacttggccagatttttctctctttgtttttttcccctgatatattctgctttattctataggcaccttctggggctttgatacttcttccttagttcctgccagttctgtccgctgcataatcccagtcaagcttgacatctgtacaagattttccagagtcacttcctaaattctgagcaagacttctccttgaaatctttactcttctgctttattcattgaatttaaccagcatcttgcccaagttatgctcttttgacctaggttttttgattggcccactgtcttttttgatgacaggtgttgtaggtggtactgtttcctttgaagtatattcgttcctggaaccaggtctcagcctcatttgcaaaggcctgaaaacacccaggacagtgtcagcatggtttctcctgaaggcaaattaccgtgtaaaaatcaggagagcaaaataaaaattttaatgcatgtagttactcttctaaattcactcactgatttttgttaggtctattcagatcctttttacagctgaaccatttatcacttgaagcaaaaggagcaactgtctatgccacgtccaaatgtctttgtactatgaaaacttgagatgcaaggcatgttgtgtctaggtttaacatcac

SEQ ID NO: 96351 - DNA, 1405 bp, Homo sapiens
caatttaaattatttaaaataatatttagcatgcttttaaaaaatctaaatactgctatgttttagcaacaaaaatatttttattttgctatggcggatctcaactccaatttccttatctgtaagtggaacaaaaaatatctatactttttatgtcataagatttttataatatttaatttcatattatgtcatgaaaatactttgaaaactctgagaacacataaaatgtgaagcgtattttttagaattacagcataattttcattttgtgtcaaaaataactatacttctgattttcaaaatgcccactacagtgaagatatttttttgaagtacatgtgtgtattttaggaaattccaagttttctctatttgtaacctggttattattctagtctaatggcttcgttccataaattatttgggcttctattttatttattttagtcctggatcagtttggtgctacctttatcatggtgaattccgttattgctctaggggtttgagagtctgtggtttctactcttttggtgtataatttataatttacagtttgttaaaaaatatttcctccaaatattgaaatgtccagtactgtttcattgactcttatcaacccacagaaaattattgatttacttcttaaaaaatcacttcagtttttcacataattaaaatataaagattttcatttacagtaatttgaatttgggcagcattattttgacaccagtaggatcaaggaagttaaaaaatttttgtagatgctagaaagccttttaatactgtcacggaggtgaaagttgtgaagcattagaaacaaaagacatatggtcatttcagacctctttacacagtatataatgaaaaggtaaaaggtccagagtacaattgggatttcggagcaggagaagtctgtcttcattgaagctgtggtatctgacatagctttgaagtatgggtaggattgggttggacatagaggagcagccagacgtgataataatagcatatagttacatagcatttactatttgccagacatggttttaagctctcttcatatatcagcacatttcattattatattaattaataaggtgattatcttcactttcaagatgaagaaactgggatgaaaatttgttgagtgactgcctccaggtctcacagctagtgaacagtggtactgctatttaattcagccctttcagcctcagtctctgtcactgtgttttcttcctctagttactgtgctatattttgggaggacagtaggacagatgaagttaaggaaagttgaagtcatggaaacttttgaaagggaggcagaagcattcatatgttatcaatgtgaatatcaagtagttcagtctttctaggacgtaatttggtacta

SEQ ID NO: 96352 - DNA, 1044 bp, Homo sapiens
ttatttttgagatagttgatcatgctttggtctctaggtgcgacagagacaagatataattatttttttgaagtgtcagaaagttttataattctcaatccctatccatgccttacctatcactaaaatgtccatcacccatccatccatccatccttccatcagtccatccatccatccatccatccatccatccatccatccatccgattgcaaaaggactcagcataatgtcattaattttctttgcactcttgcatggctgattagtttgttaaatctcactttttaggaaaagaaactgatatgttcaaaagtcagttggtttctctattttcaaaggggaaattagtggtagatggttaagatgtagtctgtgttttatcccgttcaaaggcactacttttcaatgttgtgaaagcttaaattaaaaaaaaaaattggtgctacttgtcttttagtttcactaagagaacatatttcttggagttcttctaataatttttttatttgcctggctatctcttcttgcactgatttgaccatctgtattagtttcctaagggtgctgtaacaccagaatttattctctcacagttctgaggccagaagtccaatatcagggccagcagggccacactccctctgaggctctagggatgaatccttccttgcctctttctggcttcttgtggctcctccaaatccttgacattctttttggcttgtaagctgcatcactccagtctctacctctgttgtcacatgaccttcctctgtgtgtgtgtgtccttttttataaggaaaaacatcattggatttagggcccacactaatctagcatgacctcatctaaatttgattaaatcagcacagacattttgaatggggtcacattcacaggtactatgggttaggacttgcatgtatctttttgggggatacatttcaacccactacatcatcatcatcccagaattcagtgtaatatgcctgtcattttctgtgccttcagtttttgttgttaccgttaaataaaggact

SEQ ID NO: 96353 - DNA, 2116 bp, Homo sapiens
ttttttttttaaacaaagtcttgctctattggagtatagtagtacagtcatagctcactgcagtcttgaactcctcagctcaaatgatcctcccacctcagcctcccgtactagctagtacaggtgtgtgcaaccatgcccagatactttttagttttattttgcagagacagtgtcttgctgtgttgcccagattggccttgaactcttagcctcaagttatcctcccaccttggcctcctgaagttcaggaattacaggcatgagccactgtgtgtgacccattgctgggatttaaataaggggaaatgatgctttttcagacaaaaacaccaacgagtgctataatagaacatgagagtgaggcaaggaaaactggataggatgattattacagcagtattggatggagactattgatgagtataggagatgatcattggattctaaatatctaatagaaaaatagtgagattctaaatgagaacattaatagtaggaatggaaggcaggaaaggaactagcaatatggatgaaagttgtgttatttgctttttactagttaagaaatttgtctggaacggaactgaaatttaactttgtcctatctatgtgaaaaggatttgggatataaattaatttagtcaaaattacagaggtcacaattaaactactttagtggttataattattttaaaaactagataatgctaataataaatttttcatatttactcattacattggctcagtaagtttgttttggcagcattttaagttactccatgcacgtaaatgttctaaaatttttctttaaaaatctaatgtaatactgctttcttccacttaaatacaattacatatatacatatacacacatacatatatctacatatatatatatatacacacacacacacacacacacacaaatatacagtcatgtgccacataacattttggtcaacgatagattgcatgtgcaatggtggtcccataagattataattgcctgtttttactacagaatttaccttttctgtgcttagatacacaaataccattgtgttatagttgcctacgatattaaatacagtaacatgctgtacagatttgtaacctaggagcaataggctatgcaaatatagcatgggggtgtagtaggctatactgtctagatttgggtaagtacactctgtgatgctcacacaataagaaaattgcctaatggcacctttctcagaaggtatcatcatcaagcaatgtatgactgtatatataaatacacacaatcaataagtgatccattatttggcattaacttgtcaaacttatcactatcccccctgccaaaaagtaaagtattaagtgcatctgtagagttcatgtattatgctagatctcagagtgaaaatgaatgagtaaagtttctgctcgtcactatacttgatatatagttcagaaaagccagtttcctcctcagtgatctggaatagcaggcatacatttgatgaacactcattacgtgctaggcacaaatgatataaaggtgaataaggcaatatgctttaggaagtaaatgtcttcttttgaatatagtttcgaggtttttttgtttgttgactttggtaccatttgaacaatgttcacttgagtcagcattctgaaagggtcatttactaatatgtttctaagaaaatttcccatacttggtaacctatctttcactatagtagggatctaaaatgtagggcatggggggattttagctcatagtttctctgtatatccagtattgatacagatatttatttgtattcagactgttttggtggttccaagatttttataaaattaaagtagataagaatgtgaattagtttttgtcattattttttcctttatcgtaaatttaaatacaatgagaaatattttcataaaagccaatataattcaaagcatatattatatatatatttcgtgtgtgtgtgtgtgtgtgtgtgtgtgtgtgtggctatgtgtgcatgcacgtgcacatgtgacaattgtattatggagtttctcattcaaatgtaatgattcttagctttcattttgtatcattgcttagtattag

SEQ ID NO: 96354 - DNA, 1025 bp, Homo sapiens
ccaaatgctcattggaaaatttagacatcaaaaggaagcctttttgctttgaaatgcaatttaagtagccattactttgaacaaagtgtagttttattagtgaagaacatcattgagtcattgagactaataattttgtggaacaacattattaagaaaagcattatgctatttaatgagtgatatttacttaagtcataaaggaaaattcaaacatctggaatattttttaagcaatatagcatttatgcatggaatgatgtttttcccctatgtcttacaggaaataacatataatttgagatgtatattagagattttatgttcatagatatctttttatttcactgagcacattaacaaaaattatattcaaatgaaaaatggcttgatagctaattctctgtgatgaaattttatcatgtctttagtaaccccattattgctactttatccctcttaataggttgcttgtctaaagaaaggttgtagaaaccttactggttcacacacatacaactttaccacattgttttggtgttccattttggggtgatacattgacaagtgtggggaagtgatcaaagtatgtgtagtgtctcaagaaattgcttcctaaagtttttaacactagaaaatagagatttgcatttggttgatatgccttcttttaaatacgtattcactaggggcagttatacctgatgaatttaaagatggagtaatacaagagttacagaatcacagaatttctgaaccagaaagggccttataaatgaaggactcttgaagtgaaagtcgtcattagaagatgagttcagtgactgtccaagactagagctctaagtcaagtagtttctgagattactgagttaggcttacagccgaacaaaccaggaagtgagtgatcacagcaggtgagggctttcagctttctgatgttggagaaaaaactaagagtcatagtggagacaatcttatgacatgaggaaaacaaatcagaaaaataaagacacctttatttc

SEQ ID NO: 96355 - DNA, 1156 bp, Homo sapiens
gtttctattgaatggtggcctaggtttgtatgcctggtgttgcataccaaaatctcagaatgtaaattaaagtaaatgtttattaagtttatcagtaaatttttggaagtgtggttgcctggtaatgctaaagatagactattttagcttttacattttcatcttaatattttattacagtggtataatgtgttatagaggtggacaagcctgcagattgaagtggggatcgtccagattgttcccttccctggaccatatggtatagttctaaaagccttttgtacgctgtctgttcagtttattgtaaactcaatctttagtgcgcctaaaaagataaccaaataaaagtgagcctgagaaaacggacttcatatcatatagggaccccagatatatatttttgaaaggagataactgaaaatgaaattgaagttgagatgatattataaacaagggagatttgtcattctctgaattttttttatatcacatggattttcatagattgtctttgaatactgcttttaaaatgaaagcatttatgttatgtgactatagttattatgcttatttatcccattcttagggtttcaggaaaaagaatgtagcattgttctgttttacagaggaagcctctacctgtgactgatggtaaggaatatataaactacaggttttatgaatatgtggattttttgacttaccttcgtgacaatttaggctagataactcagtaatttcattctgtgaggaattacctatacccagagttgaaaggtttctaattcttatttgttttcctttcttccccccacgcctaacttaatatgtttctataattctattttaggaaaatagagtaagagattgcttatcctatatgctaagatcctttagaagcaggaatgagtgattgctcctgactctcactctccttccctccaaagtaagccactgtttgagaagagcattagacattacccactgctttttggcataagagatttgaagttgaaatcctaccaaactgggggataaaaaggaaagcctgtgaagaacatggttctttactctatcattaccctgaaccactgaaagggtaactgagaggaactcaaatgtttttggaatgtgtaattttcctttgaattgc

SEQ ID NO: 96356 - DNA, 1181 bp, Homo sapiens
tgcctttattatatggatttttatgccaaggtatctcttgttgagaccaaaatgtctgccattgttttctatttttgtctaaaattcagggtcagttcatgtcttttacaaattgaatactcacttttagagtgtctgataagtcttggtagataagcaagtgaacttccattaaaataaaggatgtgcatttaaaatatttttcctttgaaataaaaaatgcaaggtaaaacacagaagtgtttttaagtttaccaattcttgcaaaattatagttagtgccctaccattaggagtgtgaaaatgtggcataatgaattttaaagagatgatttgagcaggagactagattttcactatgagcaagcattcgatgaaatttcgtagaatgttcctcacaatgtaaatatgttttctgttgtattaagcaaaacaaatgatttactttcaggtgatctatttttaaaattagattttttagagtgatctattttaaaaattagttttgcaatcaagataagaacagttaatagtcagaatatgtttttatagaaggagattgatattattttgactgatctttattttaaaaattgtcaatgatttttggcaataagaaaattactttgagaagaaaaactcatgtatttttgtaacagtgtaacaaatgtgactgaaaaggaagtaaacagtggctcatgtttgaattattaatgtgaaacatttttatatgccatatatactgggaaatacatctattatgggtactttaagataaaattgtgcaatctaacagttgtttcttttgcggggatttatttttaatttagaaaacactttaaaattattaaaaggatttgtaaaacagaggtgtatcagcagtatgcattaaataaactcacctgttattttctctcattcagaacaggctcagcaacatattggttcactactttagcaaaacaaacaaatattcaaattgctttgtatgcataatacacatgtaataaatgctacagttccccattgctcccaatgctatctttttaaacttgcaaagtggctttttttatgcagagctactaaaatgaatctgggtgggatgcctgttaagttatatgaattaaatctttaggtcaacattttaaacttctgaattctgacagttttgcgaaggcatg

SEQ ID NO: 96357 - DNA, 1096 bp, Homo sapiens
tgagaaatgtttttagcttgagctttgtgaatacaggaagttagagtgcatgctagaaagggattggagtgcagcctgggtaattctggctcttggtctttcataagctgcaatcaagatgtcagccagagtgacagtcatttgaaagttagactagcctggaggatctgcttagaaaatggctctctcacatggctgttatgttgattctggctatttggcaagatgccttgtgtacctttccctaggatggcttgagtgtcctcacaacgtggcagctggcagctggcttcccccaggaagatccaagagagtaaggaagaagctgtaatatcttttaggacagacactgtcactttcactgcattctgttgatcactcagaccaaccctggtatgagcaaagggattacacaaaggcatgaattccttgaggtgaggattattgggggctgtcttggaggctggctacctgtaccctcttctcccctttctttgacagcacaagttgatcggatttatctgtggaagcaaaaaatgaaattcttttaatagaatggaacttgacaagaatttggatagaacgtggttctttatattaagggtacacagtgtgcagtattgtcagccaggttttaaagagataacgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactctttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactg

SEQ ID NO: 96358 - DNA, 1606 bp, Homo sapiens
tgcagagacacctgtagagatcagcacacctgccctcaagcaaaagacagtaattagttgctcatcttcccttgcaaacttccccaatgttgttgtacatgaaacacgtagatcacagcagtgctgtcatgagctccgcactgttggagttgtttatgcccattcaatttttaatgtttctataagacattttgatgggaaccctgagcccaaagggatttgcatgcttgatcaaacttgtgatgatttgaatatagaaataaagagaaacctttgaattactttgactgttaacttttaggaccgccttagtggaaaacattcacatgatacttgaggcaaagatgtgtttgatcaccctttacaacttttttgtttcttgacagcaggtatagcgccagtaaatctaaacaagttctttaatgcttatagatccaagtgcatgtgaatatctgtatagcatggtctgaatattttaaaagatgattttgtaccaatcacttttattgaaattaaaccagtcaagtaccaatcttttagtcctgccacattgtcatatatagtttatattattaaagaatgagatgataggcgattgaactttagtaaaatacagtagtatatatgagttggatatattggggccagataaattatcacttaaagtacttggatgccttttgatatcattgttttaattttaacactatatatggtctagataccataagggataaaagctagtattttaccaagtgacctttcaagtcgtttctaacagctgggattcagttctttgattatatttgtgtaggttattaataaacagcttcaatagagtttcattactgtttcttaaattatattgtttgcaaaatgctatcattcctaatatcatagcaaattccattcacatttattctgagaaaaaataaccctagtagtgccttgttattcaagcatagtctgatggccatacatacatgcatcttaaattggttcttggagataaatgggcattatggagttgtcagattacagtaaaactaaagaagaagatgttatacagcattggactgtcattgacagagttagaaaccttagatgctaataaatgcagtcatcccattgtaccttgcagtttttcctcaatacataggtagaatcttcctgtgagtttctgagcgtagtttttgattagctcttcagcacaaaatggaatgagtgatgtgaatatttaaagcttacctctagattttatgtttgcctgccttttttagccatatgtaagcctaaatgtggattaactggggttactccatttgtgaggtgatgattatgatgctagtacggtagtataggcagaatactctttttttttttttttttttttttttaagtagagtcttgctctgtcgcccaggctggagtgcagtggtgcaatttcggctcactgcaacctctgccacctgcgttcaggtgattctcatgtctcagcctcccaaagtgctgggactgcagccatatgccaccaagcccagctaatttttatatttttaatagagacggggttttgccatcttggccaggctggtctcgaactcct

SEQ ID NO: 96359 - DNA, 1088 bp, Homo sapiens
ctgcaacacctccaatactaccaatattggaaatcaaatttcaacatgatgtttagagggaactaatattcaaactgtatcacctcccattggccccaccttcaaataccatcacactggggataaggctttaacataggaattttgggagacagaaacactcagtccatagcactacagttgttattaagtataatgtattgaaatacctatttagagcatgtgaatgaattgtaatcaaaagtttagatcgctattagggctaactcacctctctctctttttgtctttcagttgcaggaaaattttcatctgttttactacttaaatataactttcaggagatttttaaaaacctaagtcctatttctcctgtggaagtgttaaaaatcctaagaagctttcttgagataaagtttgtcccctttcaattattaaatgtgcttttctcttatctgtgaatttcaccttcagtttactggcaactgcttttttgtgttaggatcatagaattatgattaactccttgcaatctggcttttgtcccacctctgtactggaactgcactcgtgaaggtcactggtgaccacatctagccaaatgtagagggttatttttctcagttctcaatctccttgacatgctaatgtcacatgaccttggcttttcagctacatgagcactttcctttgaagtctctgctgcctactcttcttcctgtaatacctgtctctgaggtgttagggtgggtttgtacttttcctttgctaggcgtttacttattccattttgaatcttataataactttagttcttcttgtttagcatttgtatcacagataaatcataattctcacactctgatgggtattgccggtgattctcagagttctatttcacatcattgcctatcacctaaactctagtcctgcactttcatcttagaatagatcccaaatcatctccttcagattatttttttttcctctaaatatctgcatttcttttaaagaagcattctcttaataccttgacatttttagtgtggtgtcctttatgctgtgtcccttaccttccaatacctcta

SEQ ID NO: 96360 - DNA, 1480 bp, Homo sapiens
cacggtatatattgtatttatactcttttgggcagtgggatggggctgaaccattcaaaagtgacgttttaccccttcagcttgtttatcttaagaattaaaatattctctctctgggcgcggtggctcacgcctgtaaatccagcactttgggaggccaaggcaggcggatcatgaggtcaggagatcgagaccatcctggctaacacagtgataccccatctctactaaaaatacaaaaaattagctgggtgtggtggcaggcgcctgtagtcccagctactcgggaggctgaggcaggagaatggcgtgaacctgggaggcgcagcttgaagtgagccgagatcgcgccattgcactccagcctgggcgacagagcgagactccatctcaaaaaaaaaaaaaattaaaatattcttctatgtagtcgtaatacttttaccacaccgaggtctttaccattggtataataatgtatactatacagtctatattcaattttccctaatgatctaagactttttttttcttttttaagagatggaatccagcccggcactgtggctcacacctgtaatcccagcactttgggaggccgaggtgggtggatcacgaggtcaggagatggagaccatcctggctaacatggtgaaaccccatctatactaaaaatacaaaaaattagccaggtgtggtggcacgcacctgtagtcccagctacttaggaggctgaggtaggagaatcgtttgaacccgggaggtggagattgcagtgagccaagattgcgccactgcactccagtctgggagacagagagagactctgtctcaaaaaaaaaaaaaaaaaaaaagacggaatcctgctcccaaaggtctgggattacaggcatgagacaccacgcccagccaagactagtaattttgaattactgaaccgagacctaccatttaaattgactatatgattttctcttacttatgagggaccagaaaagtcatgaggattatttgaatttttactataggccaggagttgatttattcttgagtaagtgtaatagaccagaaagagacaaaaagaaagtttttgcgtgaaatccattgtttctccgtggtcaagctggcaggcacacttttaaaacaatgtctgaattcagtatgctcttggcattattcaagaatagatttcttgtaggtaaaattgacagagtaatgataattgttgaagctgggtgatggtggttcactaaacttttctccctactgttgggtataattgaagattttcatgatgaaaagttaaatgatttttttgactctttgtgttttctaatttgtagatttggaatgttagtaaatcacgtaatgcattccttagtatcagaggaaatcaatttataaaactaaaacagtaataataatagttttccatatgtagggcaaactaagctaagtcttttccaaattcacacctctccaa

SEQ ID NO: 96361 - DNA, 1043 bp, Homo sapiens
gttcatttatatttttctcatacaatttgtatatcatttggccatttaattatagataattaaaaaaaatagtttttactgtggtaaaatggacctaacataaaatttactatttttaccatttttaagtgtataggtcagtggcattaggtacattcccattgttgtgcagccatctctaccatctttatccaaagcttttcaccttcctcaactgaaactgtacccattaggcagtgggtactcactccccaggcaacctggcagtccgtggcagactttgtctttatgaatgagactactctaggtacctcatataagttgaatcatacggcatttgccattttgattgactagtttattttacttagtataatgtcttcaaggttcattcatgttgtagcatatgtcagaatgtttttcctttttaaggctgaataatattacattgtatatacatataccacattttatttctccattcgtccactgatggactcttctactttttggctgttgtgagcaatgctactatgaatgtaggtatacaaataatctgttcaagtccctgatttcaattcttttgagatgtatacccagaagtggaattgctggatcatagttttattttttgaagaactgctatactcttttccatagtggctgcaccattttgtattcccaccagcagtgtacacggatttcaatttctccatattcttaccaacacttgtttttaaatttttaaaaaattaaaaaagagaactctatattacagtagtagctagcattaagtaagggcttactgtgagcccaagtgctgttctgtaagttttacatgtgagaaacttttagccttcacaacaggtttccaaaatatatatatagagaatacgccattaatagagttcctcggataacagagtgatacactggaactttgaattgaggcaccagtattcaacacatgcttctatatccaaaggaagtgctagaccatatacagaattatagaaagctggttttgtgacatttgaatccct

SEQ ID NO: 96362 - DNA, 1012 bp, Homo sapiens
acaataggggactatgaaagatggaagggtcacctttttgcttgctgtaactgatgacccctctgctgtgaagtcacttgagagtgactgagaaataatggaatttatctggggttttgagagatggggaagtgagatccagagaaatatgtttgaaagcatatattccattgagttcagttcacttgaccagttttttagttcaataggatttttgttcagttgaataaacctttagtaagtgcttaaacagaatatgtaaggtactgttctaggcatttcatgaaaggcaaagatggctgtggtgttttctgtcctcagggagcttctgctttagtgtaaatagctgaagttaattcatggcagaatgacataggtactttaaatgtgtaagtggcagtactatgggaatttggaaagaacagtgaataccactggggttcagaggagtctgtggaggaggccaactttgggctggatcttgaaagaacaaaaggatatcaagtaggaagagaggcattctggcatgagggaataaacaaagccatggaaatgggtgactgagaagtaattctcattcacactggaaaatgataattttactttttaaataatgctttcaaccatcaattaagcttgcttgcccatgttataattccagttgaatcttggtatttttatgtcatctttgcagttctctagtgatgcgcaatgtgtcttcctttatgagctatagcgtgcattatcaagttggaaacgttactcactttagtacctggatggttataagcatcaaaaccaaacttctaagtctaatcacaaagcctattactttccctgatttaaaacagtaaaatgtagagaagatgatgatttttacatatcctaagaagcacttggcagagcaattagtttcataacaagtgattgttttttaaagctctctctagaataagaatgagtatcttgatgctagtgtcacttttaaatagctatggctccaggaatgtgt

SEQ ID NO: 96363 - DNA, 1800 bp, Homo sapiens
ttttagtattgggttatctcactgtaagggaaatacagtaaagaaaaacatctgttgactaaaagggttaatttcaggactatgattttcatgtggaagtgtttgcctggaggattcttgaaattttgccttcatctagagtatttaaaatgtttctatttgcaaaaagctattatactcagaattttctaggaaaacatccttttcagtggactcttcaatagtaaagagtcacactgtatggtgttagtgtccatagaacagttgaattcataaattaatatttttagacctatcaactaaattaaattcacttaaaatgatttggcaagcaggtatgaactgaaaataaacctatgtatttttgttttttagaagtattgaatcagaagaaattggaacatcaaagtattctctgaaccaaattgatgttttatttggttgagagtccttacttttggtatactatttataccagtaatagagtatttgaaagcagtgctgggaaatgaggtgcatggattctctcaatgttgaatcccatttttttccctcagtgaatcttcaacatttttaaatcttagcattcaacaaaaactctacagcctagatataaaccatagattactttttatatagcatatacagttcatcaacaaacagtaaagtttccttcatgacttaccttgaaatctttattcaaaggatatactattcaatttttcagtgtgccactgccaccactgcatgtttttggtcagagtgcagtgcaactaacatcgccatcctgctaggaaaaagatctgcaggttgctggatagtggaagttgcacacatctaatttacaagtcagattagagatcagaatcttacaatagctttatgtggaattgatttcatttcatggtttttaagctgttttttcattgaagcaatgcctgtaactgaaagacaggtgtgttgtagcatttgaataccttaaactcttttgaatctggaatgaaagggatgttctggattctaaaactcagagattttgaattaaatgccatcattcatttattgtgccataattgaactaccttgagaactgaatttggaattactgtgattaatatttggaaagctttgccattttcaaatacaagtcactttaggaaggaccacaatttgtgtgtgtgtgtgtgtgtgtgtgtgtgtgtgtgtgtgtttatttaaatagagcagcaggcacctttttaccttatagataaggtaaatttaataagaaatacgtggtttttaacattgatatcccattctatttaagaagtccattgtggcctttctggaggccttcaataaggggaaagggacgatgaatagaacactgtagattgcagtttatgtttttccttttaaggcaaaccattttcaaaatataataatgccaatgaatacataaatatagattgatagtttgaagttattttaagtttacctgtctatattaaaattgagagccatctcataagagtgagtataaaaaagttgttcattttagagtgcatagtgccatttaattgaattagagaacacagttgcaaaaaaaaagcatcttttagatggttcttgagccattaattgatttattgaatataatcaagaagaaaaatccagatgtttaaaactagttttgtatcaggtcagaagagtatttagctttattctcctccactcccttgtctgatgagttctcataaattgctttctgaaatgacaaaacattgggatttggaaagccttgagaattcatcagtt

SEQ ID NO: 96364 - DNA, 1086 bp, Homo sapiens
gaatgccgtgactcagccccttgcccacatgtctttggcaggaaatactgccagactagactgatgtctagtacaggaagtccattacagagaatggttgatataaagcagaaattcagaaccaggagagtttggggacatggagcaggccaaagttggagaactggaatttgacctgaaggtgagctccttgtcctcttcctgcccaaagtcaatattaaccccttggattgaggcaaaactgagccaaaagggagaccaaagtgactagagctgtctgcattgtagtaacaggtctggccaaacaaatacttgttagttgaatggatagaagtaagacagggaaacattatagtctttccacttaggttcttcatgtgacatacactaggtatcatgttacctactcaccaaaaaaataatttaggccaggggtttgcaaacttctccttggaaggaccaggcagtaactattttagtctttatggaccctatggactctgttgcacctactcaagttggccactatagcctgaaagtagctgtagaagcatacctaaatgaaagaatatagccatgttccaataaagccttatttatggaagtggaaatttagcttcatataatcttcacatgtcacaaaatattagtcttcttaaaaaatctggtttttcaaccatttacaaatataaacccattcttagatcatagatatacaagaacaggttgcatgccggattttagtgcccaggcaatagtttgttgacccttttcaggcaaataaattactatcagtcatgatgctgaaagcttagcagtgctgaaatagatgttttataggacgatgctgttggtgacactgtcttattttataggtgacactgatgataaaaatccatccaagaatttatatgtgacatctgcagcaggttcaaatctctcagctatgagacaaactggatacttcctaaggattgccatctattatgcacagagagccaaaatccgttactgaaattgtctgggtgagccgcctgctgggtccagtgatgcactggtagacaaaggagttgaaaaagaagtgtg

SEQ ID NO: 96365 - DNA, 1571 bp, Homo sapiens
cgagattgtgattcttttaggtcatgttaggaatcattgatgggggaggcaaagttgctctatagttttgttttttctttgctacacaggaatccagagtgtggtattctgtgacgagtataattgctcatctctcccctgcactgcctgctgttttaggtggtacaccacagccttccattttgtcaccttcctgtcaaaagtgtgtgtgactccttaagaatacaagttgtttgaaattaaagccacactcctctgtccaatctcaagatgtttataattcctaaaagttgagttacagcaggttataaaagatatgggattgaggtagatgaaccgtgattccttctctgtcctcctttgggtttaaatattaagcagctatcttgtagtgtaggcccttaaaatagaaacaaagggttggggcatgatgcctagcctttatagatcctaacttgaaatgaaaattttatggattgattagagttttaggagaatgattatctgctgcaaattactaaggtttgcagcattcctgggctcctggcatctgaaagctattgtataatctgtggagagcctgttaggtgtgatgacgtttgtcttctaggctttttttttttttttaaatggaagcaagcatgtctcagccacagagatgtgtactgacaccttataagtgaatttacttttttctttactcaaagcacctgaaaacatggctctttattttcagtgtgcaccagcttccttttcacctcttggtctttaagatacaaggtgattcatatcttgattaccttgggtaggtgggtatgatatcagcaagctctgtgtccggaccttgtgagcaattcctaggtcattgcctgaggccttcttaaatatatgcaggtaatgtgactgcagattttgggtttcacagtcagtccagattgattttgactctgggccatttatgagcagcaagcctttgcggggagttagtaactgctccgagtttcagttttctcctatctgatgggggggattagtcttttttagtgttatcttttttttagtaacttagttgtattaatctgttgtcgtattcaaatggtgtgaattaatgaactatctagagcatatcattttaaaaggaagtaggttttgtactatttaaagacagaggtaatcaaattagtaaaaatctttccaaatagaggtcttactcaattgactttaaaactgtataagactcttgtagttatcagtttatttatatacaaataatacactcctgcgtggtatagcaaggcagagtatgtattgtattctgtagtcagacagacttgtattggatgattcatcactttccacttcggtaaccttgggcaggatactttacctatttgattcaaagttttagtctgtaaaactactaatgaagatttaaagaatagagatgtaaagaacaataaagggtaataaggacaataaaaaggtggttgtgaagacttaagaggaaggtatgcaaaatgcttggttatgcctgaacccaataaatactgatagttgctgttgtgaccttg

SEQ ID NO: 96366 - DNA, 1347 bp, Homo sapiens
gattaagaactgaagcccagagagggtaagttgtttacccaatattacccagcttaattggaaacaaagccagggttcaaactcagactttctgtctcacatacctgccagcatctggctcatgttaatatttaacacttatataaagctattcaacatcaaaattccttgactttgcagctttgcctacatggtctgagtgatgtataaaattgcacttggcattagctaggaaggtatttctgtcgaagctgttttgtcccactggtttcaaggattcctgttgcacaactttcatctcagtcagggttcatctgcatgatccaggcaattctggccagacctccggagccatgaaccaaccaaatgcattcatcctcggtggtgacaaggtctttgcctaattgtaagaattattaagaccctattgccaagaaaattacagcatcaccgggaaggtaaaatatgaaacacaaaatgataattcaacactactaacgaaggattcgattgtaaattaccaattttaagatggaaaataatccatgtaaattaagggaagacttcttaacaataacaacaaaaaaggacaaaaagtgaaatttagaatttaggttgccttatggagaaaaaaggtaaaggaaattgcttaaataaagaagttaagaagaaaataagcacatcaataaccaagaaaaagataggagatcagctgaggtaaaacaggagattcattttagaaacaacagaaaactagctgaaataatagagtaggatcattgataaggggcctaaatttgagcctgagatatttattctaataggaaatcatctgggtggacttgcaatggggaaaggaggacaagacagggggaccatagccttgtccagttctgatgaagcaaatagaatttaaaagaatcgttggtcgtaaatgcaactaaggaaagacttgggttcactgagtatatgtaagaatcaaagatgagaatgaagtccaagatgactttaggattgtagcaggagtcaataacaggacatacagaacttggcaccttagagttggaagatgatcaacactcactggtacagcctctaaattgatagacaaggaagccagacattttcccaaggtagaccctcatcgtcacaaactcattccagaaaactgtagtttactgtttaaatagaattagaaggtaaaaaaggaaatgctcaccctgctcctgtccctgctggtgttttatggtcagctaatttttatttctacttcagccccactgatataaaagtgctcagtaatccagcatataatattacaataggaaataaatcaataagtgtttg

SEQ ID NO: 96367 - DNA, 1110 bp, Homo sapiens
cttttgtttggtttcacagattcttctcttggtagacaattgcaattgttatctaatcaaggaaatgtaacggtaattttaattatcattttaggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaagga

SEQ ID NO: 96368 - DNA, 1042 bp, Homo sapiens
ctctgtaccttccaagatattttctttttaaaaagaattatttattcattttgatgtttacttaaatggcttaacataatattcaattttcttccattttttatgaaaattaaaagcatgcaggacactaaaccagtgataatagagtacctgtcttccactgtgaacacaggcttgctacaaataaagaaaatgaatgccaaagggaaacagaaaatgataaagaataagtatctggtctatatttcattacctgtaaacactaagcaaagcccacttttaagtatctttgagaaagtattctaaagcaacttgattatgggggctgactaatttggggaccaatatttctcttttatttagagttctgttaacatcgcttgaattttaggcaataatttttaaggccagtctatgttgatatttattattatctgtctgaaaaatcaattatctatctaacgcagccataaagatatctataaaagtgtcattaataagcaacattagtaagagtggccaacatattgccaagagaactgaggctttcctgacaaaaagggacctgaaaattcaccctaacaatctaacagtattaaaatacacatggtcatgaggaaacatttttaattaacattcttttttatggctgggcgcggtggctcacgcctgtaatcccagcactttgggaggccgaggtgggtggatcacgaggtcaggagatcgagaccatcctggctaacggtgaaaccctgtctctactaaaaatacgaaaaattagccgggcgtggtggcaggcacctgtagtcccagctacacaggaggccgaggcaggagaatagtgtgaacctgggagacggagctggcagtgagccgagattgcactactgcactttagcctgggcgacagagcaagactctgtctcaaaaaaaaaaaaaaaacaacaacttttttttggtttttttgagacaggggtctcactttgtcactcaggctggaatgcagtggtgcgatcacagctctctgcagcctcaacctccc

SEQ ID NO: 96369 - DNA, 1042 bp, Homo sapiens
ggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtg

SEQ ID NO: 96370 - DNA, 1097 bp, Homo sapiens
tgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttatatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactagatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatct

SEQ ID NO: 96371 - DNA, 1024 bp, Homo sapiens
ctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaa

SEQ ID NO: 96372 - DNA, 1040 bp, Homo sapiens
gaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaa

SEQ ID NO: 96373 - DNA, 1010 bp, Homo sapiens
tgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttc

SEQ ID NO: 96374 - DNA, 1066 bp, Homo sapiens
tgtatatcgaattttaaaacagtgtcatctcggccgggcatggtggctgatgcctgtaatcccagcactttgggaggctgaggcaggcagatcacaaagtcaggagattgagaccatcctgaccaacacggtgaaaccttgtctctactaaaaatacaaaaattagccaggcatggtggcaggctcccagctactctggaggctgaggcaggagaatggcgtgaacccgggaggcggagcttgcagtgagctgagatggtgccactgtactccagactgggagacagtgcaagactccgtctccaaacaaacaaacaaacaaacaaaaaacagtgtcatctcattcaatcttttcctaagttaattacatgatggaatttaagtttaggtgacagacataagtgaatttacatgtttgtacctttcccctttattacataagtaaatatggctttcaactgaaggaaacaaaggtattagaatgtaatattggaggatgcaatcatttaaatgagaaaccttagtggtttatattaagttcccaacatgttggtttgatagataattacatgattaggaagggttttttttttgttttttgtttttttgtttttttgttttttgttttttaatcctcccttatgtagccaagaaaccagaatgccttctttggaggttaggatacaaattacctaataagtcatacactttgtgtaataaaatcacatatataaaacctatggagtacataagtggttatcctgaatattcctgctttatttttcataaaaggataaatagtaacattcggggtgtggttttatcaaattttactttttattattaattttaatctaatttaatttaagaatatattttaatatgaaagacatgtaataggagtggcgtgtttgtgtaataagaatgtttgcatgggtatgaagaatggaggaaaaaactatttgcttcatgttaacatgaaaactttatttccttactaacatgacattattacagaattaagtaatttataaaggtaaaatttttattgcaatatgcttctgaa

SEQ ID NO: 96375 - DNA, 1341 bp, Homo sapiens
aagtaaatgcaagggaggagaaacattctttgctttggctttctccttcctgccccccgcctcgtttttctcattcattcattcattcattcattatcttttctttatttctgtatttattcattcctcttttatttttacctttttcttagggattcccttgctattagttgtatgatgtacttttggaagacggtggttactcacgaaaaataccttttacacttgagaaaaacaaaacaatttcttttaagtacagtacattatcctgctgagctgtcatatgagaacagaaaagtattcttgttcaaactcatgaagttggaaaaaaacatgcaaattaagtgtgaagcataaattgttctgaaaacaaacaaaaacaacaacattaaaaagaacaaagtcatcaagggaaattcaaattcaggacacagctgtgcacaaccttacaaagcagagagtggcaaagctcacataaagaaaggaaagattacattaaaagagaatgctcagtgaaacaagacatgggctaagtctacttttatttagaggagatcattgtaagatattttaattactgcttagaaacacctttaaggaacaatttccttttatattaataatgaaattaacttttgtttcaattttgttcggttttcttcatagcagtgggacttataaagtgaataggttgtcatcaaatatgcttaagagatcactcgttcacttgtttactaattcagtaatcttttattgctcccctcctatgtgatgggcattcatgtttcacaattaggaggtacagtcctgaagtttcatgtactttaacatcctgcacaggatactcaatgtcaaatataaacacaatgattacagtaaaatgtgttgatggaggtatatccagagttcaaagtggcacacaaaaagacccttcagtcatattaggggcataaaggttaagttgtgtgtgcgtgtgtgttgttggctcactgtaacctctgctcatggttttaagcgatcctttcaccttggcctctccagtagctgagactacaggcacacaccaccacacctggctaatttttgcattttggggaaagatggggttttggcatgttgcccaggctggtcttgaactcctgagctcaagcaatccacccacattggcctcccaaagtgctgggattacagatgtgagccaccatgcctggtggtggctgtaatagggtgagcaaggggaggtttctggcatttcaagcaaagaggcccatgtgagacacagtggtctacaatagtttgaagcaatctaaagctacaggtggttaactgatggtggagcag

SEQ ID NO: 96376 - DNA, 1378 bp, Homo sapiens
ctttttgttctgttttgtttttgattttggattatgctcaattatgagtgtcagaaaaatactataacaatcagatataacagaggtaaaggacctggacagagtacccatttcggctacctgggcaaaaagaaaatcaactatttgactgaaacaataacaccagcaacaatgaaaacagcacctggaacaacacaaccctccttctttttaaaacttggagactcttagttcctggcacttgcaatgaatattagtgttcaataaacaatagattaatgaatgaatggttataaaaatgacaaagtactttttttacagcctttggatgaaaacatgattattaagacttgctgctggaaaaaaataaatcattcttttatttatcttcaaatccaagtagtttccaacatgtacacccaaatcaaaattatgagtattatttttaatagattcttttttcttcttgagtttaaacaatgagtcaaattttataggcaccccaaagctatccaaaaaaaatctgcccttgaaatgctgaagaccttcagtgtgaactaccagtcaaattgcaatcgtattttgaaatcttaatttccttcccaagataggactttaagcctttttctattttgatgatgaaatattggatttatagtatagaagggtaaacttgaattttcataatagtaaaaaaaatacaaagtatcattggcaaaaccactataccctcacaaaaaatgaagcactataaatagaatattccaatgggcagatgttagcttaaagtgtgcattgtttggaaaaggagttaattaacaacttattaattggatagaaaatctgaaactgttgtacttctagcaaatacataattttcttcaagtattattaaagcatttttgttgtacctattaaagattcttgtctctaagttaatttcattatgctaataagctatcatcgttacagaacctaagctttgatccatgttaattgtcgtgatcttcaaagacaaagtcaccacttactttaaatgaattttacatctttttaaagaatcatacggaaattaggggaagtaattaattttttattatgtgtctcaatatttttaagggaggaagtcaatggtattggctagaattcattttaacatttaactagggaaaacagcatgaagcaaaaaaaactgttcagatgcaaaagattaaagaaaatttgaaactgggacctaatttgtcttgataaactttggtgtttaatatgcttcttttgttctcagtgtgaaactgcagggttttgatttgtgaaaactttttgaagaattaattctttctaatttttcttcatttctttgcctttcttttacagtaag

SEQ ID NO: 96377 - DNA, 1154 bp, Homo sapiens
tttctgaagatatttacatgagtttttttcttttaaaactaagttctgtaatagcatatgaacatttattgtatgtgccatcttacaaattttcatagacaaaatcacacattttcatgtgtatgaatgtgtaatttctctcagaactgcctggtggcagtggggggctggaggctgtctacattatattttgagattgaatgtaattcaattatattcacctaaattatatttcccattatattttgagattgtttcaattgtattttgttttgtattttgagattgtttcaatactgttttaatctcaaaatagaatgggaacaatctcaaaatataatgggaaatataacttagggtgaaaagactcataaaaggaaattatttacattaaaaaatatataactcccaaatcctaagcaactcttatccataacatctccctcaaacatattaaatcatacttcaaatgtattatagagataatagtaataaatttgtgaaattattctcttattgaaaatgttcactttaggctacaatgaaaaatctggggacatgataaaagtgacaaagaactcaaagtttactcttgagaggattgtgttagacttgggttgaggagggaagaggaataccattcacatccagctctaccagtttcttcctaagctgtcagagggccctgctgtaggtaggagggagaagaaaaacttgtagaaagtggatgaacaacagccttttgtttttccacttttgtgattgtaaggaaagaatgaagtgtggactgctttccttgacagatcttaacacagaaattcatagattcacatacctccttttgtcccaagcaaagccctctggtcactaagctaagaggtcactgctagatatgactgtttagagcaacatgtgccatgtacaagtggcaaatcctatggaggctcagaccctctatgtatagctttaatcaatttaaagttttagaccagctgacatatgatgaaaattatgaataaacaactttaaggttaggagataagaggtttacgaagctaaaattgttagatagtttaatcaaaggtggaatttattgaatataaaactttgttttaagactttttattaaactattagaacaacactgcaatggc

SEQ ID NO: 96378 - DNA, 1032 bp, Homo sapiens
ctcatcattgcatctcaaacagggcacagaaaagggcaggttatggtcctcttccacaataagccatctaaattttcacaacatgaagaacttggagaagtggcaattatctggttaactgactaactgtagatcataggcatcatttgttgtaaacattatttagggttcagaataattcagtttggggaaataaaatctagtttgaattcaatgacagattttcatgtgactctgctctttgtgtcactgggtagatgcatgcgattccaatcatcacatagtagcttagcagaatggagactagtaactagctcattcaatttagccttctctttgggggtattacggcctactgagtacagagtgaatgaatgattctgatgattataaaggccattgaagatctctactagtcaatttttcatttgccttttaaaaaattgtagtttcagctttacttttatagctccaggaacatccagttacatttttctttattattttttctttaaagataagatcatcaataagacgattgtcttgctcatttaaaaatattctttttctcttcccacatcccaaaaattacataaacttttccattcttaattcaatgacttaaacaactgttgtgaattcataaatggaagcatttgactacaggtggggattaataatttggaagggcaggaaaactgttgaaaacaaagagctagtgtccaagtaaatatctcttgagaaattaggaagtacaagttacactgcatgagaagaattgttactgagtgtaatggtttaaagaattccaggtggtctgcgtgggtcataatgctagcatttcatcttggaataatctttattcttttctttcctttttttttttttttttttttttttttaagaactagggctgctcctgcaaagtgctagaaagtttgttcctataggctctttaagtctgtagctacattaatacaaaataaaatgtgaaagaataatctgttaggaaagtgtttcttttgtactaac

SEQ ID NO: 96379 - DNA, 1154 bp, Homo sapiens
gagtaaactccttggcatggcttcttctacaatctagtcccaacttatcactgcattcgtatctgatgtcacatacctccagtcacaccatacagtgacatttccccaagcatcatgcagttttaagcctcttcacaaagatcttttctctacctggaatgctttacttctttcttactcaccaagtgcatcctgttcctttttcaagacccacctcaaatgtcttattctctttgaagccgttttcaactttcttaggaagagtcatggcttcccctattcgtataacacttatcattaactatcacccctagaagcaatacactgtatctccaccctaataattaactcatcactgccacaaggtaggccttaagtaaattagtatatgaaaaaaattaaatgaatgagcaaatcgatagtttattcacacatagggatgtcattcagagcccacagtgttcagttttctcttctcttttcacatgggtaagtgatgcactgacctcatcagtgggaattgttctagtttatttttaaaaggattttgctgcatcgggcagtcagtgccatcaaagaaaccttgatatgcttgtgccttttggggttggatagggaaagtgaaaccaaaggtcaactacagaagcagaggccactgatggctggataatgaatggccactgacttgatactacaaacagaagaaaaaagtggcaaagcaatggaactgtcaggaacaaggtagtcatgagcctatttattgacttgatccttagtcaaaaactttgtaaaattgttttagcagtaatctcccagtttttagtagcgggactgcagctaaaacaatttcacttaatagcagttagatattataactacaaccacctggaactgtaattctctcactaccttccttcaatatttccactgtcacagctcctcaacgaaaataatctcttcttatagtggaattactgaaattgatctatcagtttatatccatgaatcagcaacaaatacatttttaagaaataatttctgttctcaacttaatagtttgtttaaataactgacatctacttttgttgttatgggtattagtacatcaaaatcgtgcttgtttagcctagtaagtaaattatacaatcgtggtt

SEQ ID NO: 96380 - DNA, 1096 bp, Homo sapiens
tttcataggtataagcagccctaataagatttggtgattcagaaattagagtttattataaggaaaagttttttttcatattttagaaacagattttaggttatttcatatgatatcatgtgtatgccattcatcattataataatagcactgccctatatttgtctaatagtttatagtatagaaagtattttaaaattaactcatgtctttatagcattgcatatcttatggtgtcatacttttatcactccccagagttagaaatatcctcgaaccatgcttgttcttcacaggtgtggatacaatgctatttctgtgagattttcccccatgcactcacattgtttattgctcctacagatcaagggctagaacagagccaacacataagctactcatatgttgcattcatattctgaattataggacttgtgtaaactattaaataatctctttaatttgtctactaagattgcatgtaaaaacagttaaatatggcaaatttggctaaagagaacaccagaagagaagaaatgcatgctgtcgctttctctttctgcctaggaggatctaactatcactgtagttgaagccctgtgaatgcaaatgcttggtgtcttagtttgggtttccccagaagctgaactagacataagggcacgagggcaagcagtttatttgggaggtgcaggaaacactagttgagggtggtaggggagaggcccagggcagtgaagtcatccattaaagagtgctttattaagctagctatcactgtgtgtggctggagcttaatcctgcaggggacctctggaatatagtagaaaacacacacctcagaatgaccccatctgagaggtgagaaagttgagatatttacataccacctcctgagactcactgtatgaagacttattggataggggtgggggaagagagtggcagtggtgatggtgtgttcatgtttggtatttctgagctgacatgtgtgcacagagtagctttctttggtccagaaatgaaaaccccaggcacatagatgcaaatgatggcaggtggacaccagtcagatcacagaaccaactctgcagat

SEQ ID NO: 96381 - DNA, 1021 bp, Homo sapiens
ttccatatctcttacttcccagtaatacaatataatattagtaattttatttcatgtttatctcttcccgaacccactagggtatagctccatgagggctggtgtcattgtatgttctgctcatatgtttactgaaggagtgatcagcacttgtagatgctcaatacataaagaacaagataattaatgttctttcctctttctcttgaaatttgctcttactctgttggcagaaatagccctctgaatccacagtgcccaggattccttattatttgaagggttttgtatacaatttccatattctttgaaggttctctccattgagaaatggagtgtggtatgaaataaagaattgttatttagtctacactttgaaagacaccttttatttctggaaaattactaaagttagatccatattcaaaaaaaatctaataacatattgagtaactccaatatggcaagtattgtatgtattatttcattcaaatttacagtaatactgagtgagcatcatatctgctttaatgatttgaaaattagaggccagagaatttggtaatttgccaaaattcacacagaaaatgaactgttctggagttggagcctaggttttttctgactccatatcacctattgatcagccaccttgataagataaattattaatagtatatactatgtggatatgtatcatgtggatgtgagaaaaattgaaaatgcacaaagtctctgaatctaacgagtaaagaataaatactatttaaagaaaatatacctttatctaagacactttatcacatttctaacttaccttgcttgtaggccaccccacacggaatatcttcatagctgtagaggagcctttgttaaagataaatgagatcatgggaattgaacattcatatgcaaaaaaccaattagtgaattatacttactaatttatgccaaagatgtatggactataacaactttagagttcaatataccaacattttcaaagtgctgttcaaagtag

SEQ ID NO: 96382 - DNA, 1044 bp, Homo sapiens
ttacacacaacacttgaagggtgcagtcagccctatgggctccacatggacccatttgcaaggaatagtgacagttaaagacagtgtgcactatagcacagcacgtaaggaacagttgagggaactgagaaggcttacctttagaaaagtcttgagaaggacatggtgccttgaataacagacttggcaaaaaaaaaaaaagggggggttagagttactctgcatgatcaagaagaaagagaaccacattgtagaatccttggagggataaactagaaaaataatataggcatggatgtcagacagatctaacatggaactctggcttataaagctactctatgagtttgaataagtttattttcctcttcttcacctctattttcattttaataatatgaggaagatctctatagttttgatatcaggattagaaaaatgcacgaaaaatacatagcttagtgcttgttggagtacatactcagaatctacaacagctgtgataagaatcagagatatctagagcataatggacaacattgggaagaaatgaatgaaattatcctcactagaaatgttggtaatactaatggaccaaaggacatatacagtgttggaggtggataggtgattaaatagatgatgtatagggtttttgttgttgttttgtttctgtatcctgagaactgatgaacatttattatgtagttggatacatagaaaaagaacacattaaaagtaaaatgaaaacaaagagcagtcaatctatgaagaaaattatttttcctcttacatgttttgtaaatatttagaaagatgatgatattttcttttaaaaacagaaatcttcgctggtcatggtggctcacgcctgtaatcccagcactttgagaggctgaggcaggtggatcacgaggtcaggagattgagaccatcctggctaacatggtgaaaccccatctctactaaaaatacaaaagttagccaggtgtggtggctggtgcctgtagtcccagctacttgggaggctgaggcaggagaatg

SEQ ID NO: 96383 - DNA, 1046 bp, Homo sapiens
taacattactaccattttcctaaagatgtccctttttaatatctcttttaatgctggagattatctaaaggctttcaatctttctgtttaaaatattcaccaccgagcttaaactaggtgtataagaaattatttgtttagaacaaagtcaaggtggagtaacatgtgttacagaaaatgttttccatgcaagaatctatctcatgagggtgtgagttatttgaaccaggaaggctacaaagctagcaccactagcccatatttctgggctgtttgcttttcatgaggtagtctaggtatatctactttcctctcttgattgtcacttttctacatgaatctccttttacaattggcaaattccatttcatgttttgtgtaatgtctacatttcgtgagtaagaaagctggctcacaggaacatgaataaaactttgacttgataagaatgaaatagcactaaatggaaacgcgttttttttattgtatagaaccatctagaaccaaatggccagggatgaggctgactttgcaactctgtggttgatttaacctgcacaaattcacatgtctaataaatgtcacgacgaagatctgcacctatgctcagaggccccagctctttccgttctgccatgttgtctttctggaggccgtgtgggtgctagggctcggtcccttaaaagcctcatcagtaaatgacccagatgatacctttgagtgttttttagcttttgttggttacaaagtttatagaactgaaaattcaaaagaaaaatgtttccccttccctcatgactccaaaacaaatttaaaactggtattattgaattatagattctcaagaaagacgcaataacagattttttttgtttgcttgctttagagactggttttgctgtattgcccaagctggtctggagttcccagcctcaagtgatcctcctgcatcagcctcctgagtagctgggagtagatactcaagccactactcccagcaggagatttttttttgaagtgcttttctcaaggtatcaaagaatctg

SEQ ID NO: 96384 - DNA, 1048 bp, Homo sapiens
ctgctggaagttctcacaataattgtgctgcccattatactcccattgctggtgacacaacagtattacagtaagataacatctgtaaaatagattttggaatcggtataagtggtaggaatattgactactgactgtggtcttactgtcacttttaatcccaattatgatacatgattaaaagctgtaaaagatgctgctactactggaatgaagtgtgctggaattgatgttcatctgtgtgatgttggtgagtccatccaaaaatttatggagtcctatgaagttgaaatagatgggaagacacaacaggtgaaaccaatccataacctaaatggacattcaatcgggaaatatagaatacatgctggaaaaacagtgtccattccgaaaggaggagaagcaacaagaatggaggaaaggaagtgtatgcaattgaaaccattgatagtacaggaaaagatatgatgatatgggatgttcatattacatgaaaaattttgatgttggacatgtaccagtaaggtttctaaacaaaataattgttaaatgtcatcagtgaaaattttggcaccctcaccttctgccacagatggctggattgcttgggagaaaggaaattcttgatggctctgaagaatctgtgacttggaaattgtatccaccattgtgtgacagtaaaggatcatacacagtgcagtttgaacataccatagtgttgcatccaacatgtaaagaagttgtcagcagaggagatgactattaaacttagtccaaagcaactttaacacctttattttctaagcttttttggaatacatatcaaattaatttgcaacatgttgtctattttaacagtggacctgtataatatttttatctgtgtttaaaaaagaagaaatttggccatgcaaggtggttgacacctgtaatccaagcactttgggaggccgaggtgggtggatcacctgaggtcaggagttcgagaccagcctggccaacatggcgaaatcccatctccactaaaaatacaaaaaattatgcaggc

SEQ ID NO: 96385 - DNA, 1050 bp, Homo sapiens
aatagaagcacaagatgacaagcataaatgcttaaccgtatttcaagcctctactcatgtcacacctgttaatatcccattggctaaagctagtcatattgccaatgccaaagtctagggacagagaagtacatgtcaccaaccacgtaaggccatggcaaaggaatggatggataataattctataggtaagtgaagaattgataacattattttctgtacctccgaggacatagtgcaatggaaaaatttaggaggtttttcaaaccctggtttggctacttgtttatatacatagatgcagttactcaacattttcattacttggtttcctcatctgtaaaaaggaaataaaacaattattcagaattttgttgtgatgattacaggtgttatatatgaagtgcctagctagcacggagtccagataataggtatacaattaatgataacgtaattatattgaatatgtctcagagcttcctcctcagaagcactaatgaggataataacagctgatatttatagagtatctactatgtactcactattatcctaagaacataacaggtagaaactctttcatatgatttgtctgtgtgtgtgtgtgtgtgtgtgaacaaaagaaggtgagaaaagctaagaaacatgcccaaagttagcttcattttatctcaaactatctcaaaaccaagtggcttaaaataacaattgtttattttgtttatgattttatgggccagcaatgagagctggactcacctaggttgcttttctggactcatctggatgcaggcctgtatctgcagtcagctgcctggttggctaaagctgcctattctagaatggcctcagctgttatggctcatcagtgttccagtgacctctcatcatccagcacaatagcctgggcttatttacctgatagctgggaagggttccaagagaacaagtgggaaagcttgcttgaggcctgggcttctgatgtgtcatcacatttacctctgtattaaccagaacaagttacaagaccagtccagacagaaggca

SEQ ID NO: 96386 - DNA, 1049 bp, Homo sapiens
tttgagaaccttgctcttcactcttctaccttccagaaaaatagacaattttgagcccaaaatctttcatttccaacttgtgagccctaatttgaggcagcttttgatccagagactttagattttttttccaaaaagaaaagttatctgccccattctccttccaagacatatatggactctgtgactcagttttgtcttcattgaattatcctagctatcaataatgaattgatcaaaacagtgaatgataaagtctttacaatccaaatgctattcaaatactgctcttattttagagaataaagcaatagcttcactcagttcagattgctcagagtctgcagcagtcacttggagaatcagatgttggaaatgccagaagcccgtccaaccccatgatagtcttgatctaatccagaagtatactttcctcagaatcaatattttaaaatattatattatctgagaaaagcaatacctgactaccaagactgttttagatccttaggaacctaggggttccctaggatgctgattaccacttcaccagggatacagtaaccatatctagacaataatacacttgctgcaattcccatcaaaataccactgtcattcttcacagaactagaaaaaatcctaaaattcatgtggaaccaaaaaagagcctgcatacccaaagcaagactaagcaaaaagaataaatctggaagcattctgttacctgacttcaaactatactgtaaagccatagtcaccacagcagcgtgggactggtataaaaataggcatatagaccaatggaacagaatagagaacccagaaataaagccaaatacttacattcaactgatcttcaacaaagcaaacaaaaaagttgggaaaggacaccctattcaataaacggtgctggaataattggcaagccacatgtaaaagaatgaacctggattatcatctcttacctatataaaaatccactcaagatggatccaagacttaaatctcagacctgaaaccataaaaattctagaagataacattga

SEQ ID NO: 96387 - DNA, 2319 bp, Homo sapiens
ccggaaccggaagtttggggggcggagcccggcggaggccaggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtcggtccggacatcggacccagtcagttcccagactgtccgggcggcagcggacgccgctgccgccgccgcctcttcgtcgcctcagcctggcgttttgttccgagagacgggagaggcgagcggagctgacagtgattttgacagtgatttaaacccgcttttgttgttgttggcttttcgttgtttggttttgtgtgttgtgcgtgtgtgtggcggtttttcccccgtggtgcattttattttttatcgttgtgctcttttttttcttttttttttttaacccagtgagcgtttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtaggtgcagggagcgcggcgcggtggggctgctcctgcggccgcggcggccgctgctgggggccgcggctggtgttgagtcggagagtccagtggagcctggggaggttgcccactccctgcgcccctcggctgccaccgccccccccccccgcccccaggtctgattgtgatctggaaacctccatgcatttttctctttttgagttgggtcggcgagctgataagagtgagtgctgtgttgttgtggaagtgagaaagtcatgttttgtggccataacactggatgacagcgctggttgggttgcaattaagccgcaaataccacaagtgacaatttatgcaaaggttgagatctgaaaggagtatttagtgtgggctcctccaaaacaagggttgctttttgtcatcgtttaattagtgcttcaccggtgaatatcacgacatagatcaagccagttgctgcttaattttggctgtgggaaacaatacatcctatcagcaatttaatctgggtctcccctcacgttttcttcaacttcagcgtccagcagtgttaaaaatagttgtagttgttgttggagtattaactataacccagtgcagaagaggtatgccgcttggtattggtaatgtgctggcgttcaaccaccatttgtgtgctcttttggggcatagattttgcttacctacggaatacttattttaaacgctttgtattgaagcattgttttcggtttagaacaacccatgtgaaattgtttttgttaaatatagtacactcataaaataggttttagctcaaggttgggggaataaacgggccattttatattggaaattttgattttgtgaggacgttctatggttgcaaccagtggttggaaaaactatctagtcttttgtatttgaaattctataaataaatacagcatctagctgaaaggtgtgcagatgtacataacaggagagttagttcaatagatgaaacattttaaataagtctcattggatctatttattgtaaaatttaatattcagttacaagcttgtggcatagaattacgggggactcttggaaacgggggcgaattgacaggtttcatggccatgtctttatctcgtttgccacaggaaaattaaagggtggtagtcttctttgtgtacctctgtggggtgtgtgtgtgtgtgtttgtgtgtttgtgtccgtcttccccacccccctttaaatataatcttttgtaatgtatagaattttgctgaatggtacatttccttgtggttaataaatggataaagtctagtcttatgtctgtagtggtattgatcagttccgggtgggctgaatgtgttgtgaaatggcgatcattgccagagattaaccaaaagaatcatgtctgtttaaatggaagaaggaacatgcttaaggcaggctgacagttctttttgtgcacggtttgggaaggaagctaaacaatggtgtgtctgaaatgaatgaaggccttgataacattaaacctcttgcttttgtgacatgacttaaccatgtagtttttatctttccagtagtactcttttttcctctgct

SEQ ID NO: 96388 - DNA, 1054 bp, Homo sapiens
ggattattttcagtgggccaggaggttaatagctataattttgaaataaagtgattttgttgctgtagggcatatagatattccacttatattaaactaatattatgttgttgcataggctttttaagatgaacattcccagttgaactaaaatatgtgattctgttgaagataattgaaataatcataaagaccttaatccatatttatacatgaacaatttgagtacttaaaatgtctgatttttaaaagccttttgttatggatcagatgcactctaaaaaaggattattatgtttctccaactaattgatttttctacaaaatgtgtgatctgacatgttggaagcatgaggtgactatttttatgagaattttaaaaattctcaggttgtcagtttttcatttctagatatttgattttttttaaaaatcaaaatgggaaacaatagtaaggaacagttttgttccaggtgtttaggagggatgtttactatttcgtggactctgatttttcagtttccatcccatggtatgtattctggagactgattatgcagactattcctgtaggatatggccaagtgtataatttcctcctctctctcattccaggggaaacattttaaattttgcccctatcctggagtgccttcagattacctttgattttgaattttttcattcctctcatactttctcagattctgtttcaaaacataaatcttagttttctttttatagcattgtggtttatttgtgtctttccccacagtttgttgaagtatgagaatgactttaatacttgctttagtacttagatttatcctatctagagttatgcagctattgtggtatttgagttgcatagaagtaagttgagaattcctttggattttgtgggagctggagcagtatggtcaatgtatttgatgaaagaggaaatggaaatatggtaattatgttttcttcagttcagctaggcagtactgtgtatgtgtgaatgtatgtgtggttggagggggagttagcattacagagaatcttttgggat

SEQ ID NO: 96389 - DNA, 1052 bp, Homo sapiens
ttactggtttctggactacctcgcacaccctcttgggaatagtgttactctcttagaatcaaatggcttgaactttagattgctcttattctcttttttaatattcaggttttccttaactctttgctgcttcagaaaaagtttcgctcatcttattattcatttatcatctctgtttaagccaaaatttgactagaaccaagagtatatttattgctgctgataggaccacattagacttcctctgtggtagatttaattctgttagattgtaaaatagtcatgtctagacagaacattgatttcaaattgactattgaacatgaaaattccaggaatagtgtatagaggaaggaggaggaggaggagaaatcaagaaggtaagaaaactactgtagatagcaagtgactttctgtcattctccacctagatttcttgttagtcacttttgtatacccagtgcatctagaggtcaggctttgttttaataaagggacttaaaggaaatatgtttttgtctctgagattggattttttgaactgttagagtggtggacctaagggaaagaattggaaacttcatatggatagtgatcaagaatgtggtcgtagaggttggtagacttgagctgtggtgtcagtgctgccagtatctagcttatgtatcattttctgttacttgattattgtagcacttttctagctaagattcaccagttccctatcactacttccttttctttctagtccatctgcatagctgctggagtgatcttattaaaaaataaatctgaatatgttacccttgcttaaaacctttcactgactgtgagtcacctttagcatagaatctaaagtcttagaatgtcataaaaggtccttcatcgtttggttcctgcctattttttctaacctcttggtattggttaagagtatagactctggatatagacctaattggtttaaatcttggtttcataacttaaccttggtcaagttacttcacctttgtgtgcctcagttttctcatctacacaatggggggatatta

SEQ ID NO: 96390 - DNA, 1075 bp, Homo sapiens
ggtcattttatttattattaccttaagtaaaatagttctagaagaagaactggatgctaggcctttcttttacctggtagtggagtttcatacttcaggattagtgaatacagtttgctaattaattttatataacctaagactcaaaatgaacttgtaataattactaaaattatatgaggagaaatgaaaagtcaatgagtaaatgaggacgatgataaataatgaataattgcaagataacatatacaagacggatatggtaatagtaaagcaatttgattagtgggcattcaaagtagaataaaacacctttctgaatggccagaaaaatggttgaatagccactgaccatctttttaattctatattatataacaaatctttcttggtaatctttacttattttcctcctcagttctttagagatacatatacttggtttgggtgttgaattaggaaattaattgctaattgtagtttttgttaaaatgtaaatagagattgcttattagctgagagggttagaaataatagaggaaattaaattagcaagcttttactgctgggagggcctaacaaactgtcaggtactattttctccagtaactacctttatcggaatgatgcttaggaagaataaactactcaagctgatcctcacttctgaaggatggagtaaaagtaaaaggttagggtcagagaagaagggtggttatactttattttccttttgaatcattgaagagtagttttgactttttacctgcagatcttatttttcactattgtatccctagaatatccccacatcaagaactgtagtttctagttagtctagcaacatatatttagcagtcctcaattagacagtatttttgtaattaatatctagccttgcatctgtgatggaaggaaatcagctcactaagccagagcacagaagagtagaggagcctactctgttatagataatagaaccattgaaacgttatttgtcagttagggctggttaatagaaataaaagctcattttgttggtacatatgtagccgtttgttggcaagaatggttt

SEQ ID NO: 96391 - DNA, 1041 bp, Homo sapiens
ctcagctgtgccagctgtaacacaaaagcagtcagacaatatgtaaataaactagtgtcactgtgttccagtaaaactttatttgtgggcactgaaatttgaatttcatataatttcatgtgtcacagagtattattattttgattttttttcaaccatttaaaaatgtaaaaaccattgttcaggggctatatacagactggattttgacctgagggctgtagtttgccaatctcttggacattgtataggtggcatccctcccccaccttagaaatatgtttaaaaaactttgttcgggagcattttcttatagaattattgttatatatgtaggttaagttcctagactaatccacaatcctgttttacttccagtgttttagtctagcaatacaactttgttttacccccaagaataactctgtctctgagggaaaatagatttagtattccttcttggaccagaagcagcacatattctccccagcactctcacagtttccttcttccctgatctctcttctacctgctggggtttgcatcctaggaaatactcttctaggggctcctgtagggtggaatggtaacaaaactaaaaagagctttctgtgtgtgattagagaggagggcatgggaggagaaaggtggagagaagagtgcaaagtagtttcttttaaaactgcagattacagcccatttgaggcttataaaatcagtgtagagggtcaccacagacaaaaaaaaaaaaaagaaaatagaaaatattagaatgaatcacccatagcatagtattgttttgtgaaacttcagttgtgtgtgtgattgtatgtgtgtatgtactgggtcacagtgaaaaatgtgctatgtggtcagaaaagtttgagagcctgtgttccaagggtttggggtactgatcctgagtttttttgtttgtttgtttttgtttttttcccttactgtatatgaggcgcatgaaaagtgtaaaggcagtctcttgatttcttgctacagtacgtttttggtactcagctaccttat

SEQ ID NO: 96392 - DNA, 1502 bp, Homo sapiens
caacattgaggaaatgattgaacagatagagtggctgtgttctaagaatgcctcatatggcatgggttataatgaggtcattgggacaatcaagtttagcactatggagtgtctagagtggtgctacaaaagaaatgcaatgccagcagcaaacatgagccaaaaaatgaaatttcagattttctagtagccacattaaatgtttttaaaataaaattaattttagtaatgtattttattcaacagtatattcagaatatcatttcaatgcataatcaatatgaacatgattaatgtgggtttttttggtgctaattttttgaaatccagtgtgtatcttgtacttacggcacatctcaattcatattagccacttttctaggactctaactatacatggctagtggctactgtattggacagctaaagtctagagcatttggtgaaattgtgaaattgtgatgatgccaggaaattggggaaagcataagaggagcaaatatgaatctctaaggtagaccttgtgcagggaattctataggaaattatatacttttgggagagagacagaaactggtgtggaatgaaactttgatgatggtgaaaccatttggaaaatgagaatggcagagattcaatagaaaatgaaaataggaaacggcagaacttgacaatgcttaatattctatgacaaggccaaaatataatagttggttctttttaagaaaaacatctttttcatccaagggctttttagcctaggctgtgtctgtgtagcctggaggagagaagtagttattcatgaaacacaagagaagccattgagatcagcagataaaattgattgcagaggaataatgtggatagcagcgtggcatggaggatgaattatgctaatatagtagagaggaagagtctgaggtaaatgattgatttttgtaaagtaagaactggacaaagttcttggtgacttaagagcaaatgaaagattaggcagaatactatatcagaatttattgctttgacagtgaaataagataggacctagtgatagggactttggtcacagtatataagtggttaagagctcatgcacttaactttaatccagtcttgaccacttaactttgcatttctttgcaagttacaattatccaggtctcagttttttcatccataaaatgggcagaaacacctacttcatagaattacatggattaaatgagattatatatgtagcaactttgactagtatgacacatcttcctgttatttgtcttagtttgggatgtccagaggggaaaaaaagagttaccattgtgttttcttggaatacatgtttatatcacatcttctaagttgttaccccttaaagcagttttcagagttcagcttggtgaaatctcttgattatttctcaaactgtggtgtgaggacctccggcattagaatcactttggttgttagataaaaatatagattcttgagctgcacgttagggc

SEQ ID NO: 96393 - DNA, 1064 bp, Homo sapiens
tgtggaaataaaaaaactgcttattaaaaatgcagagccccagacgaacagtacactttgagagaatttcagtgagtctggaataggcctgcaaatcagcattttgatgattttgatggaggttgtgcactgtgagaaacattgctctgtttcttattacctccagaggcataaatatgtaggtgctgtctacataaaataaattaggaatggtatgcttccagcttgaaaatgaacaaataaatgtacatcagaactccatgtatgttggtgtatgtttcacataggaactgaagatgatattagcacagatgtcagataaagggacaaacctaccatccacaggttacaagtgtttagtattacagaaaacatttttataaaaaggaagatcataggacatgtaacctctcaaagtttatacttctcagccttcccttttaggttagcttcagggatctagaaacattaccatccattacagaaaactgaaagattatgtggcaaaataaacagggaagcagaaatagaatagacagtgtacttctgttaagaaaaagtacttacattaagaaaaactattgagctttattagatactgagtactgtgctcttgcaagcatcttctacagcactagtgttcacctcttaaaagcattaaatgatactggcattgccttcattcccttcaatcctcagtttttggtcctctttcctcttcctaatttaaacagtctactcactgttattctattcttgtaatttgtctcacttttttggcttccatgacttcttgcttttcttttttattgtatagtataaatacaaaatgaataaaacagcttctaaaagaaaatttaaaatatgtatcaaaagtgagcaaaaaatttaaatttggtttaataaaacccattttctttatagcagtgttgctgttttttcttttaggtatttaccccaaaattatgccttgaggcatatgcctcaaggttgaggtatatgccataaattgcttatttatatttttaaaatgctaatattaaaggctaagatcttggactgtg

SEQ ID NO: 96394 - DNA, 1039 bp, Homo sapiens
agttcgagaccagcctggccatcatggcgaaaccctgtctctaccaaaaatacaaaaattagctgggtgtggtggcgtgcgcctgtaattccagccacttgggagtttgaggcaggagaatcgcttgaacctgggaggcagaggttgtagtgagccgctaagattgggccactgcactccagcctgaacaacagagtgagactctgtctcaaaggaaaacagcaacaaaaagaagtccctaagtaactagtggttaaatgttgacttccaagtatttttactctccttacacatgccacatgcacattgtctagtgccacaacatataatgtttatatttttagtttattctgtgctagttgtgcttttagtttagtaatagaaatatattactttagttagatggatggaatcttgtaatgttttgtcagactgatagtaagtactaagtatggggtattacagacaagaggaaaaaaaatttctgggaagaaagccagacaatgtttgtgttttcctttagaagtgattgtttggtggtgggaaggggcttagtttaaaaaaaaaaaattagattgacagggcctaaaatgttgtatggccaatgcagaaattttatttgaaaatttattctctttcttcatatatctaacttgtctatcaaaagtcttttgggacagtgtggactttatgataacttttgaacagtgttacctttcataatgcttaaaagcaacccagggcagccaaataggaaaggtgactgcctctaggatgtgtatcaatatagaaaagaaaagatatcaaaagactcaatgtgtagtaaaatgagtttttttgtttttgtttttgtttttgttttttgagacggagttttgctcttgttgcccaggctggagtgcaatggcacgatctcagctcaccacaacctccatctctcaggttcaagcaattcttctacctcagcctcccgagtagctgggattataggcgcacgctaccacacccagctaatttttgtatttttggtagagacagc

SEQ ID NO: 96395 - DNA, 1108 bp, Homo sapiens
tgtgcatttaaaaaactagcctataaattctgttgcaagtattggcctctagctgcagtcaccattatcccttctccccgcaaagaagaacatctaatgttagaaatctgttttgcacagcctagttaaaacttgtatttacttgtacctgttttgatgtaattcatcttatgagttagggccagagaactgcatggaactattttaatcttaaaacccgggcatttgtagatactctacacattttgtggctgtaggcaaaaagaattttctgttgtgtgttaggtatttttgaagatgcctaacttattctgggcaatatacagtgtatctttcatgacagtaagactaaaatattaggaagataattagcagtgaagtgaagcataggataattatgtatagaagcaagctttgttttctcagaagtttataagataaaacatttagaaacagctaactacccaacccaataaaccaaatcatttttatcttttagtttcttatgcttagggaaaacaaataagggactgtggaaggcaaaagcttcatctctgtattctaatttgacaatgcatttgatacctgtggcctttcagcatagatattgtataccccttgtttttattgggtagttaatatagtgtcctgagttttgttctgttccaacagtttactcattgttttctgattaatctttaaaatactacctctattcttttgatgacttccaaacctctcctggctatacccaatactacagaatatagaatgctgtagtccaatgagggcagtcttgtcaaacactctggttattcacaaccctgtttatttggtcttcatcttcccaacctctgtttaacttacagttctgtgtctccttaatagccctgctttagtttcattttctctgcaaagccctcttttttcttactattctaggccttgtgaattgttgatttagtgcaaatgtaactgaattcctatactgtgctaggcactgatgatacttcatctgcatatgtccagtattaagcaaagttttctctaaaaaaaaatttctaaaaaaaagtcatcttatatttgagtccttaaaaagtttttcata

SEQ ID NO: 96396 - DNA, 1055 bp, Homo sapiens
tttaaaaatcagtgagtaaatataaaacaattacattggattgcaagaagtgtgcactttgggagaaggaggagtcctgattaaaagatttttaagattttattatgcataccttgagaaaacttggaaattgtcaccatatgagaggtttttctgggaggctttctacaagagctgggctttctggaactactgggataatagagtgaggacattcaaaatgtatttgcctgaaccatgtctgattgctccagctccatttgttggaaaagctattccttttccattgaattgcctttgcttatttgtcaaaaacgaattagacgtgtttgtatgtagatctctttctgggtcctatatctttttcactgatgtatgtttctgtccctctgtcagtaccttgctgtctttattattgcagttacattttaagccttaacgtcaggaaagcgggtggtgatttctcccactttattattatttttcaaaaaagtttagaatatacttgtttacagtgaaacttgctgagattttgatatgaattgcattacacctatccatcaatttagggagaattgacatctttatgttcaatcttccaatccatgaacagtttgtctttccaaatgtttaggttttatttgatttctttcatcagcattttaaaattttaatcatagggatcctatacatgttttgttaaattatacctaagtgttttatttttcttcagagcaaccgtaactggtgttgcatttttaattttagtttcacttgttcattgtcaccaaatagaaatgcaattgatttttgtgtttcgttcatctatcctgtgaccttacttaattcgcttattagttcgggggctgctgctgctgcttcttttttttttttttttaaagattccttcggaattcctccgtataccagcatgtcatctgcaaatagagggagttttatttcttcctttctagacagtatgcccttaagttcttttccttgccttattgcagtagttacaactttcagtactgtgtttcagtactgtgttagag

SEQ ID NO: 96397 - DNA, 1085 bp, Homo sapiens
ctctctaaaaatatcctcaaaatctttcttggtatagtgccctaggcagccattactaacgctgattggaattgactccgaaggtaaaacctatttggcacttttgctctaggcagtgttcaatttttttgtcagttttgtttagtttttggggtgttcctatgcctgagtgggattcttcttttggaaattggaaatagttgcatagtggtttttaacatgaattaaataggtgataattcacagagccccctttcccaacaaaataaacaaaaggtaggttagacggactattgggattaggatgttgttttaagctaggaggtggcagaccgcacaacctatgggccaaatccatcttggagctaagaatgatttttatatttttagatggtagcaaaaaaaaaaaaatccaaaaaaagaatagtattttgtgagttgtaaaaactaccaaaaaaatccaaaaaaagaataatattttgtgagttgtaaaaactacatgaaatccaattttcagtgtccataaataaagttttaatgcaacataatcatgttcattcatgtattgtctatggatgcttttatgctacaagggcagagttaagtagttgtgacagaccacatggcctgtaaagcctgaaatatttactgtctgaatctttacataaaaaaattgccattcctgttttaagataacagtgggggcattgaatattgcttttgtattatttggtaaaggaggaaacttaccttgctcatattttcaacatgtttctgaaaataatttagaaagtgcctattgtttgcatacagataagtggtggtagcagcccttcttttttttgttttttttgttttgttttgtttttttgagacagagtctctttctgttgcccaggctggcgtgcagtggtacgatctcggctcactgcaacctccacctcctgggttcaagggattctcctgccttagcctcctgagtagctgggattacaggtgcgcgccactatgcccagctaatttttgtatttttaacagagaaggggtttcaccatgttggccaggctggtctcaaactcctgacc

SEQ ID NO: 96398 - DNA, 2048 bp, Homo sapiens
tttgttattaagatacatcttttaagttcatctgatgttgattttttttaatagttttagctgtttattagtggctgattaggatttgttctagaggctaaatccaggtcttttcatgacttaaggtcctatataaaaggctactttatttttatttttttggtttaattctaatccgtttgagttagtaggtgctatgtgattattgtttacgtgtttgttttctacttattgctgctcatctcaaccctgttcattgcattcagggaatttaaatctacactctaaaaaacagtgacagtattaatttctcagcctagtttgggtttctgatgttgaaatgtttcacccatgagatacgagcttttatcacttagcatgtgtgtatgtatttatatgtatacatacacacacatacacagttttatatatagttttcagtttttgtattcacagaatggaaatgccatatttcctgtgagcaaaagcactctttgaccaaattgcctcattgactttatgtcctcttcaagcttttctaataattaaaaaaataaaaaaagatgcttgccttaggttgctcattaaaaaccaaattacagcaatagtctctagtagtcagtgtgattgttataaaatcagttgttaatttttttttcttaagagatttagtaacaggaatccaggaacatttttggtttttaagaattattagatataaatacgaatcttgaagttgaatataaatgactaatttattattttattgcagaataaaaacacttgttgtagggtcagtataataatattgattttaattattttttctctgcttatttataggactgattgtgtagaaaaaaaagacagccctgaagtatatttttgttgctgtgagggcaatatgtgtaatgaaaagttttcttattttccggagatggaagtcacacagcgtaagttcacagggaaaatacgtaggtttgctcaactgtagattggaaacaaaatatatttgtgttgatggaataatttgcccctacctcttccccaaaatttgagactatgacagatatttattatagaattttgtagaccaaatctgagttatttttcccccccttttccacagccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagtaagttattgtcctgtactttgtagtgttttaaattgtatatttttgagaaatattactgtggtgaaacccactaacttattacagattattttcctttggagttaatttttgaatgtttattgtcatgagaactctagctaactttgcaaacttattaatgtacctaccgtgtccttaacttttctcactttagggttgaggtcgagtagaatgaagggatattcccatttctattcctctttggagagttttactctcatgctaacactaacctgctttgcttcttgagaagtcatttatgatggagaagtgaaatcataaccctgtctttgccctctgtcccctcctccatttctagatttctgtgcctttttcaagaccacttggcaaaacattttatccatggggatagacttaggaaagtaaccaaaaaagtatagaaaagagaggtttcataaagccttcaggaagatacctccataaagatgtttttgtagggaagaggagcagaaaagtaacctttcttaccatatgttgttggtagatcaagtattttttttggttgcctcatatcaagtgtgtactgaagactaaacacttcttttaaggctcttgattgtcacacatcacaccccaaatatttctggaaatataggtgtggagagtaatcagattaaattcattaaattttctacattctcttatcatgtagacactttgtgcaggtctggtatttataaggacttttcatggaagtagtt

SEQ ID NO: 96399 - DNA, 1036 bp, Homo sapiens
tgatatttttaatcttttgttttattatgtgtttttaagtgaaatgtaatagagttttattgtatgcttatgaaatagcaaaatttgattttttggtaaaaattttgtatatttaaggtgtacaatgtgattttttttttaagcttagagtttgtattaggtttctgcaaagacagaactcacatctcacaaatatttgcaactgtattgttttagtatgtttgaaatatgacataatgctgttgtcttaggcgtgagcattcttttgtgtgtgtgtgtgggtgtgtgtatgtgtatgtctaagaaatagtatagggctactatagatgttgttctgtgtcctaccttggtgtgtgattatttttgtattggtaacctaaattacaacttactttaaatatatacttctaattgtggggagaagtgtcataagttatctcgacatgcaggttgacaaaaaaaattactctcatcaggcatatataatttattccacttacaaatgctcagacaaggccagttggagattgtctaaaattctgtgtccaaaagcaaaaagggaggaaggggagaaagtagaaaatttaaacctttatcaatagcttaaaataaggtaaagttgcacattaaaattaattagtgcaccttatttctaaaagtgacttctgtttaaattttgaaatcttgagttcaggttttctttggcttgtacagggtctcgtctgtcagttgattggtgcatatggaccagactatataatttatcctccttctctggcaaggagatgtgtatttaggaggaagtgagtttgtttttttcctgtgttcttcatttcctggacctcatcctagaccttgttctttcattcctagttacttcattgctgtcaaatcttttttttttaaattaagataatagaaatgaaaaacgtcccattgttagctaaagctgcttgtagcacatgagctaggaattgttcagggttttcatttttgcttaaccgctcactcaatgcttgattgcctatggtgtgcc

SEQ ID NO: 96400 - DNA, 1639 bp, Homo sapiens
tatgaaaataaatcaaaataaacttctgtagccagtcataaaacctgattcttttaagcatcaaccccaaaaagagaatgggcatacctacgtttttttcagacttttaactccagtgctggctaccttgaggtgctctacttcttagggaacatatccagaatcttcatttcacctgccttggcctttctttgctttcctttcaagaggagtaagatgagagaaactgtaggaagtaggaattatcacagaggaattttgacgatctaattggctggaatcattgctgtgcaattgacatgtcaatactgttgaatctcttaatgtatgtcttgctttccttagttcagaaacattgtcctcgcatatactgtattatttataaattctgtttctattctgcttggcaggatagtctttttaaaatttaaaatggtaaaatttcttagaatgtaaaataattagttgatattaagaggaaacaaattcagaatttgtcagttttcatatagtttggataggaggaccttaattcgtcttggtagtcctaaaaagttgttgagtgaggtatctccactcccagaaaaaaatcagtctctctctctctagatacagagatacagatatttcttggaatggtttgaatagtaaataaaagaaatcttataacacatatcatatatacatatttatagtatataaacaaaaatctctattttctggaaagattttttgtattccagatctgtgtatgtgtttactaaatatctccatttatatgtctccaagcacttaccattcacaggtagtgattgtctctcacaaacctggttctcagtaaatggaaccactgtccatttggttgcataagccaggaaactaggatgtctcaactctgtttttcaccttaactgcttctccctagtacttactccatttttcaagggtgttctccacagggaaatcttctcagactttacctgtcattataagtcaggtttctctttacagatgttgaaggtactgaattcctttttattagtgtgaattgttgattagtccttctgtcctgcactgctgcaagcttcatgagagcctggctagtcagtgcctggcacagactagttactcagtaaaatttgttggatgaatgaatgaatgaatgaatgaactattcttcattcttttctgatatttggcagtagttttttttccacctcagggagaagcaacaaatctttttctcacctacaaacctaatagcttgatattaatgtgcagattcgattttcaccgttacctacagttatagtatataatagtcaagctacattttctatgttgtgaatccagagttttgtttgctttttgcttagttgtatattttagtgcattttattttgctttatttttatttttggagatgaggtatcactctgtcacccaggcgggaatgcagtggcatgatcacagcccactgcagcctcaatctcccaggctcaagatgtcttccctcctcagacatccgagtagctgggaccacaggcatatgcaaccacgcccagctaatttttaaaaaatttttttgtagagaagggatctccctgtgttgcctaggctggtctcgaactcctgagct

SEQ ID NO: 96401 - DNA, 1023 bp, Homo sapiens
tcatgtacttaagtgaatgtatttttttgttccgtttttacccttcatattttgttgcatagttgatattttgaggcttgttcttggtgtcagtttgggttattttatagcttatcctaatgttcatttcttgggaaatgtattgggcagagacatactttttggtaagatgtatggatagcacctacttgcacagtgctagtatagtgtcatctttatagtgtcatctttatctctgaaaacacctgtatttaaacaagatctgagagatccttgagcctttggaaaccatagtctacttattcagttggcatgtatttctttcaagggattaattttactctggagtactggataagatgttttgatagtaggattatctcagccttttggatgaattataaatactcttgaatcattatcacaggaagaaaatctagaaggaagaaaactagttaagcaactggtacagataaatgagttgtccattctgttttgtcagtgctattgttctctatagaaatattggaaactggggaacatagccatcatccattggaggaattctcagccttccctaccactggtgatcatatttcttttaattttaaatttagacccttacctattttgggatgactggaaaaatgaaaatcctgttctctatcagtgtctgagtgtctttagaatgtgagatgtgtgattacttgttcccagggccacctctgcttaactgcttcaccttgatgtgctgggcaagtaggtttgataatattctgtcactatgttttacttaattctgatgatcttgttttcctgtcttagtttcttgccatggtgtattatggtgcacgcacatagccaccagaaacatttttctgtctcaccattatgattctgtcttccatgaaagggaagtgaggcagttcaggaaataggaaattctagaggttcttaagacaactatcagaaagtctgagaaactgatttctagctatatataaatttgttagggctgctagc

SEQ ID NO: 96402 - DNA, 1039 bp, Homo sapiens
aagaagaagttttctatttagaggaagtcattctgccggaatttcatctttcaaggagattattctgaatagtaccacaagtaacttcacaccatgatgaaattacagtgtaatacttgcagtaacttacgtgttgccattgtaagacacagaatgcagcatttccgatcaccttctgtgtttgtaaactagaaacacagaaaagtacgttttgagggaatgaaaagggcaggcatttagtataaatttgttaacctattgtcagagctttttcttattacaaaacagaacaaaaaattttttaagacttttttgttttgttttgttttactttggaacttatttgagtaatctcttatgcatggtttattaaacctgtattccttgtgttcttactattctttctttttgactctaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaaggtaaaactacttaacgttttactttagtaaagtctgagttggcctgcctacctaatgctggctataaatccctcagagttatttttcgagacatcttatagttgattaatatttaacctgaaaataaaaatcattcttgaataaaaatgttttaaaaggtagtttattttaataaaagagcaaagatggcaactttttaacctaaaactctactcatataaaccacccttttgttccttatttcttgtgctgtaattactcttacaaacatttattttagtgtaggtaatgcttagtaattttcatttaccatttacaattcattttgattacgtgaaccatttttttaagttttaatcagtcttgcttgtgacaaaaccagagtcaggaaatttatctgatctttgatctgtcactaacttgcagggtaattatcaccaaaatgtaattgctagttttcctcaatttttctacttt

SEQ ID NO: 96403 - DNA, 1064 bp, Homo sapiens
attcagatcagaatgttaacagtggtgcttccagctctggaggctctaggttcaatctattataaccatgtttattctatggcatatccaaaccccctgcatgccccacatgaggaattatgcacctcagagtcatacctcttctctacactccctcacaacagctgccaaaaagtacatgtttattttttagaaaatcacaaacaggctctccaactaggggtcccaacaagtcaggatgtgccttcatagacaacattaaacaacataaataattccttttttcttaggcctactcagataaatagaaaattgtatttaggagttaataataactaacatccagtaagcacctatcctgatcagaaactttacatatattacttacttcacagggttaagatggcagtacctctatttactgataagaagctcagaaaagttacataatttgcacaaagacatacagctgttaaacggtagagctggaattgaacccaactctctaaataactctgaagtctggttttaatcactggattgccttcctttgacagacacaggtcaccactgagcagtatcagtgaccagatagatgtatgtgtgcataaacacaaattttgtgaagctcttgaaatgcactaaatactcctgggtagaatacaatgaatcataaaggggtcatctaacttaaccctcttcaaatataagaattatctatggctggacagttggtctctgcttgagtacttccagtgacaaagtaccgacattctaaggtgtctattcaacacttatgtggtgtacaggccagcaacactgccgtcaactggtagcttagcttttaagaaatgtagactctcaggcttcaacccagacctactgagtcagaatctaaattttaacaagattcctaagaatctggtatgacacattaaagtttgagaattacttcatttaacaaacaagtaaccatcaacacacgtgaaagcacctactttagcaatcaatgctcacactatcctctctaccccaatttctgacttaacaattgggttctgact

SEQ ID NO: 96404 - DNA, 1021 bp, Homo sapiens
aaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattt

SEQ ID NO: 96405 - DNA, 1572 bp, Homo sapiens
atacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttctt

SEQ ID NO: 96406 - DNA, 1014 bp, Homo sapiens
aacatcaccatgaaagatagatagtgcaagttcatgggactaacaatcgtgaagcacagtctctttttctggaattcacaaggtacctagaattcaaacaagaatcacacatcacatgctaaaaaaacttctagcatctaaaatacatacaagagctgtgcagggcatagacttcaaataaagccgaacactggttaatccatcagtcctatggcaagttgatcataaagcattccttacgcggagatctgggcaaggtaaagagtataagttagagcagcagcagttctgatgggtatcagaaaggcaaaatacaagacgagtcatgaggagcaccatacacatgaggaaagagttatttggggggtctcagtttgccccaaaatggatcaccatttttctcattctttgatcttttttttttccagtatctctagctcaaactttctgttaacttgcccactctgcactgactgtaaaccaaacactaaataccctgcaaaagaaagttttaacaagactaggtataaggacaggtagtcactggaacattcttattttactgcttataaaaagtttttctattaataatagttctcaaaagaatacaagttttaaaattggttagctacagttaaatacaatacccaggatttctaaaaattttttctaacttgaaaacattttatattgtgaataactgggtttaaaaattttatctctagtactcacataagccaaacattcatcataatatcccttgtttatttttgtttaacttttaaaaagaaagttaaatgttcacaacaggtagaaattcatcttcaggaaattaatgattttcttgtatgcacattctcaatattttcccttcttgattagtttttaaatggaagcaaaaccagatcaagaaattgagagaccaagtactttgtgaaataaagaggtgaactcaacattgaaaagggaattgctaggaatacaatgaatgagaccatggggacacacgtgaca

SEQ ID NO: 96407 - DNA, 1075 bp, Homo sapiens
ttcagtgtgtttttacatctgaatccaagggatccaagtggcccagcagaaacggaattcttgttaaaatgactgattctcgtgcatgtgaaaggctctggggaatgaatacctgtttggtccaaacttactgtatcataatgctgtatatgttgaaaacgtaatacctgttaatgtcctaatgaatcacgttttgcagaaaacaccgtaagaaacacttcagtctttctgtagtttccatgcatatttcaccatggttcgcactctgatcctcatctggtttagaaagcaattcagtttctttcaaaccaccataacctaagtgctgccccatccttcacctttaccctagaaaatctgagaatccattggtgtgtactgtgtgacacaatgccaacaagcctctggtttctaatactggcaggaccaacacacatactttagtgggaatataatctgtttagacgataatagagggaaatgccataattaacaaatctcccttcactcaccactatcctcattcttgcagttgtcaaggtgtaagcctcactgtaagttacaaagctaccactcccctctttaagaacacatagcttaggattgccttggcgatgtgggctcttttttggttccatatgaacttaagtagttttttccaattctgtgaagaaagtcattggtagcttgatggggatggcattgaatctgtaaattaccttgggcagtatggccattttcacaatattgattcttcctacccaagagcatggaatgttcttccatttgtttgtatcctcttttatttccttgagcagtagcttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgt

SEQ ID NO: 96408 - DNA, 1067 bp, Homo sapiens
tttttacagagaactggaaactatttattaaagtactaggaggagctatgatagagaatgaggctaggaagaaaaccatattgtatatattgaattaaagtttgccgtgtttacattcaacaatatatggacaagtaagtgtgcactgacactgttttacctgataatatgagttttcatggggttgtgagagtttttttaatcctattgattgttgttacattttgcttcccagtactctgttctgcagctgaccaaaatgctaactgttctctgggagagaacaggagagttgtcactctcctctcctattcaacctaaactatttctttcatctttcaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttga

SEQ ID NO: 96409 - DNA, 1014 bp, Homo sapiens
tagttttaaattttctagtacctgtaagaaaaataaaaaggtttaattttaattatatatttaatgcaacatatcaaaaatgtgtcattctataatcattatagaagaacagtaaggtattttacattcttttgaattaagtctttaacatttggtgtacattatatttaagcacatctcaatggcctaaatgtttactggaaattcttgctgtttagattccataaaatgtatagctgagaaagtaaatttacattttgaaattgttctaaacatgctcagaattttctaatagaactaaatatccatttttaagtttaaaaaaaaattgagtcacacattgaagtgctcagtagcctagcgtggacagtgcagctcttgaagattttaaggaaagaaacttttaaaacagtggattccccaagtccattggcatcccttataggccctagtaaccagaatttcatttcttgtagcaacaaaaatgagtacagagcattgccatttcttcaaagaaacaggaaaagtattttacaatactggagggtttttttcccctaatagtcttattttgtgagagctgtgaaaatggaaaggttacccaagtatttaaattttttttttttttttttttttgagatggagtctcctgtcgcctacgctggagtacagtggcgggcgcaatcttggctcactgcaacctctgcctcccaagttaagcgattctcctgcctcagcctcctgaatagctgggattacaggcgtgcaccactatgcccatctaatttttgtattcttagtagagacagtgtttcaccatgttggtcaggctggtctcaaactcctgacctcatgatccgcccacctcggcctcccaaagtgctgggattacaggcgtgagccactgcgcccagcctgcatttaaattctcaataatttgtagctgctcatttctgaattttcaattatgaagtattttgctatttagaaatgttttaaatctgcacagttcta

SEQ ID NO: 96410 - DNA, 1440 bp, Homo sapiens
catgaaggaatttggggactagtaatttttagaggaggggtgtgtgtgtgtatgtgtgtatgtatatatatatacacacacatctccatctgggaaaatatctctgcctcagtattgtcaatattaacggccattgttctgccatttttctattacatttttaattcatggtaatgaattaaataatggcttgttttttgtcatatgggattctactttgagggctgcttactcatattcttagctcatcccattatttgttgtcattgtcttactgtggaagctcattatagattacagattttcagcctctccagtaaccagagaaatactacaattaaactttttttttcttgccaatctagtgggtgttaaagattatgcttgatggtatcatgactgtgactattaatatttattgctgctgccaatgtaaatatgtgtaagtgctttggagagcaatttatttagcaaattaggtaactagagaaacatactaattagagaaagtctagttacctaatgcacaggaagacatgtccaaggttgtttattgcagtcttgtttataattgggaaaaaaaaagaaatgaaagatgtctgtcaataggaaattaggaaatgaataatcgtggatatatacaaagaaatataatgaaaaaatgaataaaccagaattgatactgcctcaacatgggtaaaacctcacagtgaagagagttgtgaagatacaatatatttatataaaagttgaaaattactctgttgtataatacatgtatatgtagtagaagtattaggttggtgcaaaagttaccattactttcagtgcccaaaatggcaattacttttgcaccaacctaatagtatagacatacttggttgttttatgtggggaagagtagagtccaatccggaggagatgggcttcaactctaaaatcatatttcttaagcaggtaaagtagtcatagatatttattattctctgttgcctttgtatatgttaaaaaaaatttatgcctttgtgtcctcatagcttagctcccacatatcatatcagtgagaacatacgatgtttggttttccattcctgagttacttcacttagaataatagtctccagtctcatccaggtcactgcaaatgctgttagttcattcctttttatgactgtgtagtatccatagtatatatataccacatatatatatatatccatatatccatagtatatatataccacagtttctttatccatatccatagtatatatataccacagtttctttatccactcgttgattgatgggcatttgggttggttctacgattttgcaattgtgagttttgctgctataaacatgcacatgcaagcatctttttcaaataatgacttctttctttttcaaataataacttcttttcctctgggtagatgc

SEQ ID NO: 96411 - DNA, 1050 bp, Homo sapiens
tcactttgccagtaattgaaactccagtacgtgactactcattttctgccaatgtgataattttcctgctactcatgctgttccctgtaactggaatgttcttccttcttttttaaatctcttgtctcatccagtttaagcattctttgtaatactttaccttgtatccctaggtacagtaactcatgcacttctgtttttgtgctgcattttgttcatttcactagtatgactgtgtagtagtttcccttattcaagtacgaatttggggttagccaggattgttttatcattgtgtttattgaattaacgtaaagaacaggataagaaaatcagtagactggaaactttattttggttttagtgttctacaaataagaccaacatctatttaataatgaattaatattagatagagttactaaggtacaccaaccagtaaggcacaggattatatttaggttttaaactacatctttcctcaattttggctttttttttttttttccttttagtatctctcagaagatagaagtgtgcaagaagtactacagaagcatttcaatatcagcaaaaacctgcggtcattacacatgctattggtttgtattagttttgttttattgcttgttgctttgtttttgtttttaatagtgacggggtctcactttgttgctcagactggttgcgaactcctggccttaagccatcctcccacctctgcctccctaagtgctgacattacaagcatcaaccactgtgcccagcctacttttatcattttctatctttcattagataattaagtttttatgggaattgattaaacctgtaggtaaattttgggagaatcgacatgcattggaacactacatcgagtgttccaatctctgaatagggttcatatctccttttatttgatttcttgtttgattactttcatcagcattttatagctcttactacacagatgatgtacttatttaatgtgtataccaatatttaatttgttagaacaattgtaaatgggttttgaaattttggtttccc

SEQ ID NO: 96412 - DNA, 1537 bp, Homo sapiens
tattatactatactgtatatatatagatgtatatatacatatataatataaattatatatattatatataatatgctgtgtactataatatattttgaaaaattgctcaagttcattattaaaaagagatttaggaatgacagttcctgcaatatatgtgacttaggaagacagcttacctattgtgcttttgatgtcttggatagtttgaatgcctatcagttttgtggaagtattttcttcatttaagaacacttcgtatgtccttacaagcagtacatattagttatcctttggtttttagtgttctttgacagtaaatttgattcctgatttctttttaaggaaaaatagcacaaatacaaatagagtctaaaagcattactataaaaaaaaaaaagccggaagataacttacgaatgccatgttgcatttctgccactttcctctcctaaagttggttcctgctgcctatcatgctattaattttttaatctcagttcttcatagaatgtacagaattccttattgacactcttggtgttattgtgacatatagctattcaatattgtcagtttttttaaacagtcatgttgggtcttggaatgttacagattagctgagagtaacatggtgggaaaaaggcatgacatcaccaagccagcaaatgcctggaggtggattatttagtttgcataaaatgttttaaatgtttaattatgtattgtagactaaacattactaattataggtgatagtttacttatacctctaacattggtacagtgtttttgtttttttaaaaacattcatcttccttatagagatttctgtttgtttttaaggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcaggtatcttaaaaggcaataaagctaaatgttccttgctatatgatttaaagcaattaaaacacaaattttagaaattagtaaattaacacaaagtttctaatattgctgaaggataatgctgcagtaatacaaattatatactttttaaaaattttcttcttagacagttgaaatgtcatttctcctaaattctatctcaaaagaacatcacagttaagctttaggatttatgttattagtttgaagtaaactttaatgaggctttagttttatctgtatgtggtttatattttagataattttattttatatattttacatatttagcaataataataaatagtaaataatgataaataaatgttaatgactcatacctattatgtgtggatattttttttcttccagttttcattagcaacttcagcttttattttgttgggccttaagaggcagtacagactgtggcacctccagttatattatctaataggtgatcacatctcacagtccctgg

SEQ ID NO: 96413 - DNA, 1050 bp, Homo sapiens
tttgtatttttagtagagatgggatttctccatgtttgtcaggctggtctcgaactcccgacctcaggtgatccacccacctcagcctcccaaagtgctgggattacaggcatgagccaccacgcccagcctagactgaacttcttgagagcagtcggggctgtgtttgtcctttgaataatttttttctgttgaatgaacgtatatgcatcagtaaatcccctacccaaagtaggctatcagaatgtttacagaattgagttttaaaaactgaaatatagtaaatggtttggaaatttaggaaaggtggatataatttcttattaatgtaatgctcttattttatcttaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggtaagtctttctgttcattaaaaaaattgattataatattttaaaattcaagcttaattgctgacactgctagtttttttcacttatttaggtcattttaaaaattttgtttcagcagtgcctggtgtatttatcctgctttcaactcaaattgaggaaaacagtttagtagttaccttagcccattaatgaatacctccctcctcccagtgaaattactgaagaaaaaagtatgaaatcagattatgctaataaatataatttctacattatcaagtaatgaggcggttaaatctcaccaatatttgagaaaacttggtaatagtttttattttaagatttttttccatattttgaaaaggcttgaaatcaactctaagtaatactattccaactttcaaagtacacatctccagaaatggaaaagattctaccaagcactgacagtagatagtggcttcttcattccatgggatattttagaatgattttaactatagtctcaatatcactatcactttgccttgtgaaggctctgtacatattg

SEQ ID NO: 96414 - DNA, 1258 bp, Homo sapiens
catttttaaatgttacatattcatattggttttatgtgaaataataaaaatgacaattttttatcattctgttctaatcttcgctattattatcatatatagagattattagtttaagttgtacccaaaaatgttttggctgtgttccgagtaagcatagccaaacatgatacgatatacataaattcttcaatgtactcttgaatagagaaatactgctatagaaattaatagtttaattccttcattatataaatttggcttctgctcagagagcataattaggttgccgaaggtcataaaatggcagagcctggacattataagaacctaagtcacttaattcaacccacagcttttctggtttgatataaacagacatatatatgtatattatacatgcacaaatacgtatttatagaagcatatacttagtatcagatgtaataatcttttaagcaaaaagcctgaaagacaagctacctttgagtaactgaccactgatttcccaacagattgtctctttgaggatttgttatattacggtaaattatggataacacctcttggtctgcctgccttggaaatagcataacaacatcacaatatgtgaaagttttaaaacctttatgctatttttatgttagatctctcaactggagagtgaataagtgtgtttcttttctcctttatatctcctcaaatttaaagttggctgtttcttttagttatgaactctgaatgaagtaaaagttaataattttaatgaaacaaatattttaatggggcttctacccacaatctggagcacctggataatgcatctactacactaagtttcatcaagaatatttaatagtatccaaaaatgttttggctatattccaagtaaacatagccaaacatgatatgatatacataaattcttcagtatactcttgaatagacaaacactgttatagtatctaatgtttcaaaaaagccttttctttttgtttctcatttaaattcatggttatttctttaccagtacaaattagagacttgcaagaccccattgtgtttgaagacacaaagtagaatccatttctaggtctcaaactatatttagaatatggcaattctacaaaactaccttcaaataaatttaacattctttcagattttttccggaaaatataaaatttcttacttttctttttcttctttgaccgttttatcctcaagttctaaaatataaaatttcaaagatgacatt

SEQ ID NO: 96415 - DNA, 1128 bp, Homo sapiens
tatgtttgtaaaattaaattttaggcacaaagaatgtggaaaggagatgaccaaatttggttatgttggtcagtgtgatattaataaccaactaaatatttttagtgtataatgtagtttaaatatttgaaatgataacatattcaagaaaaaagctaacttaaatggttgattgcataaacaataaattttagcaatacccagattagaactaacattatttgaagactcacttgctaatatatttatcatttcagaccatacacacaacccataaaatattagtgggctgatccaagcaaagcataagttggtgtttaaagtaagttgagtggaaagaaagctataaatctgttacaactctccttatgcatatataaaatggaaggtattattaaaatccccattccttttagcaaaggatttgaaatggttttgaataattcatcaaaacataaaacattgtatgaattaaaacaaaatcataacctaggaaaaaatatattaagcaaaatatcaagagatggaagaaagaaaataccatggattgcaaaaaaaataaaaaataaaaaatttttgctgaaagcactgttttgagagaccaactctgtatcatctagggatgtactcttattatagtgtctgacctgatccagaggtgaagaagtacctctatgcagtcctttaatgttacttctcattaaatgtcacttctcattaaatgtcacttctcagttgggctattactggtagtatgacaggtgatatcttgagattgtctccttttcagaggacctggaattccctatgctttaaaaaccatgcaggtataacaggaaattttttttatttttgttgtcttgttatgaaacatatgtaatttaaaatgaggatcatatttgcttttttctttttagataaggtgttgcaatgacaaataagtagcatattgcaaatacaaacagtattttgttttggaaaatagtttaccagttgtcccagtgccttcgttgagtaatactttttgtcctaagttttgatgccatctctattaatattttgtgtatacaactgcttttcccagttcacttatttatgatagtacctatattttaatattggaaggaa

SEQ ID NO: 96416 - DNA, 2000 bp, Homo sapiens
gcaatagcactttaactttcaattttgttttgtttctgttatctgatactgtggagagaattctagccatcttgcccttaatacccagcagccagctatggagtaaaagtccagagtattagtaggaaaagagatttgaatccaagggtcccgagagttgccactattgtcccttgtcccctactatcgtataaatcaatatattccaatctgactacgttttcacctgaagatttcagagaatcaatactgccctactatttcttttgtatttttctatttaggaccattcagaagctaggccaagtacccagagggagagaagagaggaaatttctgtgcatattcaaatatgccttttaaaaactacaacataacaaagtattccagcttcatttttaaaattttgtcctatttatatcattttagacacttaagtgagctgctgaaaagaactgctctccatggagagagtaactctgtccttattatcggaccccgaggatcaggaaaaactatggtaaaagctgttgatttctggtgtttgttggcatgtgatgattcttattttatataagaataaataaattcatatataaatcttattttatgtaatactgaaaatacttttcattattttgtaatgttttacttttttgtttttttcttttttaatcacagaagacatgtaaaactttataaacttagggtggtatatttgagtgtagcagacctttttcccccttatttgtcctcctagtgaaaaattgtcaattgatgtttgttccaacatggtcttttgtccttaaagaagtagagatttccagtggaaaaagaaaatagcatgtattgagcatgtactatgtgtctttttattgtgttctctcatttattctttacatcaacactgcacggtagggtttttccctttgttataggttagggaactatcatatcatgcattctttttatttttcctacatcattactatttgtttaaccctaacttacacagtttttcagtgcatgctcacatcttatatcattcttgtctccttttgctctttatcatatttgcttagttacctcaaaaagatattcttacttatttccctttactcttttctttgatatcctttatgcaatataggagacaaattatgggtgttaacttttgaaagcaattaatttcaatgctaagtagtctgtgtaaaatctgttctcatgtattatatacaataaatttcaatttttgaccaatgtactttaaaaaaatggatgagaagcaaaattttttttaacatttaagcaatgtatattgaaattacattattaagatgagtacgttaggattttactgttatcacatctgaagtattgtttaatataaattgagaatttagatctaggtaatttctttcaatatttcacaaattgtcacatttatatataatcatatttgcagtaattttttagtttcaaatctatgtttaatttgttttagtcctcatactcagcttctataatcactatttcttcattcttgagttttttattatggtttttctttgcatttgaattcactgttattttgggtagttttcacaagagggctatgtgaaatgtttttaaatttcaaatttttaaatttttaaatttaagaaactttttattttaaccattctaataggtatatattggtgtctcattgtttgtacttgtaattctctaatgacatatgctgttgagcatcttttcatacacttctttttcatctatatatgtttggtgaggtgtcttatgcccatttttaatttgggttatttgttttcttattgataggttttaggagtcctttatatttctgattttcagttttgttttgcaagtattttcttacagtctgtggcttttcttttcatactattaatattatttcataatattaaaagaatattattcttttcatactattaataataacattgtctttggcagag

SEQ ID NO: 96417 - DNA, 1071 bp, Homo sapiens
tcttttttaagaaggtacatttttctaggaaaggtctctaggagtgctttcagtcccaagtcactattcatgttcaagagttgggattccttctgttatacacatgacattaaggaagactttaagatcatgaattctattttccttcaatttcctcttatcctaatgatgttgtccttaaactctgaacataaattgggtagtttatctgagtccccagctttgttaggcaatgtgcttttatttttatttttgattttgattttttgtgtttatttttattttaaatgaggtctcgctgtattgcacacaatcatcctgaattcctgggctcaagctatcctcctgccttggcctgtcaaaggataggattacaggcatgagccaccacacctggccttgtgctttgatttttttaccatagaccggcacatcttccattagctcagccttttttctcagccttttcttctagacaggaaaatgtcctcagaacaaaagttacttggtgtatggtttgtttctggtttaccttcacatggaatttggtaagtaatttcacattactttatttcattcattatttagtttttttgttggcgtcagcagaaaggttggtcctgtctgccactaccataaataaaaccctaattgtctttcttttttacttctgagatttgattttaatatatttatgctttgagccaaaatttttttaacttaactcatatatttaaaaattttaatttttaattactatggatacataaaatggggagtatgtgatatttgatataagcatacaatgtgtaatgatcaaatcaggtaattgggatatccattacctcaagtatttgtcatttctttgtgttagggacatttcatttccactcatttaattgttctaaaacatacactaaattattgttagctgtaattactatattgtgctactgaacactatattttattccttctatctaactatatttttctacccattaaccatctcctcttgattctcctctcaacactacccttcccagcctctgctaacatctttttactcac

SEQ ID NO: 96418 - DNA, 3337 bp, Homo sapiens
cgggagaggggcggggtgggagaggtagtgcgtgcgcggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggtaatggtgggggtaaacttgctgcaaacgaaggccaggggcgtcggtggcgcaaggtgaatcgaaagtgggaggatggaaggctgtggagattgggaattgggaagggggcaggcttgtataggccgggaaggccaggaccaggcgagctccgtcttgtggccactcccgccccgtgagcttgccgaggaatccttgacaagtgcagggatcctgagtctacctctgcatcggggtagtaggtgaggagcgtgacggtccgagtgtaagagagaagggaactgtgaagcctcagcaattgaccctcatgactgcaggacggaggacttctatctagggacagagacaagtcctctgtatgcattttgaccagatgcatcacacgcgttgctcatattggatattgcgcccttcatgccttacctctcaaccctccctggtattctggagtggctttggggaaggagcaggcagggaagtcttgagtggagcttccctccatgtcttgcgttgttgctacaacacaaagcctttgctttttctcggagagggatgtgggattgtgtagtccttaatgttgagttctacgattgatgaaggagaagggacgtgatcaaagtttccccttatagtgtagatgagagttttaaaaggactgttttgtcaagtttctttggttactattcttagtttttgagcctttggtttcccaaatgccagctgtttttgctgaaaataatgaatttctatcataaaattagaattaactcaaaatatttaagaaaggatttataaatttacattagtaaagcttttatagtgaaacagtgctggttctttttcattgttttcatacaatcaatataaagcatcacagtctcaatatgttttgtaaagatattttgaaggaatatcatctttgtatgttttttaaaaaccaagaatctaaaattcttcgtatttattatgttggtacttaattctgttgggtgggttctttttgtttgttttttgttttgagacggagtctcgctctgtctcccagacgagtgcagtggcgcgatctcggctcactgcaacctctgtctcctgggttcaagcagttctcctgcctcaccctcccgagtagctgaaactacaggcatgtgccaccacgcctggctaatttttttgtgttttcagtagggacggggtttcaccatgttggtcaggctggtctcgatctcttgacctcaaatgatcctcccgcctcggcctcccaaagtgctgggattacaggcgtgagccaccgcgcccggccggtgtaggttctttaggtgtacactatcagttaaagttactaattttccacgttttgctttctgtaagtttgggcagtggaccccgtttatgcatcattgcttagcccttagtatcttctgtattgtgtacggtaatcatgtccgatggaatcaaaactagactcctgtgctttaaaattttctttgtagtgtaaccaattgtctgtctttatagtgtaaccaattgtctgccactttgtaatgaaaaaaaaaaataccagcaaggcagttaatgtgccttagctacaattttaaatattttgtgtctttttccatacatttagtatttaagcatacaaacatcgatacatagtataatgaaaaactataaagtgtgaactctatgtaagcgctgccacagtcaagaactagaacgtctgtggcacctgagaagctcccctctccattctattcctgatcatccctttcctcaattcttttcagtggttaacactatactgatttttatggcaatcatttactgctttctttcttagtatttcttaaccacctatgtcagcattcctaagcaatttaggttcgttttgcctgtttcttaattgtatgtaagtggattatatattacatatcattatgtatctttttctctcatgcagctgggatataactctattagtacatttagctctagttcttatattggattgtagtaatctatagtataataagtatagtataaaaagtcttaatggaaatgagccacagtttagtctaatattaataaacatttggattgtgttccgtttttagtagttatgaacaatgctattatgaatgttcttgtacatgtattcttaatgtacattaccatgggtttttgtagagtacgtatgtttatcttcaacttcactagttatgccttttccaaagtagatacaccaatgtataccccgacagcagtatatggtagatccctttacttttactgtctcaccaagagttatttttcctttttcccaacttgatgaatgtggctttatcttattgttgttttaatttattctgcccaggacactaaagagtttgagcactttttcaaaaacttaccggctatttgaatttcctctttctagaattgtctttttaattcttaaatcttttgtgcattgtctttttaaatctttttgggaggtttttttgtttgtttgttttttgttttaattgggttgtctgttttactcagggatttctagcagtatggccaatatcttctctgtgcttggagcattactctcttctgggatggcaacttttatcttcatgtaggtcttataggctgtcattgttctttgaattgtatacgtagtttaaactccagataacaagttctatgcttgtgctattcattgcagtagctactagctgcgtgtggcttttgagcacttgaaatgtggctagtatgactgaggaactgaatttttagttttatttagtgttcaattaagtttaaaaactgacacttgattcagttactgtaaaacctgtatgtttggaacaactcggatacataaacctttcttaaccgcaaattattaaattattattttttaatttttggagattttttcccccctggagatggagtctcgctctgttgcccaggctggagtccagtggcatgatcttggctcactgcaacctccgcctcccaagttcaagtgattctcctgcctcagcctccctagtagctgggattacaagcatgtgccaccacacctggctaatgtttttatttctagtagaggcaaagtttcaccattttggctaggctggtctcaaactcctgacctcaagtg

SEQ ID NO: 96419 - DNA, 1021 bp, Homo sapiens
gcaggaaaggtaagtgtgtctgtgggggcttcattgccttcctctggctctgactttcactccggggcaacagtagcaccaaaccacatacgcagtggagctccggggtgaggagggggtggtgctggggggggtgaaggaggggttggagtagggaggggtgtgtgaggtggggtgcccatcctgtcaggggaggaagggcacttttatttttatttgctgttgtcaaaagtggtttctctcctccatctaacatctgattgtgtcttgctccagtgggggagaatacaaaaacaaccccctccttcctccaatgaggcgccagggaaagagacagaaagaggcacactttctagatgtcacttaaaaaaaattcattggagagctctttttctccaggaaaagctccactgcatttgtttctgagtgggaaaatgtcgggatctggattgtattggaactgcttatccatttgtagacctgagtgttttcccctttttggtcctgtatgagatttggatattgacttcagtgttggaagacttgattggtttttgctttaagggtttcattttccattttttcgttttgtctgacttccatggaaaatttcaaatttttagttggtagaggcctttggttaggttttgacttgcattattgctttttttttggttaaatgtctgtttcatatatcagtatataaagtccaaagctctaaaatgcttaaagtttaaatgccactgctattgtctgttcccacatacgttcctgatacttattttccatatgatgagaatattagctattttataattaatctgggtatatttgtaatctttgtaacttgtctgaacaagtaatccccattgaaaactttatgttgttctggctgcatggaaggccaaacctctccatcaatagtttgctggattggtaccactttcagttttagctgaattatttatttactgttgtaaattgagatgagtttttcatctcaatttctcttggggttctg

SEQ ID NO: 96420 - DNA, 1025 bp, Homo sapiens
aaaaaggaaaagaaaaagaaaacttgaggattggggaaattaaggacacatttttttttcctgggatggttttgatgtaacaccagtttgtaatcttcttactgtgaattaatcttcactgtatctgataataaaagagtttataataagttagaaagcatatcccatcaatcacatgtaaggttttgactaaactaacggataaagatttgtaaggaagttaggtgattttatcttactgtccattgtatttttttaatttggtttttgatgttactgtttaaattataccaggttaacgaagggtttgatttttgtttcaaaaatatatattaaatagaaaaactgagtacacatcctaatacttactttgacttggggacagcaaagcacaattataggatcacactttgagaagtaaataaactgtttgaaaattgagtctgcaaagctagacatagtaacaacaggaaacatcccacctacaatgcatatggcaaaggagaaagatagtgcagcagactacagacaaaaataatagctgagagctgaaaacaagtattctgctttacaaccttagatctgtcatctcaaaaatagagataatctttcttcaaaatataatatggtgatgtgagcatattttaatttataagaaaaatctttttctttaggtatcccatatcatatttttgcattctttatagtggagggtacagtgtctcctgtatgttttaaaccttattatttttctggtgtatatttgttgttttgtcttctagggacacatactatttttactttactaatgtgccaaattttaagaaatttaatacttaaaaaaccgaatatgcaaagttcgtaaagtaaatggtgagaagatttcactgaagaattgctttaaatagaaagctcttctgatgtacttaagtgtttgtaaagtcacttcctaccctgggctaaaagagacacaagaaaactcgaggcttaaaatgttggaaatcactgttgcttgaatagtaagc

SEQ ID NO: 96421 - DNA, 1405 bp, Homo sapiens
aaaagagaaaagaatggagtagaaaacagaggactgaatgtactcaggggaaactctgtggttgaaaagtcccccagaaggcctaaagttactactttgctcccttgagaaaagaagtgaataaatttcctagggtgggtatgagataagcctctctgtgaaaaattgccctgtctcatcctgggatgttggaatagtctagtccactcttcttacatgaattcttgtgtactcccagaaagtactgcagtgctcaaagggtgaggcaggaggagcaaagaaatagaatttcattagtgatgttagtgtctgagaagtggtgccagcaagagtcatattgaccacattgtgggaaatggtaaaaaagaagcattttcctgtggttgctgggagtttctggtaacatgtgatggattgactggactgtagcttgactagacagtggcatcaacctgtgtattcactggttctcagctgcccagtgattgtacccagaaactggacatcaccttagctctttagaagctagaaatcttgtggcaagtggatttcgtgcaccatccattcttcactttgctttgaaccaagggaggaatttggatagcactagaaatttatggaaatctgtcagtgggagctagccatagaataattgttatgctgtggttttgcactccagctgtatttctagctagttaggactatggcaatatcttttgaacaagaaagcaaacaggaaaaataactgaaatttgttgagtaattactgtttacctagtactgtagtacttgctttctgtgggggagaagggtggctttcattttttattgaggtaaaatccacatagcatgaaatttacaatttaaatcattttagagcatgcaattccttggttttcagcatattcacatttttgtggagccatcaccaaatctaattccagaatatttctatctccctgaaaagaaaccctatacctgttagcagtaacttccaagtacctccctccttcccatatcgtctggcaacttctagtctactttctaactatatagatttgcttattctggacatttcatataaatgaatttatataatatgtggccttttgtgtctggcttctttcacttgaataaggtttcattcatatgctaatgtgcatcagtacttcaatctcctttatggctaagtaatttttcatatgaggatgtaccacattttgtttatccattcatcagtatttggtgatggacatctgggttgctttcactttttggttatggataatgctgctgtaaacatttgtgtacaagtttttgtgttaacatatattttaacacattcctaggaatgtaattgctgggtctcatggtgactctatgtttaacatccaaggaactacca

SEQ ID NO: 96422 - DNA, 1044 bp, Homo sapiens
aggtgtgagccaccacacccggccaaattataccaagatttaacaaaataacagacatatattaaaatattaagaatcattttgttcaaagtcaaaaatcactaatacgggcctttttctttctctctgtgtttagatatatctgtatatgtgtgtgtgtgtgtgtgtgtgtgtgtgtgtgtgtgtgtgtgtgtgtatgtgtagatatgggtttatgtatatgtaaatgtgtgaatatttagcaggaagccacaattattgaggcaggtattgtggtaagtcactttatattctcatttaatccttctaataatctagtgaaataactactatttttatccccatttttgagatgagaaaagtgacttctagagagaggaagcaacttgtgcaggattacgcagtcattaaattatagactttggaacttacataagatctctcagtgctttatgatattgtagctaacagatatgctcaatatgtttttacctgttgtagaatccagatcattaaaagaaaagatatttgctctgtgataattcagcattacgtttatcctcttaagttttctccggcttccctctgtctttagaatgcgttctgtgtctaaacttttgaaaaacaaagcccattgcttttgtcctacaaatatttcatagaggatgctacgttggctatctctctttttaagttgaaaatagaataagaatttaacttcacatgagaacataagaataagaatgctctaggttttgtaatcattaagtttagtttttaaaaaatgttcattgtgaatcataatcctaaatttgaaagatcatgtgaagaaaatgttaaaagcttattggacagtacatttaaaaaagtcttgcatgttcagacattttcatcctctagaggaaatcatagctaaatatacgtatctgtacttcttgttttagcctttgtatactagtgtttattcacctagagaattcagtattctaatttgaagataggttctaccctgctcatactattcaatataataatagcacttat

SEQ ID NO: 96423 - DNA, 1096 bp, Homo sapiens
cctgaaatatttactgtctaatcctgcacagaaaaaagtttgctgacatctgttctataataactgtacttaaatttgaagctcttcaaactaactgctctctagcccattgtcaaaagtcacagaattgtcttgtaagctccacatatctcttaatagtgtgccttttgtttaatctgatactttatttcatggaaatataaatcttttcctgtgtctttggaatggcaattttattggcatcttgagttgtcttgttactgggcattgtaggcataggtgactatttgatttgttgcatagttaggtagctgtgagatggccagactcttaaatgtctttatgcagatattaagtaatgacttgttttggaacaggaattatagcaaccaagaggatacctgcttccttagttttagaaatcaaagtcagagaatggaagtacatagaagtagatttttatcttctctactatggactgggtaactctattgaggataattttaaacggagtaagagactgtggttcaaagtgtatagaatgtaaaaacaatatatagtgtcctgctccatatgaagcacttgttgataatacctaaggacgtgtaagaatcactcatggtactcaaattcataatagaggaggagggtattttgattcagactgagaggagtgggattgtataaaacaagtctggattgttctaaagcagtttttgaggaaaaatctgcaaaagatgtgacttttatagcatgagggtagggtgaacaacaggaaggaaatgatgccttgaacttaatacataatatactctcatattgaccatcagagctcaatttatgatagagttgggagactcgatagattaaagaagtctgctaaattccacaccaactttaggatctacttaaggtgtaaggggttctgttatgtggaatgtagaatgtcaatgccaaaaacacctgttcagcaacagtttgtagaattctagatggccttggtaaaggacatttcctatgccgttgagttgcttataggaactagatttttatatttttgggaaaactcctctttcagatctgttgcttcagagct

SEQ ID NO: 96424 - DNA, 1063 bp, Homo sapiens
atttcatgtacccaaaagactatattttctatagagtatatttcagcataagaaccagctcacagctcagagtgtcagggtgctaggcaatcttcaaaattaatgtccaataaattttaatgtaaaagggtctaaataaatgtcaacttgtttattgtctcctccaaacttcttcattccctccaacagtttgaataaagtacaaaggtagggttcttgactgtcttttaaaattgttatatctttagcatttagaacagtttctgggagaaagtaggagcttaatggtatttgttgaatgaatgaataaataacagatgagggagataatgcaattaactcctaattgtatatgcacagatatttccagtataaattgcttatgttctctcaccatctctcctggtttcgactacaatactagagaaatattaaactttttacaaggattaaggataccttgaactagctgagaaagaatatagcaccttggggccaagcaataccagccgtggtaaggagttacatcccatcactcatatcaccctgactgtaataaggaataagagtacagtagatagggaagagaggtaagaggagcatattgtaagttctggtctcctttttttcaaatggaccctgtgttgccgcagaacccatggtgccacccactcagaaggcttcctggatggctctgtgcatgcttaagatgaacgggtctacctttctttgttccttccccattcttattctacatagtacctactgcactgtaacttatggttttgtgggagaaattccaggtatcttagaatacagaatcatataaaagagcagtaactactcatcttgagagtgattgcatttatttcataggtaagtaatcttgcccatagctaatacacttattatttccttttattcacttccgcatgagtctatataattcatttttaggctcttctgaatcattctgcttccattctgtagcatcattctttttggttgctgttttcttccatacttattcctctttgaggaaatacttcgcacttcatatgca

SEQ ID NO: 96425 - DNA, 1025 bp, Homo sapiens
cattaaatatcttccattttggggtgttcgtgtagttcttgttaaattttgctttaggtattttgaagtgatgttattatttacatacaagtaaataaatgaaatcttttatcatttttaatgatactcatatctaggaatgcctttttccttagagtatatttgccttagactaataataatatagtttttgctaatagttttcatgaaaatctttttctactttatactttatgttatgtaattgtctcttgaaaagaaaaacatataactaattttaaaaatccaacctgacaatttttattttttgctgtatcatgatacatttatatttattgtatttgctgttatatttgaatttatttccaccactttgtgtttttattttcctattattttttacttttttctcctttattgccttctttttgtattactcagtattcttattatcatttgttttcccttctactagtttggaattcatgcagtctatttgtaggtggttactcaagaaatggtatcatgtgtacttttcaatttatgtgcatacttttactatctaaccaaacaaaacaaaggccttaatgcagaatatttttattacatttttccaatttatagatttctgttttattcatttaattttgtcattttaacaatgtaataaataattattgttttataacatttatattccttaggtttactcacatatttatcatattttttcttgtcattcctttggcattacagatcttctatctgttattattgtccttttgcctggaaggatatcaacttatcctacttactctatctggtattttagttgttttaagtggtattcatccaataatatcctgtgaggatattagagtagtaaaacctctcaatccttatttatctccaaatgaccttatttcactgtgattcttagaagttattttgagggggcatagaattttaggctgtgaatgaacttcttttagtgtgttgaagatattattttagtgtcttcgggc

SEQ ID NO: 96426 - DNA, 1015 bp, Homo sapiens
gatgaaacacaatgcacctaatgttacacaaaagtttaactttatgaacaaaaaggaagcattgatcactagatcatagaatgaattattacaaagggtaagaagaaactgcaggtcataccacctatttataaccccaactgcacctcaagtattaggagtttgtgtgataaaagcagcaagcttttagccatagcttgtcagtgaatagctgtagaagccacataataatgaggggcatggctgactcactgtacgctaaagtagaagtaatactggtgattgctatctgtgtaactggtctaatgagatatttatttattcattgatttatttatttaagagacagggtcttactttgttgcccaagttggtctcgaactcaaactcaaacccctggcttcacgcaatcctccttcttcagcttttcaaagtactgggattacgggcatgagccaccatgcctggccaatgagatttttagatgatcaaacaggtgcctgagttttagaagtagtaagtgccagaacaggactcctgggatttctgagtccagattgaatttttttttttccaatttcagcaccatagtagaccaaatgagatggacaagccattaacagaatatggtgggaattagatttaaataaaatgtaagtataattgggtaacaaatgaaataatgattcaacaataagcatttaaaactaaatttgttgggagaagaaatagcacctaagactatttgtattaagtactgtaaaccatgaactgcaaagaggctcatgtgataattcctcatgcttatgttactttgcaaagtgttaaaaattcataaagacgttcgttttgcaccaagtataaagtatttggtacaaaggtttgttaggccattttaggaaaacatttcaagaaaccttataaatggtataattttatagagaagaacagaacattttagtttaggatatttatgacagagcagaactactaataaaatgtacatatgctgagg

SEQ ID NO: 96427 - DNA, 1071 bp, Homo sapiens
taggaaaataatagcttcaagcccatgcattttgtcctaaaagagaagactataactatcatcattattttgaagaaatgttaatacaaattttaatttaattatttaaataaactttatcttccattttctcctgacagcgctcaatttttcttacatagcagattagaactactgtacttctcatagctgatgcagtatagcaatgaccctgtacatctcagatgcccctagagtatcattcttttatggaatggtacagcaaatgatgaactaggtcactgaaaccatgcaaaattatttttgtatgctgtcctttatgatggatatttctgttcattactatataaacatgtagaaacaagcatgtagagaattttcaccaagtatgaaacatttgtattggatggtctaacaaaatactggctgtgtgatattaaaaaaaaaaaaatgcactctggggatcagaggaacctatctcacagaccggttaaattacaataccaaagaggttcttatgactcctcatcaggggagacatgcctgtgtattaaaacactgtagaaggaaaaaacagtcgtgttaaatatgagtcaccaatcaaaagtcccaaggatggatctgccacattgcaggctttggtttgctatccagctctttctcgtgtagcatactccagagttaacagcagcaggaatttactcacttagtgatggttaatgattctcctgggcaaggttggggagactagctaatatgtaatatatttttaaaaagctcaccaaaggtgattagaatccaaatagtttgggcacttaataagtgaagcttcacttaactgaaaactgcatccatccataacatctcatttcctgataatacgagatgaaagaggagttctttggcataaaatgtagtatacaggttattcaaagggacttacttgttgctgtttttataaaggggagttataggtcaagttatattatcaactaatgcaatgattaattgtccatattctaagatagaaattaatgagggcttactagtttgaaagcacttattttcctg

SEQ ID NO: 96428 - DNA, 1033 bp, Homo sapiens
gatttctctatatttgaaatattggtaatgtcctagaacacagattcttttattcccatttcagtgctctttttaccacatcatattggaaccattatttaagtgtatataatgaaaagcatcttgtttttttcatgtatattgacaatggatttttgctttgaattttagacaaataatgcattttagtgtaactaaattgaaagcaccaaacactactactaattttagttttgtttaactattcaaattttgtaggttgttttagacaaaagcagataaaaaaattatgttgtacatttactttaaatattttaccactttttttggtaagtttatttgcattttgccatcccatgtaaaggtagttaactagtcacaattctcccatttagttaatctcttgaggaaattactcaaatactgtttcttattctataaaataaaataggtgatctggaatgatagcttaaaattctttctagctctatatttatctgaataagagctatctaaaacttgaattttaaaatgctgtcatacaaagtacttttttcctaatacatttttgagataagtaggatatataaaacattgctaatatattgtgaaaatctctggaaatgtcttaagtaatgtgaactttattgttggtaatgctgttcttttttttttttcccgaagatagggcctattgtattgcccaggctggagtgcaggcagtggtgtgatcttggcccactgcaacctctgcctcctgggctcaagcaatgctgtcacctcagcctcctaagaaactgggactataggtgtgtaccacctcgcccagctaatttttttattttttacagagattaggtttcaccatcatcatgttgcccaggctgttctcgaactcctgggctcaagcaatccacctgcctcagccaaccaaactgctgggattacaggtgtcaggcaccgcgcccagctggtaatgcattttaaattgacaaatttaaaagtgtaatcagaattagctgtaaaataattt

SEQ ID NO: 96429 - DNA, 1050 bp, Homo sapiens
tgctatgaattgataatctaaatattttggtttttgttctagatttttccctaagtgttagagctaagaaatcagcttggtcattatagtgctcttgccagtctccttctcttttctcaaagagggaaagagccccagctagaggaaagagcccccaaacttggagtaaaaagaactgttttctcatctccgatctgccactgactataacgttgtttatttaacctcttttgattttggttttctgtactgtaaagtggattgaattacctgattgatatagctctttttgaatcttcagtcttaaatttaacaagccctttctgttagagtctaaaattctatgattttaaatgagactgcataaaaatctcaaaacttccttaaatatgaatgtaaaagaatacagaataactggatgtgttcaaaattggtaaattcaccctggtatcgtttttaacaggaccaaggaaataaataccagaaatcaagaagagcacacactattttccttcatcaatccatagaaccctaatgcttctttagttccatcaaacacagaggaatgaccaccatggcagatggcaacagaggatgtcaacaattttttggaggcaagcaatgaaatatttctactatgagttttctgttattaatcatgtagacacaagtagaattatattgggttttaatttaaaatgaaaagtattatttcctgtaggaatttatgtatgcatgtctttttctttattttctttttttcctcttttaacactatagcatgtcaaaaattacattaagatgcatttgcccttacctctagagtaacagatagaataaggctatcttaaatcctgaaatacagaacaaggatttaaataaccaaaattaagtacctatatttgaaagcagggctttttcatatctctcttggacacatatataactgtaaatactaaataaaattggaaatcagaattattttctatttattttagagttagtcatactatttatgagttttatatagttaaaggtagcccagcattt

SEQ ID NO: 96430 - DNA, 1044 bp, Homo sapiens
ttcatttctatattacacacacatatatatatatattcatttccatattatcacatcaagaagaattaactgcaattctgaggaaatatagaaaaataagtagggcattactgcatggccagtgttctgggctgtgtcctttttctcttctgggtacacttaaagccagcccactgttaggtcgccagaagatattactgcagtatttcttttctatcaaagaagaatgagtctaaggaagtttctgattttagagtcagatggaatttccagtgagaaaccaggcccagtgaaataaatatgtgtgtatgtgatcagtgaagaatgtattaaaaaactaccactatataatgagctattctattgtcagagtttccttatgactaaaaagtgagtgatttgtacccttgctaaacatgtaattttaaaaactgcttattgaatggtctctgcaatgagtagttaacgtgtctgtcctgcctattagaatcatattttgaatgtgtgtatgtatagattgttttgtgttatttttaagcagtgcataggattttatgtgtgggtttcaaaaacgttttgctatagtggaagtaatgttatgctgaagacaacaggggaaactggttgaggttgcattaactctctctgtaagcattattacagttgccattcacatttatgccttttcaaatagaagcccatcaatcacgtaaacttagggccagattctgatctctaatgcatagcatgaattgctacatatcttttttccaccaaaaaaaaaaaactgctcagtaacatctgagattaaaatctgtcctttcaaattgattttatttttatctagactaagaagcaaagtatagtgtcagtcctgtcaggacgtgatttctttttttatatagaattcttacagaatcaattgtttatgtatttctgtaatcataatagtagctctgagaaatatagaaaaattattgttatactttttaaaatggaatctttttatctctatgcaatcacatgtgctaatgtagattgtag

SEQ ID NO: 96431 - DNA, 1574 bp, Homo sapiens
tctttcagtgtcttttgagagaaaagaaatctaccatttaactattgttactttacagatcatctttttctaacctctgatagcattaagacttcttattaaccttgattttgtccttgctctgtggtggattgaggtgtggatatatttttatggattttatcttctctggatttgatgataatgatgcttttaatccaaggtattctactgatctttagtactggggatatcttagacattatctgtgcaaacattcttatctgctatgccttctacattctatttctaaaatttgttctatgttaaggcctgtatcctacatgacttaacgctgtttcagttttcatctctctgtatctctgtatcacattctcagtgaattgctcaatcctgttttccagtttactaggtgccttttctactatatccttttctaatatatcctgtctactaggattttctttttcaaataataaatttcaatttccaagaatttttgtcatttttttgcatacaccaattcttatattttcttttaattttgttttcaaaatttcttattcttttttaagatatttcttcctttacttctgtatgaatcttcaactcttatttttatgttttctgattgctcgtaaatatatttcctcttgcatttttttaaaaattcatgatctttcaattgtgtttgttgactttcttagctttagttttcctcgagtgctttggaaatcattttgcaggttcatcctgacagtgacttttttttctctctatctctatctccttttgtttatcccaatcattgagtcagtgggtggattgacttaagttttaggaactaggatttgtctccctcctctgtcttcctggttttatataatggtttatccccaaaagcttttttcagcttcttttcacagtttggggaatcacatcttagtgccatttttatgcactgagacttgctcaagtcttttgccaggtggttctttttaatctccactaacatgcaatattaacccttggtgcatctaaccgctaccagacttggagcttaactattctataatgtcagccttgcgtactactttgtgttctgttacacagtgacttttatttttagtacagcagtatcttgatttttttctttactatatctcttatactttattctgttatactttttcaataatatatcttatactttatccgtaattgctgagtactgttttaaatagagaagtctctaaagtgtctattgccagtaccatcttgaccaggaatcctgtcaaaacagtttgcacatacatatttggaaattaggatatgaatctttgtcaaacccatcacctttggcatatatatgattcattctatttatttgtttaatgcatagatatgctacagcaaaacaagaataagaataccaattcatgttctcatagcatgacttccagactcaaattggatggattcaaatcctggcgttgatatttgcttcctgcatgactcatcttttcaaaacctttgtttcctcatctgtatttatgacatgtctgcttcataga

SEQ ID NO: 96432 - DNA, 1051 bp, Homo sapiens
aacaaagtgatcatagttaccaccaccaatattgtaataaactttcatttcctgtgtctcctgatatgatgcatggagaaggacacagcatcgcctctgtaatattcccactaaaatgcgtgacctcaattgaattatgaggaaacatcagacaaattcaacatgtggtaaaaatttttaacaaaatgaccggcctacattcttcaaaagtgccaaagtcatgaaaaagaaagactaagtagtggttccatttttcaaaaaacttaaaaaaaaaaaaagtaggaaactgaagacacttaacaactaaatgtcatgtgataattgattggttcttggcctagggttttttttcaatctataaaatcccacaaagggcattgttgggacaattacaaaaattgaatagcgtatgtagattagatacattacttttttaatttgataagttgtattgtaattatgcaagagaatatccctgttctaaggaaatgaagtatttaggggtaaattggaacattgctccagtttactctcaaagattccagaagtacaaattaagcagatagatgctaagatgacaaattaaatagagaaaaatgaaaatcattgaggaatctggataaagagttacaagagtccctcagcctattcttgcagcttttctgtgtgtttgaatatatactgaaataaaaagttgtaatactttttctttttgttgtaatactttttgttgtgattgtttttatttcaatagcttttggtatactcctgtgttcaaatcaataaaattatgaagcaaaattacagtgactaatctgcctccctcaagaaaagatagtttatgttatatttgtgagccatgttaaattctttatgttaaatgtaccatttgaattcaggatattaatattttaagtgaatgcacttaggggatgtataatagatagctatttcaaaacacataaaactactacatccagtctcttccaatccccaccccacctaccatacatttactcattctttattccccactttacctggctaattg

SEQ ID NO: 96433 - DNA, 1011 bp, Homo sapiens
cttagctttgtactttgcacacaaagcccatttccttattccaaactaaatatgtttatgcatacacacacacacacacacacacacacacacacacacgaacatgcatatgcccatgtattttcttactacaaagtcagatggtggaacaattctgaatgtatatgtagatagttaactgtcctcaattaccatattgtgtcttacattgtaaaagacccttgagcaacattaaacaatatgcgacttccttttatttttcttgttacaagtcttactgagatatccagttgttgttttttattacttccataaattatagttagttagcaagtgcttattgaatgctttctaagtgtaatgtagaatttaaagtgatattaaagaaaattaaggcctagcgcctgttgaccttccgtttgaagtttttctccacagtaggtgggcctgaaggtgacccatatgctccttcaccctgaggttaaggtgcaaaagacaaagtacctcctctcaggattctgggatattacagaagatgatcgctcaggcagacgtgcaaattggtacaatagatacagaataatcatagtacaaattatactatcctcttgaattgtcatgcctagcttcctttctcccacacatgcgtatgactattctcccacacatgcgtatgactatacttatattttaaattattttttactcctatgtatgcttttttcttaatattagaaaacaatactatttaaaatacttgattgcttatccaacttagtgatattattttgaattcatttaagttcttagctagcattgcttaatacctggtgtgtataaatattatgctaaatatcgatcctgaatgctacagtctcagacttctcatattttagcatcttctccaaagtataatacaagtcatcaatgaaaatacagtaagcaccagattcaaaactttatggtttcatagcatatcttaggcctcctaactgctgaatcttcagtaac

SEQ ID NO: 96434 - DNA, 1045 bp, Homo sapiens
gagcttagtgagctagagccagagctggtgttagagagcaatggcagcatggtgaccatgcacagcggcggctacaagcaaaattccactgccctgttttcaatatctaacattcatggcagctttcttccacaaatgttccactcccttgatttccatgaatctacactttcacagtgctgctcataacctctggatattctttctttttttccttttgtagattccatgcttacctactactttttttattctgtgtactctccacttttgtagatccgagtatcacagataagctgctgattccaaaattcacatttccaacctagacttattctccaccttgctctttgtgcagtcacctttatgactatgtcaaagagctttcttgccttctggcttccagttgggtttggcccaatgaaaggcatttggaaaagatcagaaggtgggaagtgagtgagactggggtattcttacagggttgccacaggttagctacatccatttactgaagggcacaactcctgtcaacacccaggaagtgcccttttctgacttagatatgataatgggtctccaatattgcctgtgtcagttcccttaaaccttgcccatgtccttatagataaatttttctgcaaattacacttttgagcgtactgtctttttttctaccaggaccctgactcatataacatatgagttataacttatttaccatgcctttcctaaactccttacattgtcctgaggccccacacagccatataattactaagacttgctgatttcagatcccaaatattactcaagtatataccttttctctcttttcactcttaaaatcctagaggcccttaatacatctctatgaattttttttaagtgtgagatagaaaaggactgattaaggtaaactgtgtagtaaaaattgtcaaccaccagcaaactgatcatatggtcaacgtgattatatttggctttattattctctagctaatacatgaatgtgcatcttgtggcccaaatgtttctgtcttct

SEQ ID NO: 96435 - DNA, 1039 bp, Homo sapiens
agcatgaaggggtgttgaattttgtcgaaggccttttctgcatctattgagataatcatgtggtttttttcgttggtcctgtttatatgctggattacgtttattgattttcgtatgttgaaccagccttgcatcccagggttgaagcccacttgatcatggtggataagctttttgatgtgctgctggatttggtttgccagtattttattgaggatttttgcgtcgatgttcatcagggatattggtgatccttatattttaaaagatcattgaattctttcaattttgttttatttataaacatagaatgtttttatctagtggaatgttgatagaatccttttttaactttttcttttttactttttttaaatttttttttcagtaatatggtattccccagaaagaatcctaatatacaaaataaattaaagtgaagctggttctggttaaagcagggttagcacctaagacagagcaggaatgttaattctctattaccagtgcttattaagtatttgttttctcccagttattttctccaactctaactctattgccatcctggccctgggctgaaacccttattcactgacataatcagaaactggttataatgagatcctagctcccattccacctgggcaggatgatttttcaagaaagattcttgtttcaaaggtatttggaatctccatccaacatgaaggttggtttattctttttttatgtaggaattaaagaaacttgatgaaagaaatatggaaaagctttcagtaaatcagaagagttccccattgtaacataagctctgaatatcactttctgagaggtatgatcctattagccctattattaactatatttttgagtagacttatcaaacttgcagttagccaaatgtcttttttatgtcatatactataaattatatctcttccatttaatcttatatttaaggtgattttttacccttttatggatatttggattctacttctgcattcattcttgctgatattgtcttcatcctagt

SEQ ID NO: 96436 - DNA, 1050 bp, Homo sapiens
gcctataaaggcgggtacctggaaatattaaccgactcacactgtaaaaatgagaccagtttctaaacaatagagattgtcttagtacaacatcaaggttcaagacaaatgttgaactaaaaactttacactccccacccccacttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcaggtaagttcttattattacctgtggtacctgcaaagttgtactccaaagactaaggagagaaccaagcatggtgactgatggcacctcatataaatgtgaaaaagtgacctttgtgctagaaacatatgagaatttttattgccttagatttccagagagaattttttgcattacttgtttatataaggtgtcattctgcttatctctgtaacaagaataaagaaaaataagaagatttctaaaagaaacatgcaatcatcattaccacattcacaggagaatgtaaaatactgggaatatcacttgacctgatatcacttgacagaattactctgtccttcagagtgtgtcagctggcttttttgataaaattgagtttttatccatagaaagtttcaattattagacttcttaatgcctcatgttaactaaaaatacatttctttttttctgcatagtctttaatctatttccttgcgtgt

SEQ ID NO: 96437 - DNA, 1060 bp, Homo sapiens
agtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggtatggttttattagaaaaaagtacccaaaggtactaaacttttctacttttttaaaaaatttgtaccaaaatatttattatgataagaaatgatcctttccccattgtgaaattctcttcatttctttagtatttataattttatttacagaatgctagggatttgtctattgggaagattaacagctaagaggatttcatgtgtttccattatttgttgtcaatctgtgtcattttgaatattgttcgactttcacttggttttataaccattggactccaaactgcaaaataagccatacgaggcagggtttcctggtttgtgagacatgtccttggtctatgccaatataaaagccatctccctagcttttgtttgtattcaggtaaatgaagtttatcttggaaaaatccaaaaaggcaaaaataaatggattttttttcttgctgctgaacagaagtaggtgaatggataggaaaaggtaactagaagttgtacgaagtagaaggctgtcttctaatgtgttttcttatcctagtttgctatccttattatttgtttgagaaaactcaaaaatggatattggctactcccttttaaaaaaaaagctaataatttaagctttctaataaaaaaaaggcttgaaaacctgatttccagaatttttaatcttgaaattgttttttgagtttcttgtagaactaaaccatttttatcattgacattaaggttttgaacccaaatctattgtatctcttcagccacc

SEQ ID NO: 96438 - DNA, 1649 bp, Homo sapiens
atagggggcttccagcttttcactcactcatcatatttctttttagataactcgacacaaatgaaaattttattttatctatttagcagaaaagtcacacaaagttcataactatttaaaagtacaccatatttattgagcataccttaaataattttgatgggacatttttagtctcattgcattatacagttttgatatcccctacctcagtttacttcatttcaggtctgagttcatgtgcaaagtgtatgtatttcattgatgtatttcaattcatctataatggaaaagaccaacatttacttatattcttgtttcttctgatggtcaagtttagacttatttaatactgttttggtcatttattttttttgtttcatgtatctttgtaatacatctgacctgtactgttactgctgggggtgtcaaagcatataggttaaaaatttattagtgtcagaaaagtgtgagcatataaatagctaaaaaggataaggatacatgtctagaaatgatatgaatatgaccaactagtgtaaactaacaggaagtatgtgcttaataaaaatctaagtagaatttttaaagtattaaacctaataaaattaaatactaattaacgtgcataggtctgatgtgcagctggttatgaaaacggattgattcactaatgaacataactctttcgatgagctaaatattgaagcagtctctaatgccatgtttctttttgccatgtagtgaactgtgtcaactcaatgtaccatcactgtaattgcctagcctaaatatctgtttacactgacatttattcattcatcaaataaccgttgagccttaaaggtaggcattcagaatgagacagtaaatgatagtcacagcttttcctctaggagtgttactgagtatttctatgataccagaaagacattagaagaaaaccacattttattcttaaaatgttgctatagctatctatcgtcaagtaccttttatgtaccaggtgatttccctatattatttctaatctgtgcagttttctaaagtataaagtattattgttcaattttacagatcaggagcctgaggctaaaaaaacttaagtaactgttccgtatcatacataactgaatcaggatttgaactgaggttcatctgattctaaaatccattttcctcccagctgcataaattcttcatctgaaacatttagtgctcaaaagtattgtgttccctttcaaaatcttttaaaatgttcaatagataataaattaaatcacattaatgcatgttaaaagccacatttgttaactattgatatacttcagatgaaagtcagttatttttgccaatattatagcaaataatgactagaatttttacgtcagtgcagaagaagaaatacccaaaatgtcaagaaaactgccccttattagtgaatcacatttggtgacctttcttttaattaattatcacctcactcaaattagaatgggtttcctagtaggtgacgtgtcagtaggcctttaaaagagatgtagatgctagtcatgtcattccaagcatggtagcacagtgaggatgaaaaaaaccaacaggtaacatggtccaactgtactctgtggttacagagcttagatacaact

SEQ ID NO: 96439 - DNA, 1028 bp, Homo sapiens
agtggtgtcaatggcagaaacattgctgaatatatctaataatgctgggaatacacctggtccagctaaactcaacagtaactctgtggtgccacagctacttaaccctctactggggacaggtctacttggtaagttaaattttttcacaaattttttacaaaagaaacgtttttctaattctattttctcctttttaaaaactccattttgtcacactatttttaaaaatgtttttgttatgtcacagcttgcttaaggaactaaatataacaacacccacacacaaccatagttatacaaacatgagtgactttttcctctttcccctattctagcaatactaaatatcattttaatctgctttctcttctaattctgatgccacctaaacctaacctacccatcacctcttaaaccaagtagagtctcatttttcaaataataaagcacaggtacatcttaaaaatcacttttatttgaattttagttggtgtggcatcacagggttagtatgagcagctgcactgtggatggaaacagattgagaaagtgttttccaggtgaaccctaaataaacaaaactaaatgcttgtctagcaaaacaagaaacaagatgtaaaaacacgcaaagctaaagttttcccaagttcaagggaacagacagcccctctagctgctactagatttcctcagtcagtattaattttttgacttttgtggcttaaaaatacagtttttcatctgtattatcctatcacaaaatagttcgaaaataatgccaggtatatttaactgatggatataggtaactataatataaagtgtggggatggtgtccataaagtctagaaacagggaaatgtacatcatgatgtcaatggcatcttcaaggtgtaaaaaatttgtttattatttatgtgtttttgattttatgaatgcctttataatatagtataattagttctatttggcattgaaatctttgtagttaaataaactacgaagcattacagatttacatgttt

SEQ ID NO: 96440 - DNA, 1030 bp, Homo sapiens
tctgagttcagaatgatgtctcctttcaggaaaagttctgggcctttaaaacatatggaaatgtttaacctcatagtctggttctacttaacacaattagatcacataaattaaatgaaagcttctccatgaaactaccgttcaatttaaaagaaattagtaggggtcttctgggcctttttttttttttttttcggcctttacaataatggtggaattggctcactaggcaagaaatatgcagagtgtttaaagtagatagaaaaatttatatctgaccaggaggagataattatgcacattcccccatatgattaaaaacgtataatttttcatcttcttaggtaataaaaattactcttacaggtatatgttattctcgtaaagagtgtattgtataaagcaatttcaactgtgctcaaactttcactggcacttaggtttaatgacaggaaaccaaaagcatttttgccagcacaataaagggattgtctttctccaaatgactaggaggtcctaaaaccttgctcataatgcctaatatatacttgtcaggatacactctggccataatgtttgtacatttgataagaaaatgaattccatacccctattcacaaaatattttattctctatactctctgagttcagacaaacattctttaggttgaaaaacctaaatatttttgacagtttattcaagaaataattagaaacagaaaaagtgggcttttatgatataaatggaactgctacaaatacaagatgtagacattgaactgttttacaatgtctgtgcaaacgaactaagtcttttttatgtgccattttaccaaaagcttaactaaaaaaaaagattatggcctcccttccctggaagcattctccctgtcctaaatgccttgtctaaatatctttttatgcccttaggagaataaaggcatgtacttttaacacatttcacattaaacaatggtctagatcttctgattaatctgtgctcgaaaactcctgagactgaggtattca

SEQ ID NO: 96441 - DNA, 1009 bp, Homo sapiens
ccgggcgcggggcggacgggctctgcctgctccgcctggacggccgtgctccgtgcgcaacgttagagaggagccggggatgcccggaagcgagccgccggcgttgcgttgtcctcgagaattgtcattgcgaggtggtccttagaagttgaggacctagtgcatctaaattggcagttgtaattttgataatacagcaccttttgggaaaattgctgcttttcctccgatgggttaaattttgcagacggttggatttcatctggcttgacagagagtgtttatgactcgagtggtgttacttgcgtgcgaagttcatagtaactgcaccctcaagaatttcttcaatgaacctacagtcccgccttattgtcaacctcgggtgtgtgtggattggttctcttgcttcagtgactgtcaaaaggaagctcgaggtttcagtgattggttttctcttttgactattaatattgcaggaaatgcttttatgccttcgattggctggttgagttctgacctcattatgttaccctgttaatactactttgctcttatttaatcacatttctctttgatgtatagttacttgaaagtcttacattttcagtagaaaatgcatatggccgtagcatcgggatgaacttaactgtgtgtgtacacacacaaatatgtaatagatatatatacacgcacatacacatatatatttgtgtgtgcatatatataaatatgtttataatcaaaacccagcatttatccctaaggtttagagctgtgagaacttttttttttgtatgtgagaacttttttttttaatttgtttctaacgactcagttttccatgggaaggaaaattaaaataaaatcatattatatacaatagttaattacattgaaccctaataagcacaactttggatatttttgctattttgtgggtcttgatccaaagaaagatggccttaaaagtaccagtattgtgtgtaattactttgatcctattatttta

SEQ ID NO: 96442 - DNA, 2902 bp, Homo sapiens
gtaaaaacatgaagcatttcttcttctaacaaaagcaaatgacatgccaggtattatctaaatgccagttgttatctaaataagatattgggaaactaaagtgttctgtataggaaaagtatgtgtaaggccgtgtactgaaatgttaggaataaaagaagatgcagacttcaatttcatagaacttaaatgaaccattaagtccaaaaacatgtatctggaaagttagcaaaaactacagggttaagacaacctgacagacatcaaaagagcattagagaaagttaaatgttagtgtagttgagaggcatgaggtgattcattgcatgtcataaagaaggcttcttggagagaggcgtaacaatttgggctttcaggtttggttgtatggtgtatgttgaagcaaatatttgagcataagaatatctaaaggaagttctgaggatgctgagtagaccaaaggaaggttcttccatgttagatgctttctgtcaatcatttcctattcttcctgctaatagaaactttaggaggatagcactctgatgttgctgaccatatcattcccctgttttcgttcggacatgcagacatcttttgcttctgtcttccccttcattttatccctgttacatcttcagcactaaaaaccgtttaaaacatagaagcactcagtaaatatttggtgaatgaaggagtaaaaataggggtggagattaggttggaaaaaaggtagaattagactaaattataggcagttttgaatgttaggcctaggagtttgtagggtggtatagatgaaagaccactgaagtatgattctggagtttttgtttctagttctggttgtcatggattaacccatttatgcctaagtgggttaaatggccatataatttggaagttgcttagcttttctgagcctcaggttgttcatcactactatctcagctaacatttgagtgtgtgttgttgagtgtttgagcatgtgccaggcactttgttaaacttaatagatggtttagagttgattttaagagtaggacatataggtgttactacttctttttcagaggaagaaactgaaactttagaaattaagtaactcgcctaagatcatccgtctaaaaaagaacatgctagagccagaatttgcactcaggctgattgactctggggctcttgcttcaccgttgtactgcttcatctgtaaaatgaatgggttgagaactagaagatatctaaggtcctttatagctttactgttctatcatttattttcccatttaaagttcaaaattccagattcttgagatagagagcgttattggtctggcttgcatcaggtatctacctctgagtctgccattcaaagagaaggggaagttagtatacctatgttgagaagtgttaccctctcagctggagagctgccctgagagatctgctaccgatggtaatatagcatgatcaaaagttaggaagttaaagtgttaaatcattttaatccatgatttgtcccaaggtgaatttgtatacttagtgtgtttttacaaaccataaatttgtaagatgttttaatgagcttagaataatttgtatgtgttatgttttaaatgaaatttgaatcaaagactgtaaaagaagtctccagtgtccttttaaaaaaaagcaaactcttcacacttattaattttcaaagttgtaagggatgagttttgtttgaccgcgtagaaattatttaaccttcctggcccttagttttctcatttgtgaaatagaattggactgagtgacctttaaagtacctttgactctaaaaattacttgaacctctgaaaccgcatgtctatctactggcatattgtccaggattataattagatgaaaagaactaacaaatgtgacattaaatattgggaagaaattaatgcttaaggtttaactctttaatactgctgagatcctgtcaatttggcttatcgttcttttatgaggatcgattatattcgtcctctatctaatattaatttttcctagagcctagtagagcaatccattctgtgtatgttttggttatgatcatcttgctttcatgaaattttcttcactttactaggcttactcattgctgtaagtattctgaagttcagtagtacttttagtctttaccacttgagtttattttaattttctagtatcatttttctcacttgagtgtgtgtgtaatggtgtgtgtgtgaattttatatatgtatgaaaaagagcatgtgcacgagagagagtagacacttatttccccaacaagactaaatgtcttgagggaaggtatcatgtgtgttttattcagtacccaagacaggcaggatagcaatccaggtacttctgtcactttctgtcttaagtgataaaaagtttgtaatacaggcacttagcatgttgctggtcacttggattgagtttcgttgtattggtaaacaatgcagctctgcatcttcatttagttttaagtagagttgaagtagaaaaacagtaatgggtgtgtagagacagcatgaggaggagaggctgataggaataagccctgaaggagaccaatgcagatggcagaaggtccatcatgattatttgattttaacttaaagttgatcatcgattatttgccttgtctatactatttaaatgggacagagctttaaatttacatattctatcatgcagaaccgcttcttacagggttaacactgtggaggaagatgccagtcacttccagtttctcctcagcagtttcattgtatctgtcttcttttaggttttttgttttactgtaagcagctgttgctataaagtcagaggaatgcagactggagagtcagcctatctgctacctctcttaactcct

SEQ ID NO: 96443 - DNA, 1046 bp, Homo sapiens
ggccaggagttttgagaccagcttgggcaacatagtatggcttcgtgtctacaaaaaataaaaacatcagctgggtggagtggcatgtacctgtagtctcagctacttaggaggctgaaactggaggattccttgagcccgggaattcaaggctgcagtgaactgtgatagcgccactgcacgccagcctggatgacagagtgagactgaggccctgtctcttagaaacaaacaaacaaaaagagagagcgctttcaaacattacaagttaatatgtgtgttttcctccttccttctgttttctggcacagcagttgacaagcaaattgattttaaaaactaaagaccttgaaaattttttgctaagagaactaaatcttcacttaatccgtagagtaataattgggccctgaataattaataaatattgtttttgttcctcagaatgattttttttaggttagatgattagttagttatgggaaagataagttttagtgatgaaaatctatgcagtgggtgttgtacactagagaagtgaatagagacattccagtataccattgaattcttggatgaacacttttgtttggaaactttcaaaagtatggtattgatgagggtagtcatgccatttatttgattcttgagatgtttctcaactggggcactattagcattcaatttgtagttggttgtatgagacggtcactggcaaaacaagtttattacatctatcttctgcccattaatttctggaactttctagttggaataaccccaaaatgcttcctccttcaatttccaagtgaagggtattggcatctgatttgagaattatgatccagggcttcttaacctttttttggtgacatggactcttttggcagtctgttggaactcctcagaatgatgccataaatgcataaaataaggtcagataaatcaattgtattgaaataaagttatcaaaataaacaatttttaatatgtgtactttattagcacattaagtacagaatctacagttggatctagttattgta

SEQ ID NO: 96444 - DNA, 1062 bp, Homo sapiens
tttatatcatgaaggacatgatttgaaccagagtttaaatatcaattcatgtaatagctaattgactataatgtactattgaattagtttttacagattagtcttgaaatgattcctgtatgccagaatgccatgagtttttttttagatgcctgttgttacgctcatatagggaagtgtatgacacccagtagagttattaagagagttgaaacagttttgggatctagtgtagagtcaccttttaggacgggcaaaattgtattataaacagtgcctattgaacgaatttggaagaacagaaactgttacggaggatggactaaagaaacagtgctgcttgattattaatcaagtaatgcatagattttacttaattttggcttaaagtgatgggtcactttctgtaaaagccaagtacttggaagaagattgtttatacattataggtgcttggtcagtaggagtttatttgaaatagcctagccaccttgcaaaattcatcaaggctttcaaaatacctcccacaaaaatttccaaagatataggtcagtgattctcaagctttagcatgcttcagaatcacctagagggcctgttaaaacagagatcagtgggtcttattcctcttagtgtctgattaagtctagaatagggcctgggaatttgcatttttaagaagttcccaggtgatcctggtgctgcttgtccaaggacccaactttgaaaaccagcagtttgagaggtagtattgtagttcttatcttggccacacaccagaatatctaggatgcttttataaagtacacttaaaagctttatcctagatctaccaaccaaatcacaagttaggggtgattctggattcagtagaattgatttgtctaggtagaaaaaagggattggcgtgtgtgcccatgatccatgcctttctgccttaccattttaccacacctttcagggcttctttccttgtggtctaatttattggctttcaaatgtttttttgactatcactcattttgtgtgtgtgtgtgtgtgtgtgtaactgaaataaagtgc

SEQ ID NO: 96445 - DNA, 1052 bp, Homo sapiens
ataaataaaagttgccctttatttactgttaggacattaacacagcacaggaaggtgctgattctgtagagtaataaaacagtacagatggtcgttggaaaggtactcagccacctaagcatatcttgaggtagttaatttctctgtaaactagaaaaatgaaaccccagattgtttacattatattctgtttttggaaatacctactcttccattataacaatatcatgtgtgttcatttgtaaaaaaattcagaatatgcagaaaaagtgtgaagaagaaaacacaaatcccttaaatttccacatctctgagatatctctgtggttgacctttgggtgaatgtacattcttccatactttttttctatgtaatatatttgtatgtgaataggtctatgtgtgtaagagagagaaagagaaagagaggtttgttttttaaaatctatttcagattgaaaaatttcaggaaagaatttctttagctccttttgagccatcacttcagttattggattagctttattcactgtagcctgagacatgggcgttgtaagagaatggcagcttgtattgggtcactggtctaaagggagcttgagaggaagggatagtcattttccaaaacaagagaattttaaatatagatatggtcattaaagaaattcttgtgtgctgagcatcaattcttatttgttattactgtaactagttagtggtctggtgtatatgttgactgtaatctattcagttccatattgagggaaattgacatatcagtcagagtttttttttttttaagtccttaataaaaaatgcttttggtttttgaattaaagttaagtagatttcccccttcaagttaattacctcattttttccttagaacttttgtagtttgttctagtatacactgcgttgtagatcagtatattcattcaagtggatatccagttgtctaaacatcatttaaaaaaataatcttttctccctggtatgagatgctacctccatcctatttgaatttttttttttagctcatttggtgtata

SEQ ID NO: 96446 - DNA, 1039 bp, Homo sapiens
ttactactgtcatttccagtctcgagtgaatatttaagctacattgatgttagtgtcacctttctaagttgatgttgaagaccgtggtcttacttagcattaggaaattgttgatttaaaacaaggttttcgaaaacccaacaattagatatgggaacaaaagagtaaacatttgttgcattatcaagtggtacaagttagcattatacaacttataattaagttttccaaaagttgatttataattcaaatattctagaattatgatgtttaggataacagttttctgcacaagattgttttcacttttatatttctgtttaggatatcagttactcagtccgttaaagccatccactcacacctcttcttcatacccctcacaggcagttaagacagagcaactatgaatgattcagttcttattaatttaaaatttaataacagctgtttttcaggagaaaaaaatctttataatataaaattctaaaaggaatttatagtaaatgggcacttatctgtttaggtgataaatgtctttaaatatagttttacagaaaaaacaaacatcaataatgcgactgcttattttattgatttttagctaaagctgatgtgtttctttgggaggcaaagttaatgaaacttatgtaatgtttctacaagccagtatttagaatattagtgaattggatggatagcatgttctttaggccacgtttttcaaattgtctgtggtgaaagaccagtttttgtgttgttgtttttatttttatttttttgaaacagggtcttgctctgggtcagcccaggtttgagtgcaatggcatgatcatggcttactgtgggcttcatcccctgagctcaagccatcttcctgcctcagcctcctgagtagctgggattacagccatgcttcaccatgcctggctaattttttgactttttttgtagagatgagggtcttgctgtgtggcccaggttggttttgaactctggagttcaagttatcctcctgccttggcctcccaaagtgccg

SEQ ID NO: 96447 - DNA, 1033 bp, Homo sapiens
ctgcaccaggccagaggaccaatttaaaaaaaatttttaatttattgcataccgatacttttgtcaggtacaataaaaatacagaaaaattaaagatatagaaaatacaagttcacacttttaaaattattagtttcagcagataaaattactctgtctgattgctttaaactcctaaatgcttacactgaattttgtgcttctagagaattgcagtctgagtagcactgccttaaactggtggttctcagagtgtagtcccaaatgcacagcatcatcaaacatcacctgggaacttagaaatgccagttgtctggttccatcccaggcctactgaatcagaaattctggtggtttggctcagcagtgtgttgaaacaagacctataggtgattctgaagctgaagcacatgaaactttaataagccattgttagactttttttttttttttccaggctcaggaggtatttccttctaaaatgctgattatctgtgcttttttgagtaggagctggatagcactcttataagtctaaactctcttagagtgccaactatgtaaatgaaagactgaaagacatgattggttataagttaaatctgtcacagattcttagaaaggaaataatatgtgtaactgaggattgatatggttgaaaatatatgtgcttaatgaaaaggaaaattctggtgttttaagataccagtaggatgggccacgttattaacattctgttgatagaattgagaagcctgtcttgctgttccgtagatgaatgaagactttgccaatcaaaactcttcatcgttgtaagacctcagggtcacatagcaactgagtcagacagccccaagttggatgtgtggcaggttgtttcagtacaaaataaaaggaactagcacactgttatgtttcaaaccagtggagattgaaatgggatctttacagagattgtctggaatctgttttttcacttcagtgtcctgttgtttgtaactagtatatagaattacagtagatttttttgtgt

SEQ ID NO: 96448 - DNA, 1020 bp, Homo sapiens
atttctttctaggtcttcctacctctgccttttatgttcttagttttggagattttcagatttcaggtgatttttaaaatttttcgtatccctaaatgctacttttgagtatattaggtttggagcatttttcttgaacatttcttttttctcccctccccagagtgagagttgttcatcagtagagatatagctgaatcttgtcttctcgttttaagataattgaatagatttattacattttcttctgttcatttttttagatttgaggtattcacaacattcttagtttaatggtaccctcttctatctgtataaaatgatgggctttcaacaagtaggcaaggaagtgcttttttcattctaactctttctagctggtgttcataaatccctatcatctctgattttctgtgggtcagatgggcccagtatctatcctctctcctgctcttttcaattttagtttcccagaattttacggcactcttgtgctgatggcctatctcattgtttttgtcattgtggttttatacgttttttagtccattactaataagcttacattataaggtggtagagtatataagtataggcattcagtcagctatctttagttgggagttttaaaatagcaatgaataatctttggctatgtgtgtagcctaattcagtggataaatcctgaaagccaggaagttggggcatgaacttggtaagatggaaaagcgccagacaaggattcaaatttcattcttgctgatttctaccagtgtggccatagaaccttagttcattcgtccccaaaagaaaaacaacaacaacaataacatactacttctctgcatcttggtactcattgtgtatgactaaaagtcatgaattacttagtttttttttttttaaagtctgctttatttaccatgtaatttcatgttttcaggggaaaataaaaagtagaaagtgtataatgtctttacagaaactcagaaaaatgctcaagcgtaattatagtaggtt

SEQ ID NO: 96449 - DNA, 1095 bp, Homo sapiens
ctatctcccaggctggagtgccgtgttgcagtcacagctcactgcagcctcccattcctgcgctcaagtgatcctcctgactcagcctccaaaataactaggaccactgatgtgagccaccacatccagctaatttttatttttttaatagagaatcatagtctcaccatgttgcccagggtggtctcgatctcctaagctgaagcgatcctcctgtcttgcctcccaaagtgttgggattatagacataagccactgcgcctggcaaaagtttttactactaatagattctaactaaatttgtagtaatacttgaatgggaaaatgtatttggtgttccaacttgggattctgccctattaagaaaaacatatttctgcctggcactggaagcccttttctcaagcccctttttttttttttttaaatgtttctggacctttgttcattttggacataatgttttctctgcctcgcttatttatttcttcttttgccctgctaaatccctattgatcctaaaagtcaatagtttagattttactttctttgggcatctttccctaaccttccaagatgagtggtttgactagttgagattggacatgcttgtgaagttcaaacatgattgcatacttcattatctctctctgactaggtgagtttcttaatggcagagactgtttctcattcaacagttctcaataacaggataatatccggtgtttaataggtgttctcaagtgtatagaaatgatgcctactgataaataatttttaattcatgcattgtagcatattcagccatctagtttcgtttactctagtgcacttctatatcttgaggccggatatttatttcgtttggaggttgataaatgttcacttagaaagcctctgtggtgcttaaggaccctgaaatatttgttgagccaacttggtcactataaacatagaatgaagttgacagagaaattgatggcattgaggtaagatgagtcatagattctagacctgagtgaagaaataagagctataagggaatctgatgaagaaaatggaaaggtcaagaagctggagattttcatgaatttg

SEQ ID NO: 96450 - DNA, 1001 bp, Homo sapiens
aataaataaatgagtgaaagaattaatgaaattaaaagcatatactccatggcattttcgagccatcagtatttgttggactaaaaattgtacacagaatcaaatataaggctaaaattattagtgcatacagtgaaattgagcaacccgctgtgttagaaattaaaaggtgagttctgttattcaccaactgttaatttagcccaaaaagtgccgagaaggagttgggagtggactccaatctgttatgaaagtgagacaaacattcttgttccttctgatccctttcagtagcagttcttcatagtcacccttaatcagctttatgcagaatttattgaatcataacacattgagctgtctttaccaggtgggaagcatcctgaaggcacaaagtctttgatgacctaagatagtaaaacacttcagttgtgtgccacatgcagaaaaaaacactacctactttcattaagttacatttactttgggttcctcaacccaaatgttataattttcattcctcttggagttcaataattttattaaattcagtacccaaacttttctctttaaggaaacaactttgtttacatttcaatagtatctttatttgatctcctattacctgttttatttaatatgataacattttacagttgatactaaatatcttggaattgtagaacacgaaggaacttaacattctcctccccccgcccaaaccctggtgacggaatcttgctctgttgcccaggctggagtgcagtggtgcaatatctgctcaccacaaccttcctcaccgcccccaccaggtttaagcaattcctctgcctcagcctccagagtagctgggatcacgggtgcgtgccaccacgcccggctaatttttgtatttttagtagagatagggtttcaccatgttggccaggcttatcttggactcctggcctcatgatccgtgatctgcccaccttggcctcctaaagtgttgggattacagg

SEQ ID NO: 96451 - DNA, 1935 bp, Homo sapiens
tgttgtcaagtctacattggaaaagagaaaaagttacacttaccaacataaagtggacctgtgtataccactaggtttttcagcatggttaaaatagatgctggcctgacatccaacttcagtctcattatccttggaaatgtcttttgatattctctgcattatgcaaaaaatgataattgacctgttctttcagggcaaacatattttgattggaaagagttggggaggattcagaacaaatgaagagcattgttttgtttatacagtaagacttattggtagaaaggatgcattccaggaacatcattttcttgtaaaaaaaatactattggatgtgtattaagaaattggacataaattctgtgaaaggacatcacatattcaaataaataaagactggtaaaacaatgccatgggtacagaagcagattttgtcagatttgtggagaacacattacaggtgaagctggatctcaatttcaggtgattagaagggacagggaataaggccagcccctgagggcaacccacattcagatcagctagctctaaggatattcctctctcctcagattgtgcactagctgcaaccgtgtcctattcttgggcaaagctgtgagtgtggacatgggctgaaatggtagagttgtatctgggtaggtactaatccaggaaggaggagaagcctccaaacctagaagataatagatatgaaaggaggccaggcacagtggctcacacctgttatcccagcactttgggaggccagtgtgggaggatcacttgagtccagaagttgaaaactagtttggacaacacagtgagaccttgtcactacaggagaaaaaaaaggtaatgccagacattgtgtgaaaagcaaactaatcattgggtagtctgagataaatgaaagagaagcctgagtttaaaggagaacgccccttcaggctatgtgcatttatttatgtccacttttcaaaaaagaaaaaaaggcatttgcagtgacttagagtaaaatacaatgcaataaattaaagaccatggttaaagaaatcagggagagaataaagacactataataaggtaaatttgatgtatagtggcacatattttagccatgatgtgattacaaaatataaaagcagtattggtcataaagggtgcatgattcttggtcttcaagcattttgaaccctcctatggggcctcccaaagaagataccctgaggtaactcagcagaactgattgtgttaggaggagttaccaaagataggccttcagcatattcacctagcaactaatatctccataaatgattctccaatgatgccacactcccctgagagcaccttacagcatcttgtttcccctaccttaagagactaaaggaaatttgccttctcatcttactcagtaacataattccatgggctgtctacctacaaaaatattttctcatatgtttatttcttgaaaattttaaagaagtctaaacttttccttccacagttatgggtaaaagatagtaaaataacatttactgacctctgtatttacatcctgttatggtttgcatacattttttgtatgctaagccaattattgctcaaaggagccttctggacagataatgtatttctcccattttaaacctaagattaaagagcccagggtgatgcagctagcaagtagtagagtcagaattctaatccaggccatctggctccagagtgtgcctgtttaactgttttatactgcctcttagtcatggttcatcattacaagttgcaaatatttctacactttaaacgtagaaattcattaccattcaaagggggttggtaatagaatcagtaatggattcttttttttttttcaatggataaattgcagggtagaggcaggttgcttgctgatagaaaaggcagacg

SEQ ID NO: 96452 - DNA, 1033 bp, Homo sapiens
tcatatataaagcaaaattttattttttcttccactgtgcagtaagtctctgaaattaattgtggataccttctcctgagctcccctttagtcagtgcactgtaatttagaggtagtctgcagtcaaatatgatgaacaatgtataatttcataatttctcctgagtttgaagaatttttctttcttttctagcttttaatctagacaacgagcaaccagattatgatatggattcagaagatgagactttattaaatagacttaacagaaagatggaaattaagcctttgcaatttgaaattatgattgacagacttgaaaaagccagttctaatcaggtactgtaccatgtaaagatgtctcttatcttctagttaacccaatttgcacctttataagacctgagtgtgttgcattttactgtttcttggatttcttttcctgacatcctggaatttctgtttacaatgttccgtgagtggagagtacttaagcacaatttctttgaataagagtatgaagagtactgttctgactgttttcctgtttggataaaaataatactagtcacaatgttataatattttattgatcctttccatatgactagtattggtgcttccataactaaatttgcttgcttggatctttaaggcagtcatcttatgtcaaatcttgctcagatattaaggtactcatcattttaaatggattttaattttaattacttatacattatttcagttcagtgagggaaaaattatttacaaaagaatattctttagtgaggtattttatatatggcacaggtaatttaaaatggcactgtctttctggaaagcagttaagcagtgtaagtcaggagcctaaaaatatttatgcactttgatttaataatctcatcttttggaattgttcacaagaaaaataattagaaaaaatgtcagtgatttttgagcaagaatgttcagaataaataagatgtctctgaggtagactataacacaggcattaaaatcatgattttgaagg

SEQ ID NO: 96453 - DNA, 1047 bp, Homo sapiens
attctgttcttggttttcttatcctacatatttttgtgtaatatcagctcagtgagtatttttatagatataataatgtattacctttggccttgacctctttctcaaactccaggatttttttcccccttttggttttgcctattaacatcttcacctggatggtccacagtcccctcaagtttatccttttgggaactgaacttactgtcttaccctatgtaatcttgtaatccttatctcttcagtaactcccaaactcagatccatccattttttatccctttccttcattgataactaattcacttcagggtttgtcaggttttatcaaagcactgaatgaaggaaagggatttgacaaacccatgaattgaatgttatcaaattgtttgatttagtatcttctttccagtgtgacagacaactaattgcagtacctaacctgagactgaatcttgtagtggatgggagtagggggatgctatgaagattatttttgagtcaattgacaatattggaatatagagagtagattacataatattttcaatgttaaatttactaaagttgaaggctgtgattatgaaagaaaatatccctattcttaagaaatatacacttaagtatctaggagtaaagagccatgatatgtgtaacttcccaccctcaaaaggatcagaaaaaaaattgtatacacacacacacacaattagagcttaaatgcacacaaatgttaaagcaaatacaaaagctaacaatacatgagtcttggtgtaaatggatatacagtgttctttgaaatgttttattcttgtaagttttctaaatatttgagattaaagttaatttttaaaaatcacaagccatcttaaatggcattctctttcataggattttctctaaaataaataataaaacactttccaagaaatgtgtttttaatttttcttttgaaaaccctcagtgttttaatgtataacccttatctcattcctaaactattgaacacccgatttttagttactgattaaccttctatatacc

SEQ ID NO: 96454 - DNA, 1033 bp, Homo sapiens
gatgttttcatttcagattggcttgccgtaattttgtggcattgtgtaaattaggggtcatttgctaaataagatgtttccagtgttatctatttagaatcataatttcagtgtgttggttttgagctgtggtcattcattcttgaagagtataaggtaaaaagtggtcatttaactctttttgaatttaatgtaaatgcttgttatttggaagcctgcctttggtagtatttaggctgttacacaaataataagccatagatttgaaagaagtaaagttaaaaaagaagttgtgtagcaaagaggtgttcacttatcaaccctgaacacagtataggcagtcccagatggaaatttgtcctactctgccctgtatcttattacagtaatgctcagttccaaagttttcacattgttcccttattaattaatttgtgtttgtcttacctttgttgccatgtcatgagtttctttaggtagcaaattcatcttaaagttttttcccttatcttccccacattctataacccattaatgggctgatggtagttaatttttaataactacctagttgactgttttgtaaattaaattactgcttaactcaatgttttataaattagaatacattaatttttacatataatatattcgtttatgtattcaaaatatatttattgaaattacagattttgttgattaacagactaagtggtccttgtcttcatagagctagtagccatctagaagaaaagcctatatggtaggataatttttttttatctccccatccctgtaagtaaataatgtaaatcaactcagagctatcttggaaataataaatttaccagacttttttgccagttaagtaactggtttctactgctttttagtgaatgaattacgtgctaaatgatggaacatttttatttttaatttttttagagttagggggtctcagtatgctgtccagactggacttgaactcctgagcttaagtgactctcccgagtagctaggactacagttgcat

SEQ ID NO: 96455 - DNA, 3490 bp, Homo sapiens
gaggaattattttatatgtcactggtacaaagaattcaaaattgcataatgttgaaacttctggaaacatgctaagtttgtttttataatcaattccgaaagaggtatattatagtaaattgcaatatattagagaatattcatcttttattttggacgcacataaaaagaaacccccatacctcctactttgtgtaggggaacaaacaagctattagacttgaaaactgatagatcctcaaatgtgtataatatcagagttttgaaagatcttggatgtcttctagtccaagacttgcctgaggcatatatttattatagtcttcccaaatatcattgatccagccttcttaaatattatcagtggtacaactcactgtctctcagggaaaattactaatttttagataaatctcctaattaatgattccttcattaggttgaattgaattgtgtcttcacttactataatattatctgttagtagttattgaaactggtcgcatttttttctacagccataagctaacttttatttctttttgcaaacattgtagccaatgacattttgtatttttcatttagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaaggtaatgtgcaaattaggtttcattgaaggtagcttaatagtattcaagatcaatctttttttttctaataacttgaataattttaacataatggtagctaatggcattgatgactttctataagaaatcctacttttcgtctgatccgtggtcagacacattatccattgcgccactggcccaccacaagaaatcctacttttcagtagcttctattggccagttgtttacgctgtttatctgctacctatgccttttataaatttactgatcataccattttatgcttgcagttgaagtgataagaggaatttagtgtccttatgcaccttggaagttttgatctcttcagtaaactaaatattctatcacagatctcctgtgtttgggaagctgataacttgaaatactactactattccttgttgctcgcttgagactttacagttccttggaaaccatattgtagttcttccaagtgaaaatggaccttgctgcctctggctgctacaaggtcgtgggaagtagggaagggttcattttcaaccctcttctgcaaacagtcagaagtaagagtggaatctttctccttttctgagttgtcagttgtgttcgatttcaaattgatgagcttgttcccatctggctttcagaagcagtatgaagcagaattttaagtaagagaaacaggatctcatactgttaaatgatatggtatagaggaaagcactgttctggaggagtattcactgtcttccatttctcataattaacagttaacaccacacacagtagtaccttctctaacattgcaaagtatcaggaacgtataaatgtaaaataaggaattataattggaggcaaagcattttctgtggattctcctaacattgaaagcttgtccttgtcagctgttaatataacagctgtgaagcatgacagctgccaaggatagtatattttaggaaaaactctcttcctggttaataaccagaatttctataattcttgaggatgtgatttttttaaacattagaggatggatttcccaagtgtagatgacattccctaacccagacttgagtttttaatttggcattctggttcttagctaagggaatctacaatattttatgaagatttggcacttttctaagactgaaacaagataagttcataaatatattaagactttataaatgtggactattggacatgaggaaagagaggtttatctaaatcattaaaaaaaaaccctgaactatcaatcgctttttgaaagcagtatacaggcgtgagaagtagggaagggttcattttcaacccttaaatatgtcatatatatgttgcataacatttcggtcactgacgggctgcatatatgatggtgatcccctaaaattataatactgtacttttactgtaccttttctatgtttagatatgttagatacacaagtacttaccttatgttagagttgcctacagtattcagtacagtaacacactgtacaggtttgtagcctagcagcaataggctataccttctaggtttatgtaagtacactgtgacatttgtgcaacaaagaaattgcctaacaacacatttctcagatctttatttgttcgattatttctttaagagactggatcttactgtattgcccagactgttcttgaactcctgggctcaagctgtcctcccgccttggcctcccaaagtgctgggattacaggtgtgagccaccacatccaacctctcagatcttatctgtgtcattaagcaatgcatgactgtaattaatttcagatatattgcaaaacagaccattagcaatgccttttgaaggaaattattggacttcctttagtgaatgggtatggaatacttaagattagcagtatttattggcatattgacaatattttctgagtgttaaaatatgttttctgcttcttttgttctaaccattagagaattgctagtaactgattcttgtgtttaggcatttcttcattttgtgatcactaatacaggttttcctgacactctgattcctaccctttctcttgtttgttatttttccattttcctctgcaaagaggtacactttcttttctgatgctctttactttttattcctttctgttttcagttgtgggaccaaagacgattccctatcatgctcaccattgctagttagaaatgtttatgtgatttgaaacgagaaaaatgggaaagcactcaaataatgaatactccctaggtgttcaggaggtggcaagcattgggttatgcaaaaatgaatacaactaacaaaggctctctgttttctgtttgtgcaaagtcaaaaacacttgtgtagttgatgcaaagggtaaaaggtcttctgaaatatttgtttggctgtctggaatttaattttaagtcgctgaactaatatttaattaaggagcatgtgaatacttcagggcattcttaaatgagatagtcttaaggcaccagcatgtcttaatgcactgattgggaaatcctagatcagcatatgcatttaatatatttaaccacatagattcaactcttagtgtctgtgccttctctcttccctctgtgaggcccagaagaagtaagatagttaagagaggaaattcccagcgtagtggttgtcagttctagctgctctacataacagtcacc

SEQ ID NO: 96456 - DNA, 1186 bp, Homo sapiens
agacttagcacttcatgtttagaagcaatcaagcaataccaatgccatctagacttaacctgaaagaactaatccattaaaaacaatgatttttaactatagaaaatttttgctagtcattgaatgttttggggaattcagtacttatgatatgtaatatagaagtgatttactgtttgtgatcagatttacattttagagtattacaaacattgatctattgacttttgataacttctaaatggaatgcctcttttgtctaggtattgtccccagtatcagaaccggaagaagaaaatgatcctgatggtccctgtgctttcagaaggcgggcaggatgccagtattatgctgtaagaacttttgtgtgtgtgtggtgtttttgtgaactggaattaacaggtaacccatgtcaagatgacttagtcttgatctaaaaatgggaaatgcatcagtactttttatttaacatcctttatgtggatactggtaaaagatgctaaaaggtactgagtcctttcaaagggcgtcggaatcctcttcttggaaattgataattcctcacattttagaaatttaggttcattttgggctctaattatagcttcagcagctgtgaaaattactcagtgtgtcattactagaattaggtaaacccagaatttgtaagttggttctagaacctttgatggctgctaggtgtttattgaaatttattgttatgcaagcccatcttgtgcatacataccagtaagtatcaaacaaaataataattttgtttgatacttccataatggcaatgttttgtctaataattgtattcataactttttgacacacctagaagttgctttatgctatgaagtcgcattatatcactctccaaggttctcaatgagatataatgtagcattgtgaggatggctttgactttcttatatggcttgtagagatcatttatcttgctatataatggtaagcatacactgacagcttttttagagtgtgtaaatttaggagaggtggagatttgtttactagttatgttgatgagagaagggaaaattcttaacgaaaggggacagacagcatgataaaatgatgaagggaatgggaaggcagggaacagcttgtttgtttctttatatttatttatttacttatttatttcttttagagacagggt

SEQ ID NO: 96457 - DNA, 1052 bp, Homo sapiens
tgaagccccacttttacagttttatatctagattttaattgttctgctaatgttgcagttacttcatgtttatcatgatctaacctgtcttcatttcagatttactccatgagttttttgttttttgttttttctttctttgcagcctcgtttggaccaagctaaccattcatgtgaaaattcagaattggcagatttggataagttgaggtataggcattgccttacaacacttacagtcccaagaagatgtataggatttgcaaggaggcgaattggcagaggtggaaggtgaagtatttgttttcacctggtttttgtttgctatctggaacagaagacaaagagaacatgttcagctctctcagttaatatttggttttattttgcttttcagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcaggtaagctgttgctgtgttaaaagtatatcctgctattcttttttacttaattttattgggaaaggaattttatcttaacctacttaattttttttccaacctaagaaacaaaattgttctgttctgtctcacattttaaccaaattgtcctaactagtactgtaaaaccactgacatctgtttcgggtgtgtgcctggtacggtaaatgtaggcagaatgcatacagagttccctgtggccacactgcttataagctgccaccagatcatcacagcacagtactatctgctgcttatgttaaaggtagttt

SEQ ID NO: 96458 - DNA, 1083 bp, Homo sapiens
cagaaagtgtatatatgttgtatatattgttatatcatcaatacaacatatgtattggtccaaaatataacttaatatgacttaaatagttccattataatcacctctataatcctatgacactaccatacaacataaaataagcatttaaactgttatcttaggcgtgcatgtacttctcagggaatttaagtcacaagtaatcagtgttaacatcatagacaacaagtttttttgtattcttacctttaccttaccattagaaaaaaataatctttttggtctgtgtgatttttcctatctaaaattttttaatatcctcaatacagtaccatttctttcttcccttaaaaaattttaaggcttaagcaacaagtaaggtacattagaattcagtgttttgaaataagatctatcttatttaataatttattcttagagtaaaagattttgtttgaactcattcttcttcactgactgtgacccctctagtcactgggaccacaagattttttgttttcaacagatgtcttttgttttaaaataataggcatggcaatataaatacataatgaaaaaagttttttaacagcattttttaaaataattgaaaccataatttaatgatttatatcagttacattcattatatagatttcttagttctggttagataattttaagtgaattcagttacagttccatgaatgtggataggaatttcctcatctacctaaatagaaggatgagggagttttagaaagctatatttttacttttgatggatatatacaaaagaatgggatcctcatgtgtttggtttttctaatccatgcgtcttgaacactttttccttctgcttgttcttagtgggcttggtcatgagagcacagttgtttttaagagtaataagacaaaaaataaaggaacaagactaacacaggattatacttttccctagcagagaataacactgagctaaacagattattagtactgaattgtccatttcacagctgggaaatcccagcaaatgaagcgtttaatgagaaatagaaacataatgcactttatttatatcac

SEQ ID NO: 96459 - DNA, 1057 bp, Homo sapiens
ctttgagaaaagtggtttctgtaacttagctgattttttcaacaaaagttgtagatgtcttgttttcatttgaaacacacttttaacacagttggtcgcagtagaatttactacatctgaggatacatagtatcttcagttttctgaatacttgtctgatttctagcccatatttttatagatggatttactttaggcgttgaatctattggcttaaactatggtttgtggttatgttagatgaatgttgttctctactttgatttgtaatcagagaataaagtattttcacttcagtgttttatgaaaccagcagtaaaaatcatttatagtcttgcagatggtcctgctttcttattaaggctataacttagtcatcattattattaacatgaataaatcaaagtttttttcattacatgctctccataatatagagaattaagagtggtctcaaagatactaagtctgaataaatggtaaaatactcatgttagaactgtattattcaacaaaaactacatttaggcacttttcttagcatgtgatggagattataaatacaagcatacaccacacttgctggaagatttgccattttcattagattattttctgatattccatattgtaatttgtaattgctttcatcttaattgtggaataagtttatatcatattctgcttgtgttattaaaaatcttttaaaacgtactcatttccaaaattcatgttctttaccagtaacagggggtatcacagaagagcagtttcagacacatcagcagcagttagttcagatgcaaaggcagcaacttgcccagcttcagcagaaacagcaatctcagcattcctcgcaacagacacatccaaaagcacaggtaaactgctcttttcgtcatagttacgtttgtttctttcatcattatgtagttttattccattttagtcaagtcacagaagataatcttggttttgccactcttgatttggggtctgtaacctgaatttcttttcagttaatgtacgtaattttaagtgactagcttataaacta

SEQ ID NO: 96460 - DNA, 2083 bp, Homo sapiens
aatacaaggagaacaatgaatcagaaaaaaattgatttgcataggttaataaatacatgatcttaagcctatagaattaaactctaatggaaagtaatttcagtaatattgtgctcctaatgattattctttttgagtgtcatatgcttcatctctcgagaaaaaaaaaagaaaaacttggtttgtcctgtgatacatatttcataagtaatttctcattggcttctactgaaatgccatgttaaattattatctttcctaagtaaatagccataataaaaaaattaggaattaatggaatttctgagctgaagaaaagtttttctcattcctatctagaaatggcaaaaatgggaattgttcttgtgaagtcatgtttagttgtaattatgtaacaatgtttttgtaaaatactaaatggtaacgtcatgttctagagagtattgatatttattttatcctttgccttattaccatagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaat

SEQ ID NO: 96461 - DNA, 1041 bp, Homo sapiens
agtgacaaatatttgttttcactttattaaattgaagaatagtctatttctgcactggacagcactgctctcttagttttctcaggaaattagtgttggtactcggagtccagtaagctttcagaatctttggagaatgtgtttctttggaatgggtggaggtggttaatttttttaaaaaaataacaaaacgggtaactctcacgtggtaggatattcttaattcagcacagataaaaacatttttgattgtatttttcttatttctctaccttcataaagagagtacacgcccttcctttcccaataattcaagatcatttttatgatgtagctctaagtatatttgaggatttgttttcttttgcaaaagaccaagggaaaaactaaaaaatttatagggcacattttaaaactatatatataacacacacacacgtatattctggctttttaaaaaacaggaatgtatttgcaactgtgctaggtgtttttttttttattactaaggttgttttaggggggaaggtagggggagaacaaggaggaccaacattacagaaacttccctagtatgtactgctgtatttgagtatgatgctacacttttcaacaaattttgttgatcaacaatatacttgtgactgatgtgttttattgtctcttaactgacttggcaaacttccaaattttaaaaggtaagaatatctgaagggattatgaatattacatcctgtaagataagagatgtttttcatcactgacagcagcatcataatagctaacatcatggagcatggaacattctctcttaatgacttactcatttactcctaacaacaattctgtttagtaatattatttttcccattttaaagatcaggaagatgaagtttagagaagttaggtaactcactctatgtcacatagctgttaagttactaaggaattaaactttggagtcaccacacttctaaccacactgccttctacctttaacatgaaagaagccctcctcaaagaagtatttattctatttct

SEQ ID NO: 96462 - DNA, 1043 bp, Homo sapiens
ttaaagaaaaacttttgaagggagatggagttggaggaaaagtgcaaataaaaaacaaaccccggtgatttatgcctttagcatctttggctgcagggtatgttcttaagagctgcagatcactaatagtattttagaagcattttatttgaagatgttcgttacacaattctgtattgacacatggtgggactcttcctttgtcaggcttagtcttttactggtctctcccatttccaggtcttattttgccaagcagtcggcttcaattctctgaggagattatatcatagtttttctctgaacaacctgtctggcacctcactcctaagagattattgattttcacctgggaatctgggcacataacaactccatcgatattagaaactttggatagtcatgggggaagggacttttgttccccttttacagccacctcttgtcccatagtcagggacaaatgccaatctggtcagtatccaaacctcttccagtcctggttcctggtgggcaggatcccgagtgaggctgtcagttccttcctgcatctgccctctgtgacaggctgacctctgtagggtctggtttcctgggatggcttccagggccgacttttttctctcctctctgaatgctgctgaggggataagttcagctggctccacagattcaggcccaactgggctggtcttaagatttagaataggttaggctgcaggatgttgggtgggaaggtaaggaaatgggaagactccacataagcctcctcacctgggtctttggccaggttccgtattgggatgacaggtttgggtgacctacctaggtggtgcttggatacctggagtatcactattcttgtgtagatcagacttgcccacccagcatggaagaggctgttaggggaggcttctggcactgggtccctggtactaatgtcatcatgatagcatcaaatccctctaactactaattgtttgtttatatgatatttgttgtaaagtagactttagaagggaaggaagtagttagctgttcca

SEQ ID NO: 96463 - DNA, 1058 bp, Homo sapiens
tcttcgagtgccattcccatctatctgtggctgtaaatttgttctcaccctagaaactcacagtgaggtatttccatttctctttagtcacttccttcttggaattatcccacttggagtgtgagctcctctcaggtcagggtttgcttgatttattttcatattctcaacacatgattccgaatgggtacacataatacatgataaaatgaatgaatgaatgaatgaatgaatatttcttgtggcacttacattctcattttcatgattatttttagtctcattacctccctacatcccattatcgcttccacctgaggactaaagaagctgcctacatattgcttttgtgcaattcaccgtctttggaccaaactgcaaatgcaggcatttcttaggggagcacaattcatttatcttaccttcaagcaactcactgtttagtagaggagacagatggatagaagtgcacacacacacaccccaccacacacacatacacacactgggaatacagtaccactgacaagtgattgaatagtactaaaggattatggagcatgaaacacctttaagggtggggcaaagtggttttgcagtggtttcatagtagtttgcaaagtggtttcattttccacagaatgaaaatagttttgtattgaatatccaaactccattatcttctatctagttatccagttggcagtgccaaaaggaaagaaattagagattcactaagtacagaaaatgattgccttgaaatgatttctccttctaccaaaatatagaagccacatgtacaaaacacttttctctttttgcaacttgctagtcataaaattattttaatgtgaactaaaagctggcatcataaagaaagtaaggtccaagaagttctaaattgaagacattagtataaatggaccacacttaaaattctattgatagtcctcagctctgaaagggaaatgtctgtaatttacctaaattgccttgaaatgaaaagaaataagagacttccttccttggatgtctgtttcctggtgttttccttataa

SEQ ID NO: 96464 - DNA, 1036 bp, Homo sapiens
cctgactctgtggctcaggggcagtcaaagtggttagcgacccgggacatacccgggacagtcaactggggccgcccagcaggctgtccagagtaaaagcaattcccagtcattggggtcatctggagatctatgttagagtctccagactgggagcccctgctgtagtcctcgggctgttcctgtctcaaatctgtccagccactcggttgcttttgtcactatttatgtgaaaagttttggctagcctggattttcttttgtttcagcattgcccacaaacaccaatgtggaattaatctggaaaaggcatcccaatctttaccagagttgaaagttgaccttttcaggcagctcatatgattacttttagaagcactgtcaacatgcattttccaaagaaatgcatcagagacagactaggtaggtgagtcctgcctccctcccagcaagatcccacagtctgcacattctttatctctgtcttcacctgccaggctgagggtgaaggccttttcttctaccattagggatgatggagaacagctctctccgtttatttaaaaaatatcctgaatatgctttaattaatcactctcaaagatttctctcctccagacaaaataaacctaggttcatccactcttgtttgttatttctaaccctttggtcaccttaaagggccaccctgaccttagcgtagtaggagaggggttatggacatgggctcttgttctatcccattcttactgggtggccttgtgcaagtcatgtggccactgcagcctcagtttctccagtattacctacaccatggggtcatccgaggattcagtgagacagtttctctagcatgctccccattgtacctgcttttagcagccagtaaatactctctgttactctcattccccactttgcacttagaatcagtcataactgtttagtgaggtactgattagcactgctaatattctgaatgcttgcttaaaatagaaaagagttactttctatgagactttgcattttttaaagc

SEQ ID NO: 96465 - DNA, 1048 bp, Homo sapiens
acgtgttcccatgttggcagcgccatcatgagactcagcgtaactgggagaggtttgtcgagcggcagtttgaccggatggtactgcactgtgccaggaagccccaccagggcggtgtaccccagagagaaggctcagtgctatccttgttatcttccatttggcgcaagagatcctccattctaccttctgtgaaatggctttttcacctcccatccagtgaagaaggtttgttttttttttcttcagacttgacttggcagaaaacttgatctgctgaaataaccatggcagcaatttctgctccttcctctgagtgcagagaacccggagctctctcctgtttacagcttaccttctctcatgctataggtcaaggcagaagccattctgacgggaaatcacagcattccttaccgctcattattgtgatagcttgttagagccagaactattcaacctttgactttacagagaggaagaggcttagaaaatataggtaaattgatcaaggtctcaaagcaggtgaggggccagtttctggactagaaccagttgcctgacttttcctcctaccccctgtaggtaagggtacacagcaatcaaaggcgaaagagcttgggggtgggagagaaaggagttcactgtattttgatctgaaatgaaaatcacatacacataagaaccttatttttgaggcacaggttccattattctctttaacagaagtaacacttctgtcttctttatgcctgttagccaggcaatgattctgaatttcttcattatcactcgggcagtttgccttctcagaatgttcttttgtagctgtctgtgatcttgacagtgtctgtgtgtccacacagtgggaattttggcagaaaggaaagaattctagcctggtttcccgcaggaaggcttacaagattcattcttgtgtgttgcctttgttccttctcaatacgtgaagtggttggcattgccttggcaactccattagaagccagtggctgctttgtggacatttgtttcattgcagattctcctg

SEQ ID NO: 96466 - DNA, 1047 bp, Homo sapiens
ggcacagggtgcagagtggcattatgggagatgaggctgggacatttaggctggagcaatttgatggcaatggatggactttatcctgcagacaatgtggacccaatgaagagtgttaagcttaggatgacattatcagatctgttttgttattatcttatatatgactctgaagaaaaaaaatatttttagctgtgacttatcaggcactgtctatatacttgacatatgttgttgcattttaaatcataacaactttctgaagggtgagcattattttcctcattgtacagaagaggaatttgaggctcagagaagtgaagtaacttggccaggttggttcgggggccatggactgggactcaagcctgggcttgtcagactgactgactgatattcttctgtactcccctgcccccctttcctggtgggcacacagctagcatttgatgacaattattttatgagtggtccctgttctgtcaggccatatggactattatctaagcattgcaaaagacagggctaggaatggtgtgggaggagggtagagaagaggggacagggatggtggctcctacaccttgtgatggccctggtggcctgccagtgatgaggtgcgtttccattctgaagatgcagcatgcccttgcctgggcacagggactgccctttaggctggccagccggcatgcgggctggcctcaggtagtcagcaggaccgcctcatcatcctctgattatggcctacctgagtggtttggtgactggtgaggatggcctgtcagccaccatcaccagaaaccctacaggcccccatttcccctggagagtcggtaggaagccccatgcctccgtaggactactgatgggtaggtatgatcacatcctcccccaattctaatctgaagatggcactaactcttttgctttagcaagacctggattcagaactgagcaaatgggaggcaaggagcattttaagtatctactgctatccttcctcctcccctgggagatgagaaggctctgggcacctgcagtgga

SEQ ID NO: 96467 - DNA, 1073 bp, Homo sapiens
gctgtggaattttgtggcttcagtctgttttccaaacaaggcaggtctgcagacaaaattgaacctctttgcctcctcttttccttttttttttttctttaaatcaccaaatcctatagggccttcagagcctgataattcttctaaaggtgaggcccacttgataggtaaggagaggtggtaagcgtggttattataagaaactgcacagaggaagtttggggaattcagcagcagggtaagatgaatccttaatccttccagcttagtgtttttcatttacgatgccctcctgggaatagcactgagacggctgctgcagaatcggtttagcttatgaatcattcctattgaagaggagatttcaaaggcacgaggctaaaatcctcagggctctgatgttctgctcatactgatttcaagtgtggggtacagtgccggggatctcatttctgcggtgttgactctctttcacctgttttgctgaagacaaagtggttcagagactgcacagattaaaggaagcatgaggtttatttatcacttctttctgactaagcaggtctttcccctgacacctgagtggcatcagcccatcttctcctcctctcacactctactgcagaacgtcttggaaacgccaccctgctatcctcacgctcctgtcccggcccctcgcctttccctctcttactaggcccccgactcttgaccttgagactatagaaaagttgcagttctacatttcctgtgtcccacctagtccagtacctgtagacaaaaactccctcctaggtcagatgacacttgaaagagagatacggtgtctagtgaggaattcaatcagtctagaggtttttttgtttgtttgttttgttttattaccaaactatatataatgccaaacaacaacaacaacaacaacaaaaacaaaagcaacctgcattatttaaaatcccccaaaatctcttggaatgcttacaatagtgaccttttaagctttgggattagaaaatataaggtacttgctaaatgccagaaatttaagctgtaagacatcaagagagagaatg

SEQ ID NO: 96468 - DNA, 1747 bp, Homo sapiens
  misc_feature (1326)..(1747): n is a, c, g, or t
aaattaaaaaccaaaaccaaaaacaaaaactaatagaagagatattttgctagaggctctcaagccctctgtgtcttacagtgtaaacttcacaatgcctgaccagtgaggactcatgggggacctgaaaggaactgggttctggacaggtttcacctccggttgcctcttcatctttgtcagttttaaaaggtcagttgtaatgagttgctttcctttattgtgacttttgcagatcacatacttgtgcctacagttagaaatagttgatgtggatgggagttttttcctagtgccacccaccccctcacttaatcgagttctttctgtagggtaattatagattggagaaaaggtaggggatattttcagaggaagacagagggaaggaggagccctaagctgaagtcatagatactgcgagagaccaagaaatccaggatcctggaatgcaattaagtcaaaaaagccctacagggtctgcattctctgaaaggaggattttatgtattcaaattacacattgtgatcttccaaaggctttcggaaggggatgttaactccctgagtgtccctgagtggaaagagaggtcacattttaaagatgtttttcactttaatccccctatttttggtctgacatccagtggtgattccattaccttgtattgaggggaacaaacagacaagcctacataaaattggaaatattagcttctcaagatggagcatttaaggtaggttttcagtaaatatatgactcactggacagtgttaatgctaagctcggtggacaccaccacacagaaggtcctgggcttgtgcagcccatacccagggttggcgctggggaggacacagggggttccagctccagctgaggaaaaagagactgttcttttgttctgtgagtgatgctgggaagggcctctcctggccccgtgccctcctttgtgatcctcttctgcacactgatatagatggatggagacaccttgtgttttttctttctgccccaagagacgcttggaggtcatctgaatggtacaggcttcccagccgtcccgccaagcctgccaagtgattttgaactaatctgtctgaacgcacggtgctcatgtgctgacgggctgatgtcttaagtgtttcaggaaactctgccctgcttgggaggtcaaggaggcaactggggctggaacaaagagagtcttgtttggtggctggtggcctgggtcttgtttcttctttcatatgtgctcctaaaagatcacattccgtgggaaaagtttgcggatagaattatacaggatgcagttataaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 96469 - DNA, 1045 bp, Homo sapiens
cttaagtctctagggctgaattttacagtctggatttctgtgttgcatttgtacttatgcttacttgttttataaataataagtgggcaaattagttgctgactactttgtattctgaaccggatagtgagaggctaaatcaagaaaaagaggactgactaaggcaatatcgaaaatctgctccttaaatgagtcccacagaggttttaaactttatttctgaacgtcctatttcttaatgccaaacaatgcctatttatttttcttccgcctagtctcacaaagtattttaaatgacaaaacaacaaaatcaccaccctcgcacacacaccaaaagcagaaattaatgaaatcagaatcctgtttctacttacattaaatgtgaatatgattctaattgccagatttgccagtatctagtttgtgacttttttttagatgtaattaattttctctgtaatctatggaaataaggccatatgtttaagatctcaaaaataatagacaagtcttaatgaacatcagacaattctgaaataaatagaatgcgctgaaccagggtggagttggctgcaggaaggactgggttagagatgtccaggattggaggtcagacagacccataaggatgtggggagtgtggcagcatgaaagattagagaaagctgtaggcgtgagtctttcaaatgtcacataagtgtgtccatgagagatgggcctcagggacagggaagtctgacaggtgttcaagtaggcagatgttgctagggatacaggcagccaggagagatgcccagcagtggattccagggctcaagctaggaccccacatctcagagtagctgggatggttccagtcaggtagttccagaccgaggcacattaaggataatggatcagggctgagtcagagctgggaccagtgctgggttagagtctttgcttccccttgactggtccagagctgggatgtagggatgaggttttacctgagtagtcacatcccagctttacaactttacaactgttttcctttctgcccact

SEQ ID NO: 96470 - DNA, 1244 bp, Homo sapiens
acttttatttttccttgctttccaggaggctgtccccctttgccctcgtgtgaatttgaaatttctactttgtgcttctgccgtcctgtgctgctcactgctttcttttctctctggtaggtcagcaaaactggtgccgagggagctgttcttgacgaagctaaaaatatcaataagtctttgtctgctcttggaaatgtgatctctgctttggcagaagggacagtaagtgatcctgcccccatctattaagtaatattatgagaaaccaccttttggggcctcatagtccctttgccacacaccccaaaggctggtttgtttttctgtttggaagaggacagagggaatcctggctatggatgcctgcttgctgggagttcccatctactaaaaagtatgaatggtgatgctaatttcctatgacataggtcaaagaatgggcattctaaactttggcaagatccaaagacccagccacaaattcttgttttactcggtttctaagctcagtgtcttcatccctgacttgcttgcctctgtgtttttctcagaatgggctgtcaaaaccaatactttttcttttcctaaatagaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagaggtacgtgtggtctctcaggacccatcctctgtgctaggtcttgggtcttaagagtgaatggcaaggctgggtgcaatggctcacacctgtaatcccagcactttgggaggccaaggcgggtggattgcctgaggtcaggagtttgagaccagcctggcccacatggtgaaaccctgtctctactaaaaatacaaaaattagccggccgtggtggcatgcgcctgtggtcccagctacttgggaggctgagtcaggagaattgcttgaactcaggaggtggaggttgcagtgagccaagatcataccactgcactccagcctgggcgacagagcgagactgtctcaaaaaaaaaaaaaaagaatagtgagtggcaaggggctattgtcagagaatcacaaagtaagggacaaacagccttttactaaattacatctagcaggtgatatgtaaacttgaggcatcacttattgaagccaaagcaataattatattttaaaat

SEQ ID NO: 96471 - DNA, 1063 bp, Homo sapiens
gtttacctctcccctctgagccccagtcttctctcccacagagagatatataataatgcctactttcaagaatattgggaggattatatgagttgcttcagtttttacctagcacaagggctggcatgagtccaggtaaaaaagtccgtgaccgatggcaggctatcggtgattgcaagttctgcttttccttcgtcttaaataatctcacagtattgcggcttgaaaaggtcatagtagtagatgggactagactgaatataatgcactgtaagggacagcactgtcatataagggagaggattaaataaagtagaattagaattacattttgggaatgaacaaataaaaaatgctgcaggtaatttgggcttccaggaagtaaaaagtaatataaattatgttttcaaatgaaataggtcggtctacattcttttatcagagtcatctagattctgctctctgtgacagcagggactgagtttgtcacagacattagtttctcatcaaccactgcacaactagttcacagtaggtggtcaataaataaatgcttatcaaatgaatgaacagatgaatctaaagcttattgtgtaaggttacttggaaagttagggcagttgctgaacattgatgccattacgtccagaagtttggttgggtttggatctggtttgctttccaaactattattggaaatgtgtgaggtttcgttcctttccctttatccccaagttagttaatggattatttaaggatgctgagctattctatggggccaatacctgctgtattgttaaatatactcattgaacccaattatacagcagacacaagactgaacatcggattagacatggtatgtgatagctaatgagattaagcactttgaactcagaaaagactgccgggcacatcccaaattcattgtaatgagtgttcattatattcttactgcagaggtggccaaaccttagggcagcatgaggttcctccgttattcctttgtggttctttcaaggacgtgaagagagtacacgtttgttctgcttgactgtactga

SEQ ID NO: 96472 - DNA, 1026 bp, Homo sapiens
attggtataagaaactgcagtctccaagaggacagagacctcgtctatctgtcttggtgtaccccaaattcataaatgttaattgaactgaaaagaacctcaacttaggcaggtaaatctggtgatggtatgcagggggcttaaaggagggtactgaacatttgaaaaaggctgtaaccataaggatggctgagaacacagactaagacagtggcagagggaagagagaaagaggaaaccctgagacaattcgaataaatgttcattagatttagagaccagtgggatgtgaaggagaaaaggaaaggatgagcttgaggcctcaagggttagtggtgccgttagtccaattaggaggatggttggtgaaagccacaggatcccttctgcttccctatttccagtcttttgacatgaggaatcttgggcttaatcatattggtttagctaatggtaataattagctgaattgtccccttatgtttttaatcccagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggtaaggaaaagtaaggaggaagagtgaggcatgagtgtgtgctttttttatttttattttttttgagacagagtctctctctgtcactcaggctggagtgcagtggcgtgatcttggctcaccgcaacctctgcctccagggttcaagccattctcctggctcagcctcccgagtagctgggattacaggcgtgcaccaccacacctggctaatttttgtaatttttttttttttttttagtagagatgaggttttaccatgttggccaggctggtcttgaactcctgacctcaagtgatccacccaccttggcctcccaaagtgctgggattataaacgtgagccaccgtgcctggccgtgtgtgtgctttctttttcttg

SEQ ID NO: 96473 - DNA, 1007 bp, Homo sapiens
ttttctgtgccctcttgggtgagatcctacatgagcctttaagttacataatttggggaaaataatgtatgatgatatactctggcacagagtagacctccaataaatgtatgggaagcaaacatatgcttaatgcaggtgctggagattaaagggtgggcagtcagatgtggtctcttccctcaggacggtctgagcggggaggaaggtaaatgccagtcctcaccaataaatgtatgatggtagtccacgctgcataccaagaagtgaaagcacaggtgccaagagttatacaacagggggccctgaccttgactgagaagccagtgaagggttccttgaatatgcaatgtagagattagtatctgtgagaagcgcagttagccaggcaaaatagggggcatgaggtgaggtgggggctccgagaatggaggacataggccagcagggagcactggcctgagatgggctcgagggataggcggggctctcctgtcttcaggattttggtcaagggtgttaagctgcaagtcataccttcgcatttttgaagatccattggctgtattggagagtggactgcaggtcggagaggagggctgggagctggggtggtcttccagggatgagatgatggtattgaagtgacagggtagtaggaagggagagaaatggatgaacctgagagatatttaggaggagaaattagccgggtgtggtgaggggttggctatgggagagggaggtttcaatgacaactgtgttttctggcttgccgagttggatggagggtgagaccattctctaagactggggatgctggaggagaaccaggggtgagggaggagggagtttagggtccccgtggaacatccaggggaacattattcagataagaagttaggtctgagggtctggagctcagaggatctgcttgagttggagtcatcagtcttttggtagtaattgaaggcataggtaggtgtgagggccctttggactacaga

SEQ ID NO: 96474 - DNA, 1867 bp, Homo sapiens
cttctcttgaataattgcctataagattaaaaaacagtggatatagatttaccttatctgctgaagtcatgcaaagaaatgatttcatcacaggctgagaaagtgtggaaaaatcggcagtctctaacgcagatttgttcatccagttcaaaacctgtgaggccagcagacatggttcagtaactagctaaatctgtagcctctagtctgatttggggctttgtggaactttgggaccaccacaattggaacacaatttgctcttttagcattaaatcttcgaagatgctggctcccttcttagatccatgattataatggactctcagaaattagcatttcattggagcgatctaatttactaggccctctgcttgcttttgagaacacaaccaaactctgtaatagaaataccgtctgtctactaagagaatgttgtggcctgttcaggtggtcatgaatgtaaggaggatgcagagtcccaggtgaccagtttattagaaaatcgctctagaagggattagaggatgttttaagctgcttacagtgtttttaggaatgagggtgaaagatgctatttgcatgcaaaataatctcataaaagaatgattttttttttttaacatcacatttatataatgacatcttgtagccagctgctctcacccatctggcaacttaaagatttccttttagtttctttgatacagaaattacctaccattaggtctgccactgggcctatttaattggaattaaaagaaagcacctcgtttgccagatctgctgtggttcctggcggaagctgtgagtaaccagcaaatctctgctctggagttactgagagaatgcaattacctttctgtgttctcctgaggctttaggaactcaacttatgaaaaggataactagcttgttgctatttcatgtgtgaagttttaatgaattactggcagtctaatggttttctttctttaaaaaaaaacccaaaaacctattttagaaattttaatagccctaatgagaatttttgattagtgtgtcattctcatctgttgccgttgatggatttctattttttgtagaaatgttatttacgccctctgggagtttttattttataattagaatgctctgtaagccttataggtatgcttcagtgaatgctcctatgtaaacacaaatctttttagtccttaaaggtaattacatctgacgatagtaaatgccaggatgcttatttaaagaaggggaaggtttccagtgtgtgtgtgtgtgtgtgtgtgtgtgtgtgtgtgtgtgtatgtgtgtggggaggcctttcagatgctttacaatattatgagctcttttcctatagacagcaggtataagcctccggggctaaactaagagaaatctgcttttaatgcaaagagggagactcaaaatagatgctaatcttcctttggtggtctttttctccttctcccaccatcagagttcagggcgttatttctctagggtctgtttgcagctgtcttccttgttagaatcagttattccataatcaccatgtgggggcttctccagagaattggtccactgcagtgcagggaatattctccattaacgtggtgagattgccatggagacagataacctagtgtcaggtcttgcctagtgttgggaatttacaatccccagacgtgtttgtgagctggacagtgtagttaccaggacgcttctggaagtcattttctcggtcctttgaagagtagtggtgttggaaaacctgcccttggttcctctctgggcaggagctgggctgctttagttcctgcgtgttgcggctttgttcttctccgttgaaatggctgctgtaaaa

SEQ ID NO: 96475 - DNA, 1030 bp, Homo sapiens
catctgcctgctgctttgcctgcactgggggtggactgagtctaaggggaggtggggagaggtgggcagcgaatacccttgcttttgtggcagcaacacctagtggcagaaaaagagtgagaagagcgaatttgcctttcccacttcagtgacagcccagaaagtaagcatgaatgcttctgtccctcagctgccctgaggttttttttttttttttttttttttttttaactgttaagaaaattaacttccaatcgagagggaggtcttccaatgccaaatctccagttcatttttctctggtctgagaggtttgaagtggaaacattggctctccctgccgatctggtggcagcactcctgcttactgatgcatttgacaagatttgggataataacatatgacagtgcagctaggtagaaattcactcctttattttttgaattaggaatttcactgttagcatctttgaattgggagggatatctctaacgtccctttcagttcccaaaccgtagatctctgatttctcaatgagcaggaattgggttgaatgtgcaggatattatatttccagaatagtcagctgtttcatctgctgagaaaggtgggtgaggaggtattttaactgaatgagatctcggaatctgtctgttttctgtgcagtaacaccacactattccttccttcttatcagcaagcttatggtagctgcctgtcactgggagactgggatatcaaaaatgacataactaaccaaaaaaacaaacatgatgtttcgtttcaggatgatgaaattaaccagcagagccagctggctgaaaagctgaagcaacagatgttggatcaggatgaggtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatt

SEQ ID NO: 96476 - DNA, 1059 bp, Homo sapiens
aaaaaggtgaagggtgtttaattcagcttcactctgaaaattggaagacttttttttttgaagttgttttctaaacttattaatgttcttctgggccatctattctagacccatctgtctttatcaatttaggtgggaatatggaggtggcccagggagcaggtttgtttaggagtgaaggtggggacccttgcaggtaagtttagaccctgaaatgaaacagataggactgacatagaatatctggtaagtaggaagatgcaattacatgttataaatttaaggacttcctttttggcttaacttatttccctgacttggaaattgtcatctgatatgtagacatataatgtatcaggccatgtgatacaacttgttgataaagagttccccttcttatccaagaatgcagtgctatgcgagagtttgccttaaaaggattcttaggttgaagtcatgtaaaagaaatccattctacatgatggtgttattctttgtaatgtggagtgtatgaaattgatgggcaaccctttgaatttgttgttgaaatttgtttttcagactacattgacaaccacacagagagagctgagccagctacaagagcttagcaaccaccagaagaaaagggcaactgagatcctgaatttgctgttgaaagatctgggggagataggtggaattattggcaccaatgatgtgaaaactgtaagccagcccttcttttatcctctctacctgctcctgtcaagttagtagggtctgtgctttactcttttaagcattcaatgcttagcactgtgctttgcatctgccatgtgctggttagtgtttgaatgaatgaaaaaagggctaattgaatgactgagtgaattgtttgttggggtgaggaggaggagaaaaaaaattatctttcaaatctaggcagtgtcttcaaatgttggttggctttgtgtaaattggtttatttctcaaattggtttatttctcaacttatttcctaatgttgcagaagtttggaattaaatagcttaagcaacagttctagtctcagaattg

SEQ ID NO: 96477 - DNA, 1106 bp, Homo sapiens
aagttttgatttgagtttttataggaattcagcatcacctttcggagcattgggtgtcgctgctgttacagagatgtaaggtgtaagacattgaatggaatacctttttgaagttatctccttttaaaaatcttcagtgtttcttcttatgctgtcatttctctttctaaaaattgatggtaatgaaaaacctagttaattgaggattatatttagtagggggtttcaactgaaagtttcacctgaggtgtaggagaacttggggttgaatgtttagtactttccgcttgtcctttaattaggattctgaaccagaaatccatggacaccttggggatccaggggcaggtttccagggagtccgtgaacctatggaaattgtgggcaacatttgagtgtgtccccttctttgctcagttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccaggtgggcccttcccttccccatcattgcactcttgttgtcttgagatctgctccctccatgcccttgctggtgctgatggtgcaccttaggcttagttgagggactgctttgtgtaagcttggcctccccaggtgatggcagcccaggtctattcctagggctacattttgttgtgtgaaatagatgaattctgttgagtccgttccctttttcgaggatatatctatctacccatccatagatggatggctagctagctaatgaatgtaaaagattgggtggaatctctaaaactcctgtaagtaaggcaatattccctcatcttttaatctctaccataggtccactttaatatggaaaaacagaaactactactaatagtagtagtagcaggtggcattttattgagtgtttactatgtaccatacactgtgctaagtacttcacatgcattttctcacttaatctgaaaaaaatcctggtaggcaggttttattatt

SEQ ID NO: 96478 - DNA, 1099 bp, Homo sapiens
ggtgctgtaagaaagtgttggggcctgagtgataaggagctagccaaggtagtgtgtgtgtgtggcatgtggtggggtggtgatggtggggagggaaagcttccagggagaggaaaatgcaaaggccctgagatgggaattggtgtgtctgaaggacagaaaaagggaagacctaataattgaatggtgaagatggaatccagaggtgcatgttcaatgaatgaggccttcagccctgcacttttcccagcccctttctctcatgcatgcttttctctgagaagggaaaccagctcggcctttggcatctcatgttaactggatggtgaggaggggcctgccatgagtggtgtctgtggggaatgaagccgagaagcacagggagaagcagaggtctgtcttggtatgattctgaacaccaaggcaagggtaaaatgggcaccatttggttgtggcactcagaaaagggactcaggaacccctcctctctcgcattttcctaccagacaattccaggccagcctggatgaccacttgctagtcattcactcttcctttttgcttgtttaaagcacgaagccaagatcaagtctctgacagactacatgcagaacatggaacagaagaggaggcagctagaagagtcccaggactcgctcagcgaagagctggcaaagctccgagcccagggtaaatatttgactaacgtgcaggtgtcaaacacctggcctgagtcagacagcctctggttggctggaatcatgatgtttagtttcgttcagttaaagcatttctaggtctactgcaaacaaaaccataactagaaaaaaaggagcgatttcttttctttctttctttctttttttttttttaagatggagtctcgctctgttgcccaggctgaagtgcggtggcataatctcagttcactgcaacctccgcttcccggttccagcgattctcctgcctcagcctcctgagtagctgggactatagatgcgtgtcaccacacctggctaatttttgtattttttagtagagatggggtttcaccatattggccaggctggtcttgaactcctgacctcgtgatctgtct

SEQ ID NO: 96479 - DNA, 1069 bp, Homo sapiens
ccagcctaaaaggagagatttctgagagaccatccccacactgaatctgctcatcttcccatttcctcacagtccacccagttacccaaatcagaatcccctgctccccacctcctgactctagttggtcaccagagccggtccatttcacctgccagaggcccctctggttcactgtccaggttaactaaggactgtggctacatccatctacccatgcccaccctcagtctgctctgggccagccactgtgtggcatcctgagggatgattctaaaattcacattctctctctgtccaaacggacacttctaacccttccatggcatcctgttgctcttaatataaagtttgaactgccgtggcttccctggcacccccttgaacaagctctaccctttgccagccagccttgtgatctcctgagcttagggaagtgcctcgcacataggaagcacttcataaatattaatgaatataagcagaaattcaagagaagggtctagaaatgcagaaagtagaacaggattaagaatgtatgtgccatgcaatgtgaaactagaacatatatattatgggttgcaatgaaaattgttagaattttctcagaaagccatttgaaaatacatattaataactgtaacatttttcataccttttgatcatcacacctcagatattcattgcagaattttagatcagcaaaaaagaggaagccatctaaatgtctaatagttaatacactatggcgtgttatttaatagaactttttcttcacatgaaatacatgaaggtgtgcagcaatgtttatgatgcaatgttaggtgaaaatcacaatatatcattgtattcttactatggttataactattaaaaatgaatggatgcagctgggcacggtggctcacgcctgtaatcccagcactttgcgaggctgaggcgggcggatcacgaggtcaggagttcgagaccagcctggccaacatggtgaaaccctgtctctactaaaaatacaaaaattagcagggtgtggtggcacacgcctgtaatcccagctactcaggaggct

SEQ ID NO: 96480 - DNA, 1052 bp, Homo sapiens
aatagaggaccaagagagagaaatgaagctggaaaagctcttgtgagtgcactctaaatatttcctctattttctctcatccccatgatattctggttagattgggctaatttaaaaacagacaatggctatttgtgtgcttgttggtgggttttgttgatttatctgtggatgcaaatagtatctgctgaaatctctgagtcccctgtggtggtctatggttcctttttgtttttcagattgctcaacgataaaagggaacaagccagagaagacctcaaagggctggaggagacagtggtatgtcaagatatttcccgatttatgtttgtctccaagaccggattcatttgtgatttgtcggattatttcaaaattttatccatgcacacctttctgtgtaatgttttagataagacattctatggaaaagtaggatttgtagaatttagtcctcaacttttcacagaatcagtcaaccaatccatctatccttagagcagtaacctggagcccctgagtgaggattaagctgaattgcaacttagcaattttacagccctgcactttgtgacatacttccactcaacattcaacagatatttattgagcatctcctaacggctggcattcttcaaggtgcttgaatatatccataaacaacagagataagatccctgtcctcatgaagcttacctttagctgtgggagacgataaacagtaaggaaacaaatcttgcactctatcagattgctatagaatgtgcataggttggtgcctgggggaggctccatgaggatgtgacctttgagcagggactcgaagaaggagaagaactgagcacagagatgtgttggggagagcattccaggcagaggcaacagctcatgccaaggccctgagataagcccgggactgtcctgttgggggccagcagggaggtttgtgtggctgcagctgagggaaggacagggatataaggtgagcacagagaggtaaaggcttcagtgattcaggccaggtaaaaccttgagacctgcagggctttggg

SEQ ID NO: 96481 - DNA, 1052 bp, Homo sapiens
acgtgcgtgcacagtggcgcccggggtttgagaagctactgcggcctctcagctcagatttgctaaaaggtgaagacagcgctggcccactctggaacatctgaaaggctgggttggagcccgcaggacgcagccctcaccgcaccctgtgctcaccctgtgggaatgggaatgtcaggcgcccccgttatcctactctgagatattccagcatacatcgtggtctcaaaacttctgagctgggcagagagaagccagccaaggctgtaggcctaggtcttgggctataaatgggtacactcttagaaatactggaataggaggatatttctctgcaaggtgtgaagggccctgtgttctgcacccggtgggagcatgaaggagcccatatgtagccagagccccagggaaagcctccaagtgcaggtttggaaatacccctggaagagccaggctggcatccatgacagggtgtggctacaggctggcacagaacctggggaggtctggagtctcagcctcttcaagacctgtatggatttgggcattttgcccatgtaggaaatgagggtgtagccagagtcctggttcccaggatagccatagggacaaaaacaatttaggaatattctctaaacagcttcttctccttttttttttttttaaattgaaacatctccaataacatgtaatttatttcccatcagatattgctgtgtagatgtattgcaaaccagcagtttcacgtttctagttttaaatcataccttagaatagtggttcattgcatgtgtaggatttcataccctttgagaatctattaaaagctatggaccctctccccagaaaacagcatcacaggcagaattctgcatccaatttcaggggctacacagatatccttgaaagtcatggggaacctacgatccatttcagatgaaactgaaaatctttttttctaacttttcttggcccaaattagaaatgagctaattgatgtttaagttctttctgtcccctaaatatttggatgccttggatttgctaagtat

SEQ ID NO: 96482 - DNA, 1501 bp, Homo sapiens
tagttttcccattttcagagagatctggtggttgataagaattgtactgttggtaagaattgtgacttttagttgtcacaggtgacctgtagatatcagggttgctgttaagacttttctaaatgtctgttctctcttctttctgttggttggatacagccaagcccatccgccccggacactacccggcctcatctccaacggccgtccatgccattcgagggggaggaggcagctcttcaaattccactcactaccagaaataaatacaaagtgagtcccatgtcaagggtggtttctctatctggaggcagaggcttcttgcctttccaaagcccctgcctggcagtggaccttgagtagagaggagttctgctctactccagcacacaccctgggggttccaggtaaacagagacccagacctgtcctcacttagtccagagccctggggtcttctagctgaggctgtctggggcccatgggacctggagccaggcccggcctaatcccctccaggggtaggggtggtgagtgattcagccgagctttgttttgcctgtgggactcccctctttaattggcatcccaaagggcattacctgtttgtcaactgctttacccacagcagacagaagttgggggttgctttaagtctcaggaacagaatataaagaaagagccagataatagaaagtgatgtttttatgtttactatctgaactcaacaagtggggattttaagaagatatctagatgagtccaggatgcttttttctttgagatggtggtctgcaagcttctctacccacaacccatgtgcacgacatttctctcccagcaaaaagaaaaggaacgagtgatattctttccaaaagagaagaagcagagagcgaaaactgtcatcctgatggaaatggagaaaagaggttactagttgggcgggcagacagatgactaggtgaccagaaaactttgtttagataaactctgactttgaacatgcagatgggaagaggtggctctgaacattgtccttggactctaagcccttgctagggtagctggctcccaaggcaggcaagcatgcaaggtgtgaagcctggacccctcctcatccagtcctttctgcatcaaggcaagaaggtgagcaggaggggctggagccatcactcagggtcccggcatcgcccaggcataggctaaaacttccaagggaaatgctttggtagttgcccccacacaacttttacctgtgctgccccaggcagtgccaacgagcaggccaggggctggtcagagtagtgggaacaggagggaaggcggaggcagcccgcgggcgggcagtgtgcctgccatcatctgccatcttctagacaggaaaatgggaaatggtcttggcggtgggccaccccattcctatctaatctctgcttccaatcagaaatagaatgaaactggaagttagaaagttgcttttgactacatattgtcagtatcg

SEQ ID NO: 96483 - DNA, 1073 bp, Homo sapiens
taatcttacctatttcttttcactttttaatgtagccactagagaatttaaaattaaatatgtggcttggccgggcacggtggcttatacctgtaatcccagcactttgggaggccgaggtgggtggatcacctgaggtcaggaatttgagaccagcctggacaacatggtgaaacaccgtctctactaaaaatacaaaaattagccgggtgtggtggcaaacccttgtaatcccagctacttgggaggctaaggcagaagaatcacttgaacccgagaggcagaggttgcagtgagtcgatatcgcgccactgcaccccagcctgggtgacaagagtgaaactccatctcaaaaacaaacaaacaaaaaatatgtggcttgtgttatatttgtatctgacagctctggtctaaacatctagaattaaacaaaacttttttgaggagtaaatttctactgtgttttctaattcctatgttctctctttggttctctttcaacagatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtat

SEQ ID NO: 96484 - DNA, 1385 bp, Homo sapiens
caacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggca

SEQ ID NO: 96485 - DNA, 1136 bp, Homo sapiens
ttgtttctatagcagaggataggcaaagtacacagaaggtactagactcaactccccatattccccttgcccccaggtcagagtcttcaggggctgtgactctgacaagcgtagtttgtatgttgctctggactctatttcttgtcatggtgagtgaggttcagcttgcaaggggtcagttcaaggctggtagatttaagacctgcctttttgtgacttctgtcaagttttggagcaatcaccgatagttactggcctagttttgtccaccttttcttctcgggggcccttaaccagctgtattactaagaaatgtaattctcaaagtatgctacatctactgctcttcatgatccatttcaccctggagacagtcttctgagcattcttgctcattgtgaaaccacgtcaccatcaaaatactgcacagaagccagatattacatcattggtatcgtgttgaaaacatctcctgcattttgggactatttcactagggtgaaaaacagaaaatgaagtacattaccgaaaaaataggcacggtgtgttttatttgtcttttagtaaggtatgggaaccacagtttttaggcaactacaggaaagttagaacaaagatgagggctgcaagtaacccactgctgtgccagcaccacagaggtggtattagtgttactgagaaatgtgcattatacatttctcctagaatttggagctgggattgtagtttgtctcttgggaagagccagtaggtcaaacaggggacacctctgttttatatttctctttttgccttggcacccaggaagcccggagctacagttgtagtgataattttatttcaagttataagttcaaagatttcctgtcttaatatgatttcaactttttaaaaacaataacttttttcttattacaaagatgatatatattcattataaaagatgtataaaataacatgttcacaccccaaccagatattttcctaccacacagaaatagtcacggtttgcattttaatcttaatcattataatttattctaaacatatatgtatatatttatacatatacatatatattacaaaaatgaaatctctttcacattacaactcatgtttaaaacataacatttatc

SEQ ID NO: 96486 - DNA, 1092 bp, Homo sapiens
tgagcgcgccccgcggagggctccgctccccccgcgcgcgctgattggtcccgcggccctcgaggccgggccggccgcggctgcgggcggcggccagtgcccggcgcgagtgggagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgagtagaggcgggcttcccgggagagcacaaaagaacaggggattggtgccagcggccccggcttaggcggggcctggccaaggcagggagtgcgctgagtccctggaactacccgatgctagggcagtcccctggggccagaggaactggggtcccggcctccggcgttttgcccctagtgggcagagagccccgcgagtagcctggacgggtccagaggggcgtgtgtactcgtgtgtgttgggctggcgcgtggagggtgggatggaaaggtcaggagctgccaagttcaaggctggaggaacctttcccaggagtaattcagcatcttctcacggcccaacatgcgtccaccaggaactccagccggagggagttcctgggcggcggactggcagcaccccacatgttgctgcggggcggggggcagtggcggtagcccggctgcggccacccggagcctctaagggaggtgcagtgtgctggaggtacctccccgccgctgcaagaccacgctaggcctttcagccatccaccccgacaacccagggaagggaccatccacccacagagttgggatttggcctgggcttgacttggcgacctgtttttctctccggtaacagcagttccgttgattcacatttggctaagcgttcagttacaacctaaagctcactatctgacggtctgactcgctctgacccccaccatatcctcactatctctaccgctgccctcctccagtcccctctcccgccccagtatctgccctgctcctcactgcggg

SEQ ID NO: 96487 - DNA, 1626 bp, Homo sapiens
aaataacttaaaagatcatctaaataggaagaaaaataatagaagattaaagtcaaaatggaagattgaagataagtgtacttggaaaaagcaatcccaagaacatttataggagatagttttaaattctgttcccatcagcagatagcatagctggctagtagtctctcagctctctaaaacacatgtgtccaccaagttaaagtcagtgttagaaaaagtgtaggttataaaactctgtattaatgtgatgctattttaaaaatatatatggctgaataagtttatataaataaaccctctctatttgttcatctgtgtggaaagaaatacatcaaaatattaacagtgactctctctaagtaatatgggattggaagtgatttttattatcttcttttacctgtgttctccaaattttctagattaaacacatattcttataagacaaaacattatgaaaataagatttagtattataacctcaggtttcatgtagtgttaatagaaagaaagctcatttgattattatttctatgtcttctgaaaatctgtagttgaaaatttttttgcctttttctcccctctgaattccccatgtaaaaagggcagcatgttgaaataacgtgtgtgtgtgtgtgtgtgtgtgtgtgtgtgtttggtgttaggaaaaaatgtggttgatgtgctttttaaaatagaactaggaaatgtaaaaagatttcgtttttacattcaatggattttacattcaaatccataactcaggatttgaagaacaaagttatagaagcattgctgatttctttctagactgtaagcgctatgaggacaggcaccgaatctgtttctttcctttctgactgtgtagtgcttgccttggtgtctagcacagaagactctcccagtaaatacgttggaatgttttgaattgaatgataggattaaaaactctgataagcatgtagaaatttgaaataagagtttctagggcccattgtatcctctgaggtcatatgattcactcacgttttagtttgtttctctgtaagttatcctggcagtctttgtattatatgacccctgggccacaaaagtggtttgtgctggtcatctgggatcctctggcttattctcaagttttgatccagctcctgccacttgcatccatctctcatttcagttggttttgtgctttggggctggtgttttgtttctttccttggctctggattttgtctctctttcagcctttggcttgggttcatcatctttttctcccactgtggacaccagtgtatataatcccagttagctctggccccctttaaaaaaaaaacttatattttaggttcaggggtacatacacaggtttgttagataggtaaattgcatgtcacagggatttggtgtacagattatttcctcacccaggaaataagcatagttctcaataggtaatttttcattcctcactctcttcccaccctttaccctcaagtagaccccagtgtttgttgttctcttctttgtgtccacgtgttctcaatgtttagctctcacttataagagcatgtggtattaggttttctgttcttggattagttcacttaggataatggcctc

SEQ ID NO: 96488 - DNA, 1090 bp, Homo sapiens
gcctcctatttgtgggagggaataatgtgcatagttagggctggtattttttaaacaaagaaatagacaaggccagatctgtttaatctctaacggccagtgttctttctgttcattcccatagattagaatcacagccaactggcttaaaatgttgttttaaggagcaccaggtgagaggtggccagatcagcatcagctccccacagtcctgataaatgactcaggtttgaactcctcctgttgccaatgttgttattctttggtaaggtgaaccaggcaagcaaaaatcaacatggtacaaaaaaatttttctcaccaaagctatttggaggctcaactttctcaatgaagggcactgcatttcatagatagaatagcattttaaagacatgtactgtctataatggtactttcttctcagttgggaactatttaggagagatctgtgctagaggagacagttttcagctaggacatgcaaattcaagaaaggtccagtgccatagcgtctacaagacgtcttgtagagaagcaagcagactcatttcctatagcttctgggcagttctggcattgcatgtgtgtttcagatctcttccggagaagcagtgtactgaataagatcgaacatggaaaatggaaaggaagagtgggcagagaagaaggagctaaagaacttttaataaagaaagtatcatctactttataatagattaaaaaaaaacttttcgatcctatctgattcctgtcctatcagagaaatccctaaaatgaacaaatttgaggagaatgacaaacatccatctgccttaaattatcttccaaatttctgccactcccagcttcaaagccactcctttggcaagtcattgattcagccttagaagatcactgttaaaagccttccctgaagggaaaatcatgctcgttaatgaatgaatctaagctgggtaacatactcttccagtaggcaagtgaaagctgggggaatatgagtccaagcaaggggactgagatggggaaatagaggaggtaactttttccttgtaagatgtgggtggaaaggaaagatgttgagatctttgct

SEQ ID NO: 96489 - DNA, 1042 bp, Homo sapiens
caaaatattggactatctggtgtctgacgtccttctatgttttaaattctgtgaatgtacaattagtttgtctctcctcctatttctttcctagccagcccccttgcctcttacctagaactgtttttgtgttgtgtgtaaaccatttgatcaacaatgtactctgttagaaaatctctgcatctactttaagagaagtgcatgttgagatagtgcaaatctgcaagctatgcacttttcccttttatttttatattttagactacattaagtcaaaggcagtcaaaaagcaaacaataaattccccaagtgctgtacaccctgcccaatatcctaataaaaatattgaaacatttatactaatagaggggataatatttcagaaaagaataatttacaaaagacccaggttttattccgacagaggcgtttctaagcaaagcagggcaattaatcatagagctgtaacataaagatgaaaagatgaatactgaatatatagaaaatgtgcgctattcttcccttcatctttagaattacaaaagatgtttatcaccccttgccttaccaacaccaatcttggattttttatttggcttctgcaccagattcacccttgacttgatgaggagcaggtaaaagctgaagtgctttgtgggagtgggtgcgggagtggaggaaggtatagacatccaggatgtaggatggctgtgtctgaattagacctcctcctacaaaaatagctcctcttccagatgttttttaaagtgagggaatacaaggtggtcatctgtaatctcttgagtcagaaagagaaagaggcaggcatagtgtcttgtgcctatagtccacctacttggcaggctgaggcaggagtatggattgagtccaggagtttggggctgcagtgtgctgtgactgcacctgtaaatagtcattgcattctagcctgagcaacacagtgagactccatctttaaaaaaaataaaaagagagtaaggattctcactgagacaccccccgaccccatctctgaaaaaag

SEQ ID NO: 96490 - DNA, 1085 bp, Homo sapiens
ggactgagaaaattctggaaagtagttgcccaacaaaataggttagtactgtactgcacactttgttcagctttactgtgggcattgtcagatcaggttacagcataggatttaaaggtcaattatgccatgactttaggggaaagaaagagtgactagaaggttaaaaaaaacccctaagttttggcttttaaagacttatgaaattgtattccctttgtgacatttgatgaatcacttttcttaatttccattctgataataatctccctaacgttttcctaggaagctctttcatggcaaaaatactgtcctgtagatgcccgagagagttggggccagttatacagggtgggggagagttggggtagctactcctgtctctccgagttgatttgatactgcttccttgaatttactgaaattaagacacctgaagagattaaaattttgtggcataaaaacagtcacagctaggcatggaactggtttcagggagaatgaccaagttaggcatttagaggatgagaaccaaattacagatatacgaaaattagagaagccaaaatgaccccatgcattaatgaatggcctgagggaacatctgtggttgtctgcgtcttagcttacaaactgaatccagggacgttttcatcacaatgcctgcatctgaatagcatggaaggtcaccaggattaagagttttgacctgtcagcgcaatggggtttaggtttggtatctttatttttggtctgtaagctcttttgttcaaggcaaagttgatctctccctgagccaggccttgagtggaggtggactggcttcgtgtttctaattagtcagacactccccctgctcctgactactgatggatgtcatgttagttcaggaccccaagccctctctctctttgagctgcagtgcagggatccactttagtactgaactgtcatttgtatggttagcatggtggccggctgtcttgagattatgttagcagaccccctccctatccctggctcttgaccttttagcatacagcctcttggcattttcccaaatggaataatatatgtgtaagcac

SEQ ID NO: 96491 - DNA, 1049 bp, Homo sapiens
catgtaaccaatgtattttatttgaatataatatttatatttggcaatttttatttagttttaaagccatatatggactttaaagcttaatatcagttttctgtctgtattcataagtagtatcataattaacattcattagttaacggaatgggtgaggttctgtctgtgaaaccgttttctccttttataggagaaaacacttttcaaatttgagaaggtctgccccagaccttccctaactaatttgcttcacttctgcctgtgtttttatcctcaccacaagatgctgatcttagcttgggatcagctagaaagtctgacaggtggtgacccaggcttttgacttcttataatagagcttggcatgctatggcgcctcttggaagacctttcaaaggtctttctgaatggaaagcaaacgttcctgggcagtgtcttgacccagatgagtaaccaggtgccttcttcacctactgtgagctgattttaaggactatgttagctagcaagcatgtgctagcattgttcaaagtgtactatctcctttaaacctcctaagagccctttaaactagaggttttaatttccctattttgcaattgaggaaactaaggcacagagaggttaagcaaccttcccaggagcagtcagcgtgctaggctgagctggcccactccagagcctgtgctcctggactgtaccacactgctttcgatgcattacatattctccttcacagtaagcctagcaagtgggtaatggggcctggggtctctctgctctggagcccagcacttcatgtccttgctgtagtggttcctggtcagcctgcttgtggctgttgggtgtggctgccacacccatttgaaatatgtgtacattgtgaaatgattaaatcaggctaattaacttatcaatcacttcacatacttaagattttttagtgatgagagcatttaagaactattctcttagcaagtttcaagtatatgatacactgttattaactctagtcaccatgctgtacaacagatccccagaactta

SEQ ID NO: 96492 - DNA, 1082 bp, Homo sapiens
gctagatcatttcagatttccagaatgcataggaattggaggaaagggatattaaggcggtttaagtgttgcatgtgactttttacttatttagttttttaaatatttggagtattaaagtagataggtgttcatgtttacctaaaaattattactaaaatgtctttcttactaatgagaatatttcgtttttatttcctcagttttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaataatgtgtgttttcattacagtattttttaaataccattattgattcttaagtttctatattaatctttttaaaattctttttaatgcaattgagaattttggattcattgtagactttttcaaattttcttttatctttattgtctattaagtgttggggtaccagtctgagtattactttgaaataatttatgttcaggaaaagaagaagaaggataatacatctttaaacgcatatgagtcttgtccttatccctactaaaaaggtaattctctcttaactcctgagttgagacagacaaatagaactatgccttaactgacaaatttatttttcaattttagc

SEQ ID NO: 96493 - DNA, 1213 bp, Homo sapiens
gataaaggctttgaaatgtcctgtgacatctgacctcatgctgccattagataggaagagtaaaatttttaataacttttttcctaaggctaaattaaagtcatttttactcctgggtgattattagagttataattttatgagttaatataatacggaaaaatcttaacagtaagcatttttgaaaattatattaaccccaaataacgtgtaatcctacttacccttcaggattgttggtagtaatatttcagttcatccaacaaaagcagaagtaaacaaaactaagtgaattttacccttttcaaaaataacatacatttataaaaattaactaataccacagtaattttacttaatcagcatttttctaaagaagtacttttatccttctttaaaaatttgttctttaaaaatcaaattcttttctacctggaatgtttattcttatttgtagattttgaatcactgtttccagaagtagctaatggcaaactaatgattctgactgtaacacaaaaaactaagaatgatatgactgtttggagtgaagaagtagaaattgaaagagaagtgctcttagaaaaggtaattctttcaattgctaataatttaattttatggtcattatttaagtaatagtgaaccaatgtcttaaaatgatgactgtcatttccaccctttattcattttctgccaaagtattataatactaaaggacttacatcttttttgagagtaaaagtgcagctttttagtatccttaaaagtttagattctgtttattactttcctcaatttatttttaaaaagtctattttggaaaatttggtaaatgacaaaaaggtaaaattaactctttatccttctcccctcagcctccccctccctctccttctccatctcccccttcatctccccatcttcccctccaaatctatcccctttctcctgggcttagaacatgtcaaaataaagagtgaaaattatgccagttctctccaagagtaaacagtaacagtatgcagtacaataatagtgtaataatgtatacccacatttttttctgtggtttgcttttaacctaaagtatgctttgacatgtttccatgcttacacatagatatatttcattctttataaaatctgcatagtattaatatcacagggtaaaccataaactttttaatttatttaagaattttaactgggt

SEQ ID NO: 96494 - DNA, 1039 bp, Homo sapiens
gctgctgcacctccagatatatgtaagtgaaagttgttactgctttacttataattgtttcaaaacatttttagttgtattttcctctaatatttcttcttaaggcttaatggatttttctaaagttgtgtttgttcagttgaaaatgaatcacagctctgcctaaatatatttatgtcagaaagctacagtattgaaaaaagagtaagtactggtttctaaagcttacttcttaaacttttctttctgtcttcaaacatagagtcttccctgaaacaaatctccttttggtcctgttaaaccatattattatttcttcccattctttgctagatttcataaatgtaccttgtactttttatgtgttagtgtttattgaacttacctgctttctacaaagtctgtttcttctaacctgtttggtacaccactaccatgctaatcattctaaattattttaaccatgtccctttcttgaaaaacctgttatctttcattgctttcagcagtagttcccagactaccttcaagccatgaagctttgttcaaggttaaaaagaaaaagtgggggtagggggatagtctctgtggtaggtaagtttgagaaatgctacatgccatattcctgccttggaggcttataaggcacactaaaatattaaagactcttagaaacttaacctaatgtgtcctaaagatattggacatggaatccttttttcatggcacacattacttacaacgtaatttaagttcacttgagcattcagagccttccatcctgcccaagttttctaactctctgactactccccaatttacatcacctaaagactaaccatatatttataataaatgaaagattttgccattcaaattatataagatgttagtatctggaatatataaagaatttataatagatcaataggaaaagataacccaacagaaaatcagaaaacaaaaggacatgaataggcctttcacagaaaacaaaacctaaaatgaccagtaaacatatggtcaaatccactgccca

SEQ ID NO: 96495 - DNA, 1176 bp, Homo sapiens
ttagctaaactgaagggtttttttaatctttttttcttttttttaaaacagtttccatattggaagtgaccttctaaatcctacaaaataagaataggagatactctcacacaccagagatatttattgactgtaactttgcagtgattagacacatcctatctatagaattcatatgtagcggtcataagacatatataaaaacagctacaattaaagtataaagtaataattttttttagaacctacacgaaggtgcaatgcagattcaagtctttgtggagaggagtttgggatcacttcatgagggaaacatttaacttgaggtttgaaagataggtgggatttgtatagtctaaaatatgagcgggaaggacaggaaggtatattcaaagaactccccaacccgcctacccctttgaaaaactgaaaagtgactgctgcctgccaacctgaatgtaagctgcatgaaagagataagtgggagataaggttgaattgtgaggttggtaccaagtaaatgagagccttgaatgccgaactcagtaatttagacttcattctttaaattgtgattattcacttagagctgtgtgctaggaagatttatatggcagcatttagccaggatgctatttctgtaattgaacatggtatattaagtctaaagtgtgactatagagacaagtcataagaatagattactagtcttggccaagttctatggtgaatttttgcctgcccataacctgcacagaaagagaatgctgtaaaagaagtatgtggtactttcaaaggagagaaattaattgaagtagaatagaatgctattatttgacctggttttattttggtttaaatgaataaattataatagttcagtagggaagatccttttataagtcttttgttagaaagaagttcatattaaaataaatttaagtttcagtatccaaatgtacgataacaatttttgtgttaatttatatggattgtaaattgtggatggatgttactaatgaaatatgcagatagtgtttcataacaaggggcaagaatgttcatgtttcagagtctagacaggtacattaagaagccttcatggggactgtgacaaagcctttctgaacaaaggggagcaacctttccttagctacagtgatttgttgctaacta

SEQ ID NO: 96496 - DNA, 1462 bp, Homo sapiens
gctctgacacccaggctggagtgcactgagtgatctctgctcactgcaacatctgcctcccaggttcaagtgattcttctgcctcaacttcctgattatctgggattacaggcatgcgccaccatgctggggctaatttttgtatctttagtagagaccggtttcaccatgttggccaagctggtctcaaactcctgacttcaagtgatctgccaaccttggcctcccaaagtgctgagattacaggtgtgagccaccatgcccagccaaaatttgagagtttttaacaaagagttaaagccattggaaccccttggactggagtacaatgatgggctttgcagagagtgaagaagatttgtgaaattcctgaaaatgcatgtaaattcctgaataattataagtaggttctgtttccccttcaagggagctgagcttctttaggtctttgaaggagtctgtgcctctgaaaagatcaagggccactagtggagagtataaaagaaaaagggcaaaagtcagagctctaggaagtatcaattaaaggagtaaccgaagaagaaaactggcaacagagactgaaaaactttagtcagtgggtagacaaaaatcaggagaaagacatattttaaacatcatgaagataattgctcaagattattagatgctacgcaatggtcttattaaggaccaaaaagagatcatcatatttgataggccaatggtgactttgctggaggaatttcagtggaacagtaagagatgaaattttgattactgtggtattcaaaggatgaaacataaacctcttgaggacagagatttttttgtctgttcactgtcttaggacttcactatattcctgctacagagaggtaatcaataaatattgttgaaagttgaacagatgaagaagtggtggcagtgaccattaataacagcttttctttgttgttctattttcaggctccatacctacctaacatctatcttctcaagaactctgccagggaaggagtagtttctgtgtttcataaacagactgagactcaaagaggctaagtaaactacctgaagccatatatagcaacacacaatgacggatgtgagattcaaacttggatttatctggctccaaaatttctagtttttttttttttttttttcccactacagcaaaactaaggagaagagacagaggtgaatagctgtctctcagtggttattctgttttcccttatctacatgttttcctcctttcactctctcttggtttgttcttatccttcagaggtaaagaggagccttcagagagctataaaggttgatcaaagtaccagattatgagattatttggaggctaatatgtaatccttggggtttcctttctcatctcacccttacagctgcctgtattaatgctttctgattaacatatggtctcctttttattctagaaaac

SEQ ID NO: 96497 - DNA, 1038 bp, Homo sapiens
catgtgtgactttattttcagctatcttttaatattattcactcttagtcacaccaactatgcttatccctacctaagtccttctcatcttgttatcaccagctggtaaattcttcctgcttcctttacttatataaatgtggctgctttttcaatatcagctccaagccatctcctccatgaagctatctgggtaattcacagaaatctgctttcctgaatcatagagcattgctcagtgtagctcatgattataacctagtcttagttgctttttaattagtttgcacacgtgtacatatacacacacatgcacacacacacacacatgaccaactagattacaagcttttcaaaagtgggggctgtaccccagtgacatctagtaatatgctgagtatcatatatacattttcaatagatagccattttttgtttatctctttgattgcggaggctaaaacataataggtatttaataaatgttgagagatctgaggaattgatttaaattactctgctgaagtactagatctttgataatattagattgtgacatttggtgtgacaattctggtagtcattagcatatacctttgcaagagctagctcaagtcttataccttccatgacaacttctctaggctaatacagtcctcattgttcctcctggtcctgaatttctccttctcctgtttctgaactcctaaagcatcgtacatctacattgggcaagtgccttaggactacatctgtagaatgggtttaataatagtgcccatctatttggaactatgataattaaatgacaatatgtataaattacttagaacatttctggcatattataagtaatcaataggtgttttagtcatggttctccagagaggcagaactgataagatatatgaattagctcagttgattatggaggctgagaagtcccatgatagacgtctgcaagctagagaaccagggcaactggtagcatggctcactgcaaagtgtgaaggcttcagaaccaaggaagccaatagc

SEQ ID NO: 96498 - DNA, 1039 bp, Homo sapiens
ccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaatgtgatctgtcttttattatctacttcctgatttagctgtttagctttgttctttaacataggtgattacagaatctggcctaacgttttctgaactagaaggctttggaattttttgattcttcatagtagtaacagataaacctgcatatataaaagttttcatgatgctttcaaatcacaagaaaaaaatggggcataattagattaagtgatttgatcatatacaaaaaagagctatgatactgcctaagattaacttgtagaaaagatggaaatccttcaagtctttaagaatgaagcaatatgatgcagtctcaagtcacaggtttaatactaatataagcctagtttgcctctctgccctgtggggtcctaagccttggtccttaacccatgccacctcgcaaggcatgcccttgttcacagcagttgtggggatgacccagaacacagcttttgcagcaattcgtggaaggataaataacacagcacaacataatacaagttaccccactgatctgggagatgtacagtaagcatggaacagcttaaaagagaggactatctccccataaatccagttgattctcagtcttcagctaaaatacttacatataagttttacataagtgtccaaagatactctgtgggattttaaaacagtgcttctttttacacagctaagtcacttcatataaaaaaatgcatccttgtggcttctttttttctgagtggctttgggaatcttggagg

SEQ ID NO: 96499 - DNA, 1650 bp, Homo sapiens
caaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgt

SEQ ID NO: 96500 - DNA, 1059 bp, Homo sapiens
ttagtaggtagcagtctccagcaggtgactcagggctgagcacaaagccagatctcctttgtggccataaaatgggtgggggacgggaaacatagtccacaaaggggggaggggtattcccagcagtcatgtggtggcctgaatgttgaaaccattcctcaggattttcctggcagtctcaattttaattaaactcttttatcctctttgtatttcttcaatcgcttttcctaatttttttatttggaaaagatggtctccattgtcatagagcagtattacatctggaattagcagtgagtactctaacatcatacaaatcgtatcctgaaaggagctggtaggcacctggaacagttctctaaagataccaggtctgcttgtactggaagctctccacagggagagagtggtttttcctaatgtgagtgatttctgggaaaggagatctctgaagcctcgttaggtttctgacaatcctaactgttggcagctttgccttcctgggtctgggatcaggttgtctctcgcggactttgaggagtagaggaaactctcatttatatgtccagtatttggagctccactctatgatctagaattttctgactgcctgtttggaaagagtcattcaaatgtttacagcaggtgccgtgctagagttagactttggacacagaaacaggaaaggttctagttgagaaagtgtgaacttcttagaactaatatggaaatactaatgtagccataaatagtgttcaaccatctcgtttctgatgcctttcgaatgttcaaatgggtgaactatttgtgaattattctcttcacctcagagtactttcagcgactgaaaaggcagccacagcttgtcattttcagagacggcctcattctaatataccttcatacttaaaatgacttgactttttaaactctaaacgctttaagcttctgggaaatatctttcagctgtcagcctctgctctaccagggtcctggttccagatgtgggtaggcagctgctgcagctcatgaacagctctgacttaattctctatt

SEQ ID NO: 96501 - DNA, 1065 bp, Homo sapiens
gcaggtatgtgtctgaagaattagtttctgggtgaggcacgttgtgactattctttggctggaaattttgctctcacccagaattaatgatcttgaatacaaagatgggtagatctgaaatttcaaaagctctctagaactttgctgatgtttgccaaacttgagcaactcagagaaccccaagtgtacacttgttccaatctacccccagcaaagcctttcaactatattttctgggtgagcggggtacacattttgcatatatagtgtagttgtttctttacaatatagagtttccctaagtttttccttcagaggtgtggcaggttacttaaaaaggaccttggaatagggttgcgagcttaaaagtttcatatagtaccagagaaatgctgcatctgagaatttccatatgcatgaagcctattccacatgctgaaaaagagtttcatttgacaagccaaacgcagtccctaaatgttattggactttagtgcattcttaggtactagagcacatactctgtgtatatcaatacctaccatgtactgcagttaaagttgaatactttcatacttagtaaaaattgttgagccctcctgcttgtgctgtgtttagttctacagttagcaccttgggagtttttcatgtgcatcttttaaaaacacctatagaagttaattttttttttttttttttgccgtttggcttcacagggtgttgtaagacttttctggagggatataggagttaggggcaggtattgttcctgctttacccacttactttcagctccttcctttggtgtcatttctgcccctctttattgcttctcacttcacagagtcatttctggaattcctcttcctttttttttggcatgcgttgtctcacgcatacctgtgattccaccgtgccctctccagctttgcttgccttacttcctttgtgcagtctcttgggctttatggggaagaaaaggaaggattccaagtgcttaaacacagagtaaacactgtaaagttacacaggaggtgtttttgtgtgtgagtgtttttgtttttt

SEQ ID NO: 96502 - DNA, 1047 bp, Homo sapiens
tatgctattgcctcatgaacactctttcgaatcttgtcatgatccaagtttcttttaagccctgagtgctaaagttagtacttcctattttagtttttagcattactaacacttaaggtggtatcctttatttcttagagaaaaagagaggaaaaatatcttagttacctaatggccttaatatgaggacaaacttctctataaacagaagtctatctaagctgttatatttagattattgtacatcaagtatgaagaatggtcttggtgacaagctctctaatgaaatatttcttaacagggatggaaatggttcagcagtattggagattagtatataattaatccagaaaagcagcttaaaaggggatcactgctctctctctccccctcccctttttttttggtgatttagcatataaatgaacacatctagacaagacataaaaatgattataaaaccagtaaacatggtttagtgctttctgtgtgcatacaatctgctagatgctatgggaggagtacagagctgggtgagagcagcttctgcccttaggtactcacagtttcaccatgtgataagacagacatggtgaaaacatgagtgacaataaaatttaaaatattcaggctttcccaaactaacaaaagaaatcaaatgagaagcccggattaagtgtcaggtgtttaggtgagaggagatgccagtagactgagatttgaacagggtaaagacatccttcttccctgacaaccttctttgaatacccacaggacaaacagaggacatagaaagacttcctcctgtctagtgctgtaatacctgtttataggatggtgagcccggaggttctaaacctggatttttcaaggagcaacaagatccaaagagttcttgaaggccacaagggcagcccaggctccctaactcatgacttaatggtcattgaggcccaccacaattcccttcctttctagaagttgactaagttctaagaagtttttaacgtttcttccacgtggaaactcgcttacatttagtggctc

SEQ ID NO: 96503 - DNA, 1038 bp, Homo sapiens
agaaatgctaaaccagccggtgaccaggtgtccatcaagccccacttctttcaattcatgaaaattatagactttcttttatatactggcacatcctaagacctcctctaagaatcgccttatggtcaacaggggaggagaggctctgtgatgctcaggtagggggaaggaggacatcatagaaagggagggaagagcaactgtatagtgataactaagcagatttttaaaaggatatttgaataacatgattataagcttttgaaaggactactgttccagtaaaatattaagaatcaaccaaaaaagaaagtcatttattttattgagatctgagatccagtgagaactgatatagagggtctgatttttttccttatagaggctcatagaaaaaaaaaaaaactacatttgaatagatgccaaagacccattatttctctctctttctctcttatgttttgttggacattgtcatatctgcatggcatgcttgtgctcgtgaggtcagctggtcttggacaaagtggcagtgatgaagatgggagaacaaaaagatggaaaagttccagatcattgatgatgtcattgagctaataagttaaccatccctagagtcactctgcctcaaaatttcttgctctatgagataataaaaaatccttgttgcttaggctactgtgagttgagatttctcttttttacattaaaaaactccctaatatattacttaatccagatttctttgtctattcagtggaaaggataatatctcttttagtgtaatgcccggcgtatagcaaacatgaaacaaatgagcctaagcatttcagctggagatataattttctgaaggagtaggtaagatgagtggagttgcattccagaaacatttaaagcaagtcagtgctgccttatattagacaaacatttccaagaatgtatggtttaggatgctaatatactctaatgtcctaggttccagagattccagagtcagttaagtagacttaataaataatggtctaaagaaattca

SEQ ID NO: 96504 - DNA, 1051 bp, Homo sapiens
caatgttttgcaaatatttatttccattttgttgtttctattttcattttcctagtactgtcttgtaaacagcagaagttgttgattttaatgaagtataatttaccaatgtcttcttttatggtttgcactttctatgtatcatatgtacgatacatatgtatgtgtcatatgtaagaaatctttgcctaacccaaggtcacaacagttttctcctttgatttctccccaaagctttaggtattacatttagatatataatatattttgagctaaatttatatgattttaaggtaatgcagaaaaagttgagattctgttttggttttgtttctattttgcatatgaatatccaattatccagcagagtttattgaaaaaatacccatttctacatcaagttcccttgacaactttgttgaaaatcaactggctatatatatatgtgggtctatttctaaactctcttctgccccattgatactaactagtcatatgccaatattatactgtcttgatgctgtacttttatattaagtcttagaatcaggtagaatgagttctccaacattattatttgttttcaaaattgttttgataactctaggttttttgcatttccatgaggattatagaatcagcttgtactttttctttctttctttttttttttttgagacagggtctcactctgtcacccaggctggagtgcagtggcacaatcttggcttactgcaacctgagtgatcgtcctacctcagccacctgtgtagctgggactacaggcatgcaccagcatgcctggttaatttattctttgtagagacagggttttgccatgttgcccagggtggtcttgaactcctgagctcaagcaattttctcacctcagcctcccaaagtgctatgattacagacatgagcctctgcacccagcccagcttgtaattttctataaaaaacaagaaagatactcttggaattttgattggcattactttaattcatagatctatttgaacataatttatatcgtaacaacactaaatca

SEQ ID NO: 96505 - DNA, 1017 bp, Homo sapiens
tgagggtagacaaaacacagcagagtaaaaatatgcgggatttggactgcatgggctcaaagctttgctctgctgtctactggctgcgtaaccctgggcaatttacttgacctccctaagcctcagtttcttaatctgtaaaagaaggataataatggtatttccccactgtgcattaatatggaatcatgcatttcaaatgttgagaacagtgtctactgtatcaagttatcagtgttaacccttatttcattataattaataattcccagtttttgtattaaggagttcacctgcataattacacatgtatgttttgtctttcatggagattgttgctaaattaccctgttactgctacttgctggaactctaagcactcttctgttggctccagaaatctctctactattgcaataacgttgatgtctgcattatgtttgtttcttgtggaccaataaaggaatgtcataggcatcacactgaaaaggattcactgactggagcctctaaaaggcctttattggctttcctgtgatgtggtcctattaatttagtgaaagaacggactcatattttataatataatttgcaaccctcatagactgagctattgtacttcctgtggtagggttagactgactcgaagtcttcagctctaaccttgggctgaaatgagaatgaaatctcctgaataggcctgtacagctagaaaattaagcagcaacatcttaaaagtatgcctacttcagttaagaaaaaatagttaaaatatttatagatgaaaaaaatagaggtcacattaacaaaaaaatggaagtcagcatgtagctggcacttctagatcccttgtgtgggactactgagaaaacacaagtgtgaactgagctcccaggggctatcctgctttgcaaaatttaacaaaacataaaagttgtttctagcagtgagctgtatgggagaaactttccatgaaatcatactatcatcagttttatgatagtatgatagatacaa

SEQ ID NO: 96506 - DNA, 1040 bp, Homo sapiens
attgttacccaattagcttgactgaagatggacagtttctcttgaagctgcttaactgcccttggacattgagtgggaatgggtaaataatttcttcaaaacattttctggttctacttacttttagttctgaaattctttttttttatcttttatttttttaatatgctttggttcaatttaccattgaatttcaaatttgaatcccaaatcagacccactgactaccagtgattgacttggctggattttgtcattgagtttatccacaatggctgtttgcactagcatttgtccatgtggttcttttacacataagagtgatgtgcagatggaggtctctccttctccttctctttgtctaaatgctcttcatttttttttttttaacttgtgctaacttctgccttgggtaaaatagtgcagaaaatctttggtgaattatttcatcatagagtttgtgttctgtggtttgtaatatattctgggccacatcaaagaaagagaagccatatggagtgtaacagcttaaatgaaaggcaacagaaattgtcagaagaagttaacccaaaggcagcattgaaagacaggggtcaggtgaaggggcaggagatggaagcacagctgaagtaggcaagggtgggacatgcattaggtcacagaataatattctctggaggagaaagatactctaaagcctttggaaagaaatgcaataaatatttcacaagcttgccaagaaaagcaaaaggtgaaggagttatttattatccagagacctccatatggttgctttcctcttacaccaggaaaggaagaaaacttttagcttacatttatttatttatttatttatggagacaacgtctcgctctgttgcccaggctggagtgcagtggtgcaatcatagctcaatgcagcctcaatctcgtgggctcaggcgattctcccacctcagtctcctgagtagctgtgactacaggcacatgccactgcacctggctgagttttaaatttattgtagagatgaggtctcacag

SEQ ID NO: 96507 - DNA, 1029 bp, Homo sapiens
ctaaacttgttagaaatttctaaaataagagttaatggaatctgatgagaactttcctaggagtaaaatatatcagatttaacggacatagctttgcatagttaatgcataacggattgctaatcattattttttaatttacaatttcataattagctttatatataagattaaagttacagcttgcctgttaggtatttataatatggtccatggaaatatgttttatggaaacataatagcacatttgtgtgtctgccacctgacttaattaatattttttccatttcaagaaacatcaacaataatctcaagtcattatattggttgaagtcaaagctggtattaataactccaagtatgttacttagatttaacattggactattatacccggtgtgggcaggttagaaattagcagcaatgtggttgaaaaattctcttatttcagattgatggggctacaaatgctatgcggaattctgccagtttttccccttaaccacatgactgtaactgctacaattacagtaaagtctacagtaagagccagagttcctccaagtgcggatgttattgtggggggtttcggattgtttgcacatctgaatgtccatcaatagagttctcccaactaataaccagagcagaatgtctgccagctcacaagcaactgttgctaatttggatgttttggatgatgtgaaagttctctaactccaatgaatcataattttcaagtatacattttgtgagttggattatcacaaaaattacatttatctgttgtgagagccctaaaagtgctcaggtgattgtctttcaccctggctaaacataactcctgtggtaaaagatgatcttttagcttattcccagcagctactatagtacctggtataaaggagccaaattcataattaaatgttgactaacaggtaaatttatgtttatttttataatgaaaaattagataacagaataaacctggtgaatgaattctagtaacattttaaaggaattccatct

SEQ ID NO: 96508 - DNA, 1184 bp, Homo sapiens
ttctaaatgaaacaactgaaggccagtagaaggggtattacaaataaaacaaattattgtcccccactttagtttaaatgaaaacaaattattctttccatgctggattataattcctgttatattgctttcatcttttaaaaaatccaggttcattgatttctcaaatatccccattttcgtgaattctttttaacatgtgacttattctggcacaaatgcaaatatgcctaagaaggttaacacacaaacttcttagcagtcatgacatcctggtaaaaatatatttaccaaattgccattttctaaaataggagatgtttagtgttactcatgttctggttaccaggagctgatttattcagatgaaggtagaggaatagagaggatgtggactgtggcaaagcagggaaaaaggagctctgtgctggaaatgatgctgaaaaggcacagacagaggaaggagatcatttgtacaattgtttccttacttctcaggttggcctagagtttgaattttgttacattctacactttaaaaaaaaaaaccacaaatatattccctaagtctccataacattaactatcctctttgggtaattaacccacatgccacttgcatctaagggactgccctgctttgatagctgggaggaatcacaccagctctcagagggctacttgctttattaccacttggtggctaaagctcctaccgtagccatgatgacaacttttttaatttttcccattccaggcttgttcacactctttgaattcaacaagaatcaaattctacaactaataagcaccttcttgtgctaagtaggagagtctcaaatgtctaggtgataatctagacaattttaccaccctcatggaataatatccggggaatatggataagtaaacagacagctacatcaagcagtttaacatactgacttcagaccgtgagaagatcctctctgctctaggacctgagtttcactcccacctctgtcccattgcagttgctgcttgtgggtggcgtggggcttcagatgttccttgcatggcagccttgtggtccaagcagtgcgaccaggtcctttttaactctcagaaaggttcggacaaatgggaactgacaagtggtactaagattccatgactctcaaaaattcaaattgagagaatcctgt

SEQ ID NO: 96509 - DNA, 1035 bp, Homo sapiens
cttctttccttcctgaaggtccaggcttccatgtggaataatttctgttcatcctgaaattcctttagtatttcttgtagtgcaggtctgctagtgacaaactgcctcagattttgttcatctaaaaatgaattacttttgttttcaattttgaaggactttttggataattatagaattttaggttgaattttgttgttgttgttgcagaagtttaagacaccaaatcactttcttctggcttccattttttatgatgacaagacagtaagctttaattcttcttattattattgtttccccaaattaatacagttttcctagtatttgtcctgcatgagattctctgagcttcttgtatatgtgggttaatgtctttcattgactttgaaaaaaattccagtcattatctcttcaaacaattcttctgcctgattttctttcttctttgtctgggacacaaattgcatacatattaggccatttgttagtgtgccacatgtctcaaaagctcttttttcattctttttaaaatttggtggttcaatttatatcatttctattgagctaagagttctctgatactttcttttactaaatttagactactgttaagcctatccaaaaatctttaatttagataatgtattttttacttctagaattttaatttggctctttttaaagtcttcatttctatgctgaaattctccatctttttctctaaattctttaaaatgttatgatttatttaaagatcttgtatgttaattctatatgtgtagttttgcttctattaaatatatatatatatacacatatatatgtgtatatataattttgattgtgggtcaaattctcctatttccttgcacatgtgttttttaaaattgcatggcatatattatgtttaagaggctcatagagactaaactaagttttctttcccccagagagggcctactctttcctctgtcagatagctagagagagatccctttgatccaatctgcagctgagctaggtctgaggttg

SEQ ID NO: 96510 - DNA, 1035 bp, Homo sapiens
agatctcttgaggtcaggagttcaagaccagcctggccaacatggtgaaacctcgtgtctactaaaaatacaaaaattagctgggtgtggtggtgggcacctgtaatcccagctacttgaggggctgaggcaggagaatcgcttgaacctgggaggcagagattgtagcgagctgagatcataccactgcactccagcctgggtgacagagtgagactccatctcaaaaaagaaaaaaagaagggtttaatttttacatttaactcttaaattcatatagagtttatgttggtatatggtgtgaggcaaggatttactcccctacaccccttttaaaaagtatctaaccagctgcaccggcacttttatagaataagatattctctccactgaagtgtgatgtcatctttattatatagagtcttgtgtttttaaagaataacctgctgtttctcttacaggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaaggtatttccaagtcaaatttttgtaattttagaaatacttcttcaataaaatttaaaaattacattttattaaaatgatccacggaattggtaaattttaaagtagttttttttttgagacacagtctcactctgttgcccaggttagagtgcggtggcatgatctcagctcactgcaacctctgcctcccaggttcaagtgattctcctgcctcagcctcctgaatagctgggattacaggaggcgcctgccatcacgcccagctaaattttttatttttagtagagacagagtttcaccatgttggccaggttggtctcgaactcctgacctcaagtgatctgcctgcctcagcctcccaaa

SEQ ID NO: 96511 - DNA, 1044 bp, Homo sapiens
aaacaaatgcagtcaatgaatcttctgtttcttcccaatgccttacttacaaaagtaaagttttgctatatactttttgctttctgataagatggccaagtctgttataacacaatactgatgcaaggaaatgcgccatcacgttagtatgtcttggctaaaagctgctcgtttcaaagtccttgaaaggactgtctttctctaggcatttctttatcttaatcgtgggtagaagagatgaacaaccctcattattcataattgacctcagtaaaattatctatgttagccatactttctccaacctatgaaagggagttaaggacaaatattggcaagtcattgaagtactaattcattagatgattcatagaaactagttcttaccaaacaaaatttacatctttatgtttttttcttctaaaaatactggttcagggagaagtttctttgattttaaagataaattaccagtagacattcgaataaagaaatatggtattagtactaatgagggcatagagctgaagtaagatttcctgagtttaaattgattgcatgtttttctttgatattgttggggtgcagaaaatgatctccctgcccggcacggtggctcacgcctgtaatcccagcactttgggaggcgaaggagggcggatcacttgaggtcaggagtctctactaaaaatacaaaaattagctgggcgtgatggcatccacctgtagtctcagctactggggaggctgaggtgggaggatcacttgagcccaggaggcggaggttgcagggagccaagatcacgccattgttctccagcctgggcaacagagcgaggcgctgtctaaaaaaaaaaaaagacttcgagaggccgaggggggagcggatcacgaggtcaggagtttgagaccagcctggtcaacatggtgaaaccccatctctactaaaaatacaaaaattagtcgggcatggtggctgatgcctgtagtcccagctactcaggaggctggggcaggagaatcgcttgaacccgggaggtggag

SEQ ID NO: 96512 - DNA, 1697 bp, Homo sapiens
ccgcttcccgggtttaagcgattctcctgcctcagcttcccaagtggctgggactacaggcgtgcgccaccacacccaactaatttttgtatttttgttttttttaagtagagacggggtttcaccatgtgttggccaggctggtctcgaactcctgacctcagactcggcctcccaaagtgcttggattacaaggtgtgagtcaccgcgcccggccagctcttagtcttaaacccaacagtacgttatctccttttgctaactgatttgttgctaaaacttcaacaagcactggacttggagtttgaacacttagtctgagggcccactatgttcagtctagtgagtctgagcaattaactcacattttgaatttcaagtctctcgccttaggcaaaacaccaccacctgatgctcaccagaggggcgtgacgcggcagctgggcagggaagggatgggaagggatgggaagggaggcgatcgataactccggtgtgccgctgactgttggattggctcgaacttctcccgccaggcctaacctactcccgcgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccaggtgaggtccgccacggggcgtagcggagagtggggcgctctatagtggggagaaagaaggtggttgggaggggcgcgtagaatgaatgtgagttctagaagtctagcaaatgtgaggacgcccgagtcgcggacgccttggggggcgggggagatgtattctaggtgacgttcccgggtactgctgctgctgcgcttgaggtgtgtgtttggaacgagggagcatgcacgtgtgttttgcaagcgagggatttttaaaagtttcggttggaagtagttgttggaggaggggtcttcagtgtaaacctccgatgtgttgggaaaatgtggctacccagagtttttttaacagagcaatacactgatttttattaattgcaaaatgcttcaaagtaattttcatagaaatgtactaaagttttgtaaaaccctttggaaaggcttagcaaatcgttagtaactaggaatagggatccctgttctgtctttttggagtcaggt

SEQ ID NO: 96513 - DNA, 3109 bp, Homo sapiens
attgcactccagcctgggcaacaagagcgaaactctgtctcaaaaaaaaaaaaaatttctagattgacatggattgaaattctcttatgtataaggtttaaaaaattgttttattttactattaattgagataataatagatactttataaacgttacattctaaccccttccttctcccagtcttagaggaagagatgtcactccactctaaagctaggatgttagcttttggatttgagtctcttgtttactcagtggaagggccttgctcccttttccctgtcatgtctttagcatctttcatctgttgacctctttgctttcataggtgtagagatatcctttatcttcattcaggtgatctcgatccagtttcctctcctttctttaccaagctgtacacatggcctttggattttattccttgtttatttttatttttattttttatgcgtattctcaaggatttgttggagtaacatgatgaatatgcttgttctgtaatcaacttctgctttctaaaaattgatttacagttgtgcttgtttgtaataaatgtgattttgtttttgtagactcacatttccagtcaaaactcggagctgagtagtgctgctctacaagccctggggttttgcttatataatcccaaaattacctcagaattatcaggtagataaatttcttatgacttaatatttttagagtataaagtataagttttaagtataagtagtttgatgctgttaaaagtactgttatgtctggattagtttcagaacctgtagtttaaggtttgcttttaagaaagaaagaatggctgggtgtggtggctcacgcctgtaatcctagcactttgggaggccgaggcgggtggatcatgaggtcaggagatcgagaccatcctggctaacatggtgaaaccccgtctgtactaaaaatacaaaaaattagccgggcaccgtggcgggcgcctgtagttccagctactcgggaggctgaggcaggagaatgacgtgaacccgggaggcggagtttgcagtgagtcgagatcgtgccattgtactctaacctgggtgataagtgagaccccatctcaaaaaaaaaaaagaatgtttagattatcattacctacacatagctctaacttcgatactacaaaatttgctcttaaaaataatggtatttgacaaaagattagccgggcgtggtggcaggtgcctgtagtcccatctgctggggaggctgaggcaggagaatggcgtgaacctggcaggcagagcttgccactgcactccagactgggactctgtctcaaaaaaaaaaaaaaaaaaaaaaggatattgctgggtgcagtgtctcatgcctgtaatcccagcactttgggaggccgaggcgggtggatcacctaaggtcgggagttcgagaccagcctggccaacctggagaaaccccgtctctactaaaaatacaaaaaaaattagctgggtgtggtggcgcattcctgtaatcccagctactcgggaggctgaggcaggagaatcgcttgaacctgggagatggaggttgcagtgagccaaggtgttgccattgcactccagcctgggcaagagtgaaactccgtctcaaaaaaaatcaaatgaaaagggtatttaaacatgattgctgtaaaaagggaaacttttattcaggcatatgcactaaggaatatgctgaattgaaaagttctttgacatgataaatgtgggataatttggaactaaaagtggtaatgaaagcacagaacctaatgctttccaagttttcaagtagtctgcactgttgctccatagttagatgatttccattgtaaaggaaacccttatctttagagaagggaagttaggaataaagatgtcaaagttgttaccatctgtttttgagggaaaagctgctgcctgctcttttttatacatggaagtgttagcaacctaaagcaggagttgttcattttggagcagagatgcaggattgaaaacatcttaccaaaaattgtcttgtatgttcaaacctacagtgatatctagttatttcagttgcacaagatatctgatttggtgtctgttgttttattttctctcagtatatcctcccctctaatctgaattttgtgtttttgggagaagtttggtatcagcattggttctctgatctgttctctggatatacatttaattttatgattgatgagtatattgttttctctagttttatatttgagactttaaagagtatcacctattctatacaaaattaaaactgcttgtttttcagaggcaaatgctctagaattgctttcaaaattgaatgataccattaagaattcagacaaaaatgtacgtactagagcactttgggtgatatctaagcagacatttccctctgaagtggttggcaaaatggtgagtatagtttttgggtatgccatcttaactatatgccaattaaaagaaaaaactataatgccaataaaaacagttcaggcttatttcatttgtatttatttggttcgttttttaggtatccagtataattgattcattagaaatactgtttaacaaaggagagacgcattctgctgttgttgattttgaagcattaaatgttatcgtaaggtatgcatttggatgttgtgcaaattgaagaatagttttcataaatttagctgaaggagagggtttttgggatttaaatgagagacagacattaaaaggggggaatgtcatttacaccaaacgactcaaggacaaaaagtaatagaaaaaagatggaagtagatatgtgtgggttactaggttttttgtttatttttactgggaccatgttcaaggtgaagtcttggttatgttcctgctagtaacatacacagttcaggtttgaaaaatatcttaaagtttgtgtaaggatttaaaaaataatgtaaactcataagtgggcttgggttgtttaggaaggcagtcagtgtttagcagggaatagagtaccttcttcatttttgttgtaacaggcatgccaacgcataaactcttttaagtgtaaactctttgatgacatttctgtcttccctg

SEQ ID NO: 96514 - DNA, 1050 bp, Homo sapiens
accattgtgaatgtgctgcatctttgaccaaaacgttgctctgtggtgaatgacaatactgtccttttcatattggacttgagcattattgtgaggtcctggaaccaatcccccagggatactgagggatgactgaaatgtttcaatctaaagacaagattggttctttaaaaaaaatttacaaaagcaataatgtgcaaattcgtaaaaataagatctatttcttgtgtgtatatgcatatttgtatatattctaaaacaaatgggccgtactgtgtatatttctgtttcacctattttactgcttgtttagacttaaaacatgaggtcacgctaattattcattgatttctctattataggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactgtgagtgttcttttatgtaagaattttctggatactgcatcggaaggttctgcactaagcttaaaattcagtctggtggccaggtacggtggctctcacctgtagtcccaaagcgggaggctgaggtgggaggattgcttgaggccaggagttccagacccatctgggcaacatagtgaagacccatctctacaaaatatcttaaaaattagctgggcgtggtggcatgcgcctgtagtctcagatgcttgggagactaaggcgggagggttgcttgaccagaaatttgaggctgcagtgagctatgatctcaccactgcattctagcctgggtgacagaatgagaccctgtctcaaaaaaaaaaaaaaaaaaaaatctgtctgggcatattggtatagttgcactatgatataggattttagctttgaatcaaaaccttaagagttgcataagttagcaaaggcacattgctcattacatagtagtaaggaagggag

SEQ ID NO: 96515 - DNA, 1678 bp, Homo sapiens
acatatataatttttttttttttttcgagacagtttcgcaattgttgcccaggctggagtgcagtggcgcagtctcagctcactgcagcttccacctcctgggttcaagcgattctcctgcctcagcaggagtagctgggattacaggcacctgcaaccatgcccgaccgatatttgtatttttagtagagatggggtttcaccatattggccaggctggtctcgaactcctgaccttgtgatccgcccgcctcggcctcccaaagtgctgagattgcaggcatgagccactgcgcctgaccataaaattctttctttaacccatttatcaagcttgcaacaaagcatatatgaaattctttatataaatttgagctaaaaattatttcacgtgtctgttgattatgaagctattaatgtattttttcattattgtgaaaaaatacagtgtcatttaaactagttaatgatatgcatgctgacatttttagggtaaagtatattggtagaaaaaaaaagttggattgatggatggtaggatggccagataggtgataagaccaacatagtaaagtgttaatggtagaatctgagtgtttgtattagagcatttactgtaaaaactcactcggatttgctatatgcttcagttttccttttggagtcttttgggaaaatttttttttttttttgagacagtcttgctctgtcgcccaggctggaggacagtggcacgatttctgctctctgcaacctccacctcccaggttcaagcaattctcatgcctcagcctcccgagtagcaggaattatgggcgtctgccaccatgcccagctaatttttgtgtttttagtagagacagggtttcaccatattggccaggccagtcttgaactcctgacttcaagagtgaggccgaggcaggtgattctcctgcctcagcctcccaaagtgctgggattacaggcttgacccaccgcacctggccttgggtggggtaatatttttattatggagaaaactatttggttgaatcagtttttgaaaattattcctagactttggtattggatttttttttctaagagtctgtttggtaaattaattgcttttgtttgcagaaattaatctcagaacttcagaagctatttatgagtaaaaatgagacttacgtgttaaaattatggcctttgtttgtcaaactacttggaagggtaagtgcccagttaatgaacagtcaacagtttttacatgctggactctttattttcttaccttttctttgtacagttgatgctcattatttcctttgtacagctgatgctcattatttcatgcctactcactaaaatttatttgtaaatctgaaaccagtacttgcattgcttttgctttcatttgtagacacccaaagtggcaaagaattggagtcacacaacgtgcatgtttccagctgaggtcaagcaaggttacgctctgcctttttgttttagttctcataccttaaacaggtgtcctttttataatccatgtaatgccacatttttcacttttctgtgcttttcctggtggtttcactgtttaaatttggaacctaaagcttgggtccaggtgctttctagtttgtgttcctaagcaaaggaaggctgtgatatacccaatggtgaaaataaactt

SEQ ID NO: 96516 - DNA, 1187 bp, Homo sapiens
tgagccaaaatggcaccactgcactgtagcctgggcgacagagcgagattccctctcaaaaaaaagaaaagttattcagttttcttgatttttatctcacttttactattttttattagcagataatactgtttttaaaaaatatttcttttacagccatgaaataagatgtttccttaattttccattcagtttgtttgaaaggttatttttattattttcagggttcaatgccttttttctctaatataattttttaatgtatattttgtttggtattgatttgataaagtttgggatttatctgctctcctaattttctgttttagaaatgttctgtgttgtacattgtctgcttcttcaaactttatatattttgtgatcttgagtttagaatgtgtgtttaaagtttattttcttatattcctaagacttttaacatatctaacatttaacacatctctttatgttttgtgaataatttgtcttttgtctccccattagattatgaagtcctaagagcatctgttaagtgaatgaataaaggaatgatagcaattattctgtttcatgcagataaataacttcttaatgattttttcccctttttagaccttgcatcgaagtgggagtttcatcaattctctcttgcaactagaagaacttggatttcgtagtggagcacccatgattaaaaagatagcttttattgcttggaagagtttaatagataattttgctttaaatccaggtaagtaatattttaacaattttgattttctgtgaatttgttttgcttaaagcaagataaatgaagtttttctggttttttggattttaagttgaagttaagtaactactgaattattttcattttaagggaacaggaataaatttgtactgaaaatagaattcacatactaggcattggaaatcacaaatatgaaatctgtttcacagtatttcaaaaactgaacaaagtgaaaaataatgatttgtggcttccttttttatttatttatttattttttgagacagggtcgctcttgcccaggctggagtgcagtgatgggatcttggttcactgcgacccccgcctcccaggttcaagagattctcctgcctcagcctcccgagtagctgggattacaggtgcccaccactacacccggctaatttgtgcattt

SEQ ID NO: 96517 - DNA, 1902 bp, Homo sapiens
accccaaaaaggaagtgtcttggactggagaacttgttcatacagtgatagcctttattttcttatagaactgttaattgaaatagctaaatggcagagtagttgtaacagacattgttgagtgccattccaccaaatacatggcctgattgatgtttcagaatccttttcaagttatttatttatttatttattcaggacggagtctcactctgtcacccagcctggagtgcagtggtgtgatctcagctcactgcaacctctgcctcctgggtccaagcgagtctcctgccttaggctcctgagtagctggtattacaggagccaccgccatgcctagctaacctttttgtagttttagtagaggtaggatttcaccatgttggtcaggctggtttcaaactcctgacctcaagtgaccaacctgcctcatcctcccaaagtgccaggattataggcgtgaaccaccacgcccagcccttttaaggtctttttgacaagttattttagcacagactgtgtcttaattttacatatccccagtcttactcatttggcataaatgttttttctgaagattggatttaatttctatgctgaattttaacaatatgattattgttaagatagggcagtcctgaatctaaatgaatctatttagatttcaaaaatgtattcagtcagtggccccagtagtaatgatttttgatggaatatattaataattgatttttaaaatgatagccttttttgacataatgtaaacatatgcttccgtttctttgtcaaatggggataatgagaatgctaaagcagctaggacagtatttgtcaaagttttggcattttgtgctggataatttgtttttcaggactgtcctggtgtggtgttgaagtttagtagcgtccgtagtctctactcactaagatgtcaatagcatcccctcatttgtaaccaacctgaagtattccctggtgggaaattgccccggcacacaatatctaataaatattacttatttgttttaaaatatatttttgatttattgagtgtttttggttcagctgtactgtagtttatcaaaatgcaagttttgggtagagcaaggacagcctggggatttatttttttaaaaaaattttaaaatacgttctcttgctgtgataaaagactgttgcatagctagtgttagagttaatctttagcttggacgtctctttaactgtgtgcttattttcttttaagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtaacattacaagtgttgactatagcactttatgtttttgttaatgtgttcttaaattcttaccaatgtaatcctgtggtgttatttttgctatttattagcagactagaacatataaaaggtctttcactttactggcagagaacttaaattcatttcccacaagggatattgttcagttgcttgaaatggagcccctttacctgaaatgtttttatttatttattattaatttatttattttgagatggagtcttgttctgtttcccaggatggagtgcagtggcacgatctcggctcactgcaacctccacctcctgggttcaagtgattctcctgtgtcagtctcccgagtagctgggactgcaggcgcacgaccacacctggctaattttttgtattttttagtgtagatagggttttaccatggtggccaggctggtctcgcactcctggcctcaaatgattcgcccatgccagcctcccaaaatgctgggattacag

SEQ ID NO: 96518 - DNA, 1026 bp, Homo sapiens
accattataagggtccaataggctaattctttgcatttgtccaatacattaattggaataatttatttggtaactacatgtgactggtactaggatgatgttagaaatgagctttgtctgagttcatgttttccagagttttaaaaagttaaaattagtctaccagtaatgtgtacagttcagatgttgatgtatataaacaaatttaggtaatacatatttagggcaaatacagttgtaatgttcatattttttccaaattccactttttagcctgtttgtgcatggaaacgatctgtaaaatggaatatattaaggctccatttaatgaaatttatattatgtgaggcttttaaaaactgtgacagttgtatagtttatagatcgatgttttcttttaccccataggtttgtgtgcctctgattcaaagtacaataagcattgattctaatgcctcacctcagggcaattcgtgtcatgtagctacatctccaggtttaaatcctatgactcctgtacacaaaggtaagaggtagatattcttgttttttgcttttttaatcaggctttgttgacctagaagcatagttttgaagtaggaaaaaaaaaggctttgagaggttttgctcagtgtttttcgtttgaaatgaagcacttcataatttttaggttcattaccaaaaaatccattatcatgtttttctgttttttgttttttttttttaatattactgattactgttgtaagcgcattgttgtggttagaagagacggatgttttttcagtacattatgtgaggtgccttgcaaaaaaagcctcagagcagctaacatgaagctgttgattttagaaccagaatcttagcgctattaaaaacaacacatcggccaggtgaggtggctcacgcctgtaatcctagcactttgggaggccgagcccagcagatcacttgaggtcaggcatttgagaccagcctggccaacacggtgaaacccagtctctactgaaaataaaaaaattagcc

SEQ ID NO: 96519 - DNA, 1440 bp, Homo sapiens
gccaggagttggataccacctgtgctacatagtgagaccctgtctctacaaaaaatttaaaaattaactgagcacagtggtatccatccatctatagttacagctacttggaatgctgatgggagaagtgcttgagcccaggagtttgaggttgtagtgaactatgattgtaccactgcactgcagcctgggcagtacaatgagactctgtctcaaaaaaaaaaaaaaaaaaaatctcagcagttataaagtgtcttctttatgtatgtcattgaaagacatatgatatacatgtgtgtcatatgtattattttgtttgccatctgagtcttcaaaatttgttacagaatacctgcatattaatatttcaaggtatggattaatgcctgagacatttaaactctgtttttaaaagtttcattgaaatgaaatgtatgcatttgggtagctaatataaaatgagcttgtatgacttaactctttttttttttttcttaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttaggtatttaaaggttttaagaataattttaattactaaaacagtctaggacttaatgcattggggtgaggagaggtgttattttgtcgcagccaaaatattttacagttgtgtatgaaatatgaatcttttttttatagaaaacacacctacttaatagacattttaaagttttatagtgagaaatgtatttcataaatctgttgttttacataattatcttttattcttccctttcagagccattggaacatccgttaatcagcagcccttcctttttttccaaacatgcaaatacacttatcactgctgttcatgatagctttgttgcagttggaaaagatgcccccggtaagagaatttgatttattatttgctcaaatgtgtgtttaaaaagaagaaaaaataggccagtcacagtacctcacacctgtaatcccagcactttgggaggccgaggtgagtggatcacttgagctcaggagttcgagaccagcctgggcaacatgacaaaaccctgtctctacaaagcatacaaaaactaggtgggcatgttggcagatacctgtagtcccagctactcgggaggcggaggcatgagaattgcttgagcccaggaggtggaagttgcagtgagccaagattgtgccactgcactgcagcctgggtgatagagcaagactctattaaaaaataaaaaatatgaagataaaataacaaatatttatatagtgccacctactggccagattgtgcattgagaact

SEQ ID NO: 96520 - DNA, 4123 bp, Homo sapiens
ggttctgaagttttgactctcttattaaagtctttggaaagcatagtaaagtctgaagtatttcctgtatcaaaaacgctggtaagtataatacccgtatgttggactttaaaaaccattttctgaagttaaattttatatagaagatatttgcacaaatctagtttgggaagacttttttatatcaagcattcatcagcagtttagtcctattgcaataagtgccattctattaactgtagagtcatttgaaacctttttaatagtgactataacaacagccacaaaagtcttcaacgtggtaagaaaaaagtatccgccatacagagaaaaactagggtaaaggacatgaaacttgaactgaagaaactcagatgtcctttaattttatgacaagattgctgaaaactactaatagttggtactttgttttcaattaactgtttttaaccaagataatgactttggtattaaaaccccttttttttttaaacccgtgtagtacaggaagaaaagtgaattggatatgattttgaggatatgggcatctcaaaataagctccagtggaacaaacaatacccttaaattctgattttgtttcctttatgtattttgatagttacttgttctgtagcagtatagcatagtggttaatagcaagggctctggagcatactaggttgaataccagcctaactattcattagctgagtaaatttgtgcagtttatctattcccttggctttgcctaaccccatatgtaaagagggaatgtagcagtagttaaagactaagtgaattgatacatggaaagtactatgggccaggaacaaactaatactgtctattattattactaatctgtttcaggtgacagtgtgtgaaaatgtattttcactgacataactcttctatgacatttaagttatgtagtgcatgttcataccagtatattaccactgggcatggtggctcacatctgtaatcccagcactttgggagggcaaggtgggcaaattgcaaaaattagccaggcatgctgacatgcctctagtcccagcttttatggaagcagaggtgggagaatcacttgagcccatgaggttgaggctgcagtgagccaagatcgtgccactgcaatccagcctggacaacaatgagaccctgtctcaaaaaagaaaaaaaagacagtatggtagtatttttggagagcaatttggtaggctcagtcagtttgatttagcaatcttagacccaactattagcagtcctttgaatatttgctttgggtaccagtataattaattgcagaatttctattagtagtataaaaaaacatagaaatagccccaaggtctcttaatagaaaaatggttgaataaataatggacattcatatagcagtatttttatatattgatgcaaaaattccgtaacaaggtaaaatgaaggttagttgcagagtttaatatcattagtgatttacagtgtaatggctttaatggtttaaaggaatgtgtgtataactggctgcccaagaagttgtgtgtttttctgtgtacttacatatacagaaatttagaaggtctaggaaaatagactctgaactgaaaatattatcgttggagattaaagactttacctgctttttatatttctgtgtttgaacttctaaaacggatgcagatatattcatgttagtgaatgaatgtatttgatcttttttaactaatgagattatatttacgttaatgaatgaacattacttgtaattgttagagatatagttaacactcagatttttattagataatatttttacggctaatttactgtaaaaccttttatctctcataggtcctcatggaaattacaattaaaggacttcctcagaaagtattaggttcaccagcatatcaggttgctaatatggatattcttaatgcaagtatcttaaatgtaatatgatgaagattggccaaaaacatttatacttcccttttttattttattttattttattttattttattttatttatttttgagacggagttttgctcttgttgcccaggctggagagcagtggcacgatctcggctcactgcaacctccgcctcccaggttcaagctattctcctgcctcaacctcccgagtagctgggattacaggcatgtgccaccacacccggctaattttgtatttttatagagacggggtttctccatgttggtcaggctggtcttgaactcctaacctcgggtgatccctccgccttgctcttccaaatcctgggattacaggtgtgagccactgtgcccagcatatttcccttttttttaaaaaaaaaaaaaaaaagaaagatgaccttatgtaaaattctgagagtattggatttgaagtatattgaccaaattaaaggaaaaactgatagttaatataaagaattaaatatgctgctatgtgaatgaaaaaactattttcctggattaaataaatggctccaaaaggaaagtttcctagttgtttatatacgataatactgttggttactgccataaatattggaagctaatgtaaaatgcacttagtatctctaggatataggcattgggattccagtaagttttaaatctatgttctttttatatctggaatctcataattccttgattttctgtgtagaggaaacagctatgattagactataaagagcttgattttttttttttttttttttttttgagacagagtcaggctgttgcgcagtctggagtgcagtggcgtgatctcggctcactgcaacctaattctcccggtctcatgccattctcctgcctcagtctcccgagtagctgggactacaggcgcgtgccaccctgcccggctagtttttttgtatttttatttagtagagatggggtttcactgtgttagccaggatggtctcgatctcctgacctcgtgatccacccgcctcggcctcccaaagtgctggcattacaggagtgagccactgcgcccggccaagagcttgatttttgtgtgcagtatatggaaataattttactaacatggttgtcataccctaagtaatgccaaaagttaaatttgtcatgctaaaacaattttatttcttaaataaccaattataaaaaacaaatgttctattctttgtaactgagaagattgacttcattttctccttcagggaactccagctttgttcttaattcaattaattttcaacaatttcttggaatgtggtgtatcagatgaaaggtaagtttgtactttaacttgaaactttgtcttggaaaggttatgtaatgaatgagattatttatgtactatttcataagtttaagtttttttaaaaaaaattcgttaactttttgtcagttattttagaattttgttaacattaaattaatatattcctgccaaaaagttgatgcattttttataattttttgttcaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcaggtatgaaataaatctgctacgtattttggataatagaccttttttttttgttagtgcagttggggaaatgaatagaagtttgaatttgaatagaagatggtaaatattttttctggtggaattggtaaacgttgtacttttgattgattttattgcatttctccctcactggtaaagaaactataacttaatggggactaatcagcttcattttcttcagtagtgattataaacctagaaggctcacatagatgtaaattcttgtatcttggattctttcagtagttttattaacagggaataacagcggttatcttgactaggctatatattcccatagttaagccacgttggtgattacctcaaagccatatagcatttccttaagtcaggaatctattgagagttgaataatctgtgtatttaaatacttaaatcctcaatgtttacctatttaaca

SEQ ID NO: 96521 - DNA, 1135 bp, Homo sapiens
tagaatgatccagaggccctttttattgtatgagtttttgctggaatgctgtgtatgtatagtagaagactttggagttggccctgggattcatttttagaacttaaacatagtgcataatttccccagattgcaattaacaaattacagccaactggtgacttaaaactacagggatttattctctcaccgttctggagaccagctatccaaaatcaaggagttggtaggattggtttctcctggagctctgagacagaatctgttcatgcctctcagcttctggtggttgctggcaatccttgaccttccttgggttgtagctgcatcacttgactatgcctccatcttcacatggtattgttgtctgtgcctatccaaattttcctcttacagaaaagactgttcattggattggggctgaccctaatccagtaggacctcatctgaacatatgcaaagactttatttccaaataagactacatgcgtaggttcgaggggttaagagttaaacttattttgaatctcatcattggggaacacagttttgcccactacttataaataagttatgttactacttaggattagaataagatggtaatttgtctaacttcattatttttcttgttttagaccaatgaagtaaatcaaggtgatgccttagaacataattttagtgccatctatggtgcattgactttaccagtaaaccacattttttcagaacagagatttccagtggtaaggcattgtcaagtattgatttccgagggatttgtatttttctgaaaatattatttcatcctttataatcagcttccacaatgatttgtttttctttttctttttctcttttttttttgagacagtctcacattgtcgtccaggcttggagtacagtggtgcaatctcagcttactgcaacctctgccttctgggttcaagcagttctcctgtctctgcctcccaagtagctgggattacaggaccatgccactgcgcccagctaatttttgtatttttagtagaaatggagtttcaccatattggtcagtttcacctgacctcaagtgatccacctgccttggcctcccaaagtgctgggattacaggcgtgagccactgtgccc

SEQ ID NO: 96522 - DNA, 1117 bp, Homo sapiens
tctttgataatttttggtatcatggccttatttcctctcttcagttagacctctgggatgtgggggaaaggttattaccctgtgttagtctcttttttattttgagacagtttcactcttgttgcccaggctggagtgcagtggggcaatcttggctcactgcaacctctacctcctgggttcaagcaattctcctacctcagcctcccgagtagctgggattacaggcatccgccacttcgtccggctgattttttgtatttttagtagagatggggtttcgccatgttgacctcgaactcctgacctcaggtgatccaccaacctcggcctcccagagtgctggggttacaggcgtgagccactgcacccggccgttagtgtcttttttgacacactaaatgttgcagtgtttttaaaaaatgttaaagatgtattgattctataaactttgatagataggtatatattaacaaaacttctttttttgttgttattggtaggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctgtgagtttgtcctgatgctacctttttttgtttgtttttaaaggattcttttcaagtaaatggagataatatttgtgaactgtcacctattactgcctctatttatatgtgataaagttgatactgcaaacaagtatgctttgtgtaacagttttgtgtctttgggctctaagattcagttttgggatcattaatagtgaagatcttttactatactgtgttatctccttgtgcttgtgtcattctagattaacacttcaagggccttgctctcctggacctcactttctcatacgtatctgttagatctttaaattcaatccctttgaaagtttgtagtcttagaaaatataagtctcttttctctttcttttttttttttttttgagacggagtctcgctctgtcgcccaggctggagtgcagtggcgcgatctcggctcactgcaagctccgcctcccggg

SEQ ID NO: 96523 - DNA, 2005 bp, Homo sapiens
ctggagtaccacagaaataatgctgtagttctttttcaattcattattttcccattactggtgatgttaacacttcctgtttgtttgaggatggcatctgccaggttttccactgtaaggttaattactaaatacttactgtggcacaattattgcttgtttctctagatacactttcatttaccatctaatatcacatggattatgctattcattccttttctgtatttttctctactgtctctaatagtgagaaacctggttttcattaccctcaatgtatttacaacttgatcattcacttgtatgtaaccagtctcctgacataatggctgtcacctcacctcagcattctgtcagggaatttctggatatagtttttcagtgtacataaatgtctgaaaaattgattccaaggagaaagatcaacttccttttagtagcaacacttgtttttcatgttaccatatgagattaattttaattaagcattcgttttctgttaaatttgagatctcattccttaaaagaatggattgattgagagaaacaagtaattttggaatgggtaaattttttgggcaagggctatgtgggtttattcttctaggtagatgtttacagagggattatctaagggtacaaaaaatcagacagtacttttaggacaaatctttttctttatatctaggaaatagtagacttactgcattctttctcagctttgtatctctgacttgttcaatgttatttgtagggatcaatgtactatagatgagcaaaaaaatggtccgtcattcttagtggaaattttttgtttttaaaactaactttcaaaatttaaatttggaacctatcttatgtaatttggtactttcttgcatattagttgttgaaattttatgaaatgtaaaattaaagtttgagatgcattttataattcctaagaaaaaatgaacttgtttttctggaattcatattcatgatccgccaagtagttttcgtctcccattctcatttgtaaagataatgttctagtgatacttatccattaatggtacattatgttatgatttgtttggggtgtcagtcagcaaacggacatgtatttgatgtatctaacatttaaatgtgagctataaattgtaaaagtggacagtgactcctattttcaatttatttgagtttttaattaattcagtttttgtttttagcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagtaagtattttggactaagtagctttgaattaaatgtatacaatttaaatataggtagcaacttttattttttaatcagctgtgttgtagatggtagtcttgacaattttgtggagaggataataaactacacttttgttgaaaagatagttaaaatagtatagaaatatgagagagaaattggaagtctattttgcctgttacttccctttccctttgcttttcaatgcttaccttttcagaattgtttatgcaaacaagcatacctattaaatgcatgatagataggaaagcttacttggcatgctgttttgcaattaattatatggtatgcacttaatacagttggctgtttgtatccatgggttctgcattcatggattcaaccaaccctggatcgaaactatttagaaaaattaataaaatgaatgcaaataaatacaatatgacaattatttacattgtattagatattataaggaatctagagatgatttaaaacatatgggaggatgtgtgtaggtta

SEQ ID NO: 96524 - DNA, 1057 bp, Homo sapiens
aagcagtgctttaaaacctgaaagaaaaaaaaagcctcagtaacaaactcgtacaagcattttgaaaggattcatgaatattctttatagcaagcttgtgtggttcattcagaagacagtttatctttcataaattaacaaagttttaggaacagattttataaagtacgatacaacctccaaatccatgaacttttctttgcaaatctttaagtctatatttcatcaaaagtaatgcctaaaagaaatgtacagaaacaagcagttaatatgattattactttgaggtttattgtagatattttctgtgattcatttttcaaagatgggatggttttatgcttaatatttagtatttgagttttttacttgttaagtctttgggcacctttttatatcatcaatttatatttattatgtctttattacctttttcttaggattagcttgatagatagtacagtgttaacttgcagaaatataaatggtattctattttatccttcctaggcttgatgaagttcctaaagtatatagttgtctgaacaacaaggtaaaaatagacaattctccataaaccatactttcatgatgagaaaatgatagagtttagataattttcttaaacataattctgctgatttttaaaggggttattccttctttctttctttttttcctggagacagcattttgctcttgtcacccaagctggagtgcagtggcaggatctcggctcactgcaacctccacctcctgggatcaagtgattctcccacctcagcttcctgagtagctgggagtacaggcacatgctaccacacccagctgattttttgtgtatttagtagagacagggtttcaccatgttgggcaggcttgtctcgaactcctgacctcaagtgattcgcctgcctcggcttcccgaagtgctaagattacaggtgtgagccaacacgcttgtcctgttcttcatttttaatggacatttaataacaccatatgaacacatttatagggtttttttttttttaaggatttaatactttaaattcat

SEQ ID NO: 96525 - DNA, 2268 bp, Homo sapiens
tacaggcatacaccaccactcctggctaatttttgtattttttgtagaggcggggttttgccatgttgctcaggctcgtctcaaattcctgagctcaagcagtctgcccgctttggcttcccaaagtgctgggattacaggcgtgaaccactgagcccagcctagttaatcaactcttagctcatccctttgtatatgatggcgattggacccaaagttttctaggtgaacgtatgtaggtaactatttatcttgttataattattacaaaaacataatttcttttgttaatagaaaataagttcaaaattgaactgtaatattaataaccaaagcaaattcacctgataatttgtcgagttataaagagggatatatatttaaggcaacagtgggggttagtttaaaattgtcttaattttaaaaattgaaatagcaacatatattctgtgagttaatatttagtatatgttttgcttttattttttcgtttttcctagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaagtatgctaacaacaaaacttatatacaactaactattctgttgtgatcatataaattgatactttgattcaaataatcttttcttatggggtattgttacagaggattccttagttgaaatattaccatttggaatacatgataattattaaacattatttcaccttttcattggtgcttagaataatcttgatttcaggagccaagaaaagcagtttaaattatccttaataaaagagacaaggaggacaggaaatagatgattttttttttttttttttttttttgagatagagtctcactctgtcgcccaggctggagtgcagtggtgcgatctgggctcactgcaagctctgcctcccgggttcaagcgattctcctgcctcagcctcctgagtagctgggactgaaggtgcgtgccaccatgcctggctaattttttgtatttttagtagagacaaggtttcactgtgttagccaggatcgtctcaatctcctgacctcgttatctgcgtgcctcagcctcccaaagtgctgggattacaggtgtgagccactgtgccctgcctggataattattaaagctagacatgaatactttatataatattctacttcttattggaattttccatgataaaaatttggaattcagaaaagtacagggaaaaatataaaaattgcctaatttttctcagttttatatacacatagtaaggaacagtctttatttaaaaataaagatgtattttgctgctctaaaaattaaagtgctgttgttaacagatcatcagtgttcaccagtactacttgacttaaggtatatattttatgtacttttttaaagaccagtactaacacaagccaaacaaaaatttctgctcctgttgcctggtttggaaactgttgaaatgatggaggaatccagtggaccatattctgatggagtaagttggggggttttattgttcatttgtttttggacatttaagttatttgttgaaagttataaataagtagaacctgaacagaaaagagttttgtaacataggctttttccacattgtcagtggtgtggcctgaaatttcttttgtgatttttcactagagattctcatgtaaataatctctaattcttgtcattaatcatttgttttgaactcgggtacctcatctgtgctgttcacaaagagtaaaatacataattgttgctttggaaaaactggaaataatggttactaagccatatctaagccagagctgctgttcattttcttatttttaaaaaattgattttctcaattcttctatcaggaaaataaatctttgctgtcacatggcattaggagcaaagtttctttggctaataatatttgattactgcctgaagatatagtagttaaaggcacgggtactatagacttgtgagctagagtgttcttagaaaacctttttctattcaggagcagctagggtatagctaattttgtttagaatctttgggagaaaaaagactgttatagccaactaagtatctcatttgcttttggctgaagtaaaaattt

SEQ ID NO: 96526 - DNA, 2660 bp, Homo sapiens
gaatgtggtctgtaaaagctatatattctgttgaggggaaatatgctctgtcatacatgctttattaaccctcagttgtttaatgtttaaagttctatggctttgaatattctcttagaaatattttcagttacaggtagagtgtttgaatgtagtaatttaattcactttatgtgtttatgtgacatgtctcattttcagaattcataaaattgaatggtattaaacagctactattaaagagacaccaaagccatttgctgttgaattagacagtggctttcctttctttgatttttatgggattgaataattagaaaaattttgacaatatttgcaattactatttattaggaattttcaaaacgtgaaaaggaaaagcaaaatattaccgttctatttaatgaaattgtttcatttttaataaaacagacagaaaattcacaactaaatgtgaagataagtggcatggagagaaaatcaaatggaaaaagagattcatttttggcacaaacaaagaataaaaaagaaaatatgaaaccagcagccaaagtatgttttcaaaagtttaatcaaaaattttaagataaagtatattgtaacttacatacaactttaaaaattggatgaaagaactataaaagactaaataaaggttgggattgcaggggaattgagggcatttgatgtagaaagactgctaggatagcatggtaacccagaagccttgggtgatgattcctgtttaggaaaggtaagtttctgtgtaatgcttagcaactgttacatgtagttattccaggcagcagcccccttgagatggaatgagactagttatgaatgactaacataggtagcacaagagaaaatattttagaacttttgtttaggattattgttattttagaacttaatattttgaatagaaataaataatgcctagataagacacctatgttcttatcaactagctcatgctagttgccagttaacttgacttttagacaacagttctctcttccatgacctccagtaaaggttattctagaatcttgagaccatggccctggtgaaatgaaagaaaagtgttattttttaagaatacctctgccacattcttgtagcaactataaatagaattaaagcaatggttccaatgaacatttattaagataatattgtagtaccaaagttacttgtatgtagggcattttgtattggcgactttcactaagtcatgcctcaacttgagagctgcaaatatactctcctcctgccaaatcagttcatttccatgtgttagcctgacagacggttttgtccatactttgtagttaagcacagacttccctacttcgtaaagaggtttaatactgtctactttcttagtatttattagaggcagaaagaaagtggggaacattgtactaatttgttacggatcatgagtatcatcaactttcataatcactattgaaaaatggtgtcattattagaggagagtgatagaaatattggaaaataatttggaagctaaaatgtacatttgcttattttttcaaatctgcagctgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtttgtaggccttttatcttgagttgggtatttggtattcaggcttagatttcatgcaagaaaagtgtaactttgtgtttagaactaaaatatgtgtactaattttttttttttttttttgacacggagtttcactctgttgcccaggctggagtgcagtggtgccatctcggctcactgcaagctccgcctcccaggttcacgctattctcctgcctcagcctcccgagtagctgggaccacaggcatgtgccaccacgcccggctaatttttttgtacttttagtagagacggggtttcaccatgttagccaggatggtcttgatctcctgacctcgtgatctgcccacctcggcctcccaaagtgctgggattacaggtgtgagccaccacacccggccacgtgtactaaattttaatgcgaaaagttatactttacataaatgcatttcataatgtataaagctacctagtaatgtaccaaatatttataaactgaatttcttctctgaggtgggaaatacgcatttaggtcatgattttataacaatttagtagaactgtaattttcgtttctttttatgttttgttttatgttgttgagacagagtctctctctgttacccaggctggagtgcagtggcatgatctctgctcactgcagtctctgcctcccgggctcaagtgatcttcccgcatcaacctcccaagtagctgggactgcagatgcacgccaccatgcccagctaattttttattttttgtagagataggattttgccatgttgcccatgctggtcttgaactcctgagctcaagcagcccacccacctcaacctcccaaagtgctgggattacaggcgtgagccaccgtacctggccataagtttaatttctaattgtaagaatatcatccggtttttgaagttacttatat

SEQ ID NO: 96527 - DNA, 4455 bp, Homo sapiens
aaaccaaaggaggattctaagatgatgattacggtatgtttgacatttcatattttgggctttttagaatcacccttccattatacagtctgttaaactgctgaaatgtctgtaggtcttccctttattaattttaaaatttattgtagatttattgtatgatttccttttaactcccattcagatactagcagaatatcagcagacactagtcagtgtgtgtgtgtgtgtgtgtataaaataaatgtacttggcttttcttgaatatttacaattaggaacacaaactgttaggtatctaccactaactttggaatagttgccatatattgaatgtcagtgattatctttgggttaccgaagttttacactaaagttttcccagaaagtcaaactcgtttgctggttattaatctgtgtgtgtatatatatgtatatatttctgtgcaggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggtaaggggaatgaggctaaatattaaggaacccagtatttggttgggatattttggccatacagtgacctctggtgaatgacaaaatattacaattatatggccactcatttgattatttaccataatggttgctagggaaaaggtaggtagaagaaaaggtttcgaaaaaaggagactgaagccttttagataagtctttcattttacaacactaaagatctttatgcagctgtgcacattgttcacctttggcaaaattgataaggctcctagcatcttttctgctccccataccataatatcatatgaggaaacagatttaggaatgcaggcaacactgccattgataaagcagatttagtagttgtgtgttggaacattatgctgttttacgttttacatacatgttccagaccatatctaattaaaaaaaaaaactcatgtgccttcatcaacttgtagatgtgatcttatttagttatttatatccccatttcctcagctaaattatagatcttttactttagaaaagatggattatctatatatctgctttagcttcaggccttgtgccttgcacatagtttgttgaatgaatgaataaaaaaataggaaaagttaaatgtatttacgtaactcaacttgtcttatacttaacaaaatagatatcctgaaaaggtatgatgttggcattccttaattttgaacttgaacctgctattcattgtagaatacattttatatatacaagcatgaatatatagac

SEQ ID NO: 96528 - DNA, 1008 bp, Homo sapiens
cgagatccacccgccttggcctcccaaagtgctgggattacaggtgcgagccactgcgcctggcacatttctgtttttacatcagtcttctttctagtctggtaatcccataaagttcctagaatcagatcgtacacttttaactgccacatctggcttcgttaagtttttgttactgtgcctttttcacaatctttggtattatgcagagacagtttaaaatatagaaaattagagtgaattgtggtattgagttaatgtgatctgtgaaggcagtcgctaggaactgtgcagctgacttctggtgaaataaattttctaaacccacattctatttttgggtaacctcataatgaaaatttatggtgtaattttttaaaaactttaattttgttaagtaaaatcctgacctgtgttttcaggttcgccgtgtctcctttgcagatccaatataccaagcaggattggcagatgacattgatagacggtgctctattgttaggtcccattcttccaatagttctcccataggaaaaagtgttaaaacttctcctactacacaatctaaggtaagctataggctttaaaatatacatatatgtataccgacacagaattacatgtacatgatgtgtcataaaatgaactatatatgtgaaaaacttcttccttggtttaaaatatattcttttgtctggtacacggtaagcagaaaggaagagaagcagaaaggtaagaggcagtaatgatccagcaagtaattgattaggtagtagattactctttttatgttttttgaacttttaaagaaatgattgcagtctaagttgtaaaaattgtgaaattatagtcatctagggttctgagtgtttttttctctcctttcttctatctagcataataccacttcagccaaaggatttctgtccccaggatcacgtagccctaaatttaagagctcaaagaagtgtttagtaagaagtgctttagttttcatgtcactttata

SEQ ID NO: 96529 - DNA, 1053 bp, Homo sapiens
tgatgccttgagatagtttctctttaactgaattatcaagctgccctgtcgtagcataatccccaataggagatgaagtattcttaaacttctctgaggaatttaatgatgcagtaatatgtatcagacataccaagtccatttctgattaaagttggggaggggattatgtgtacttaagaattatctattaatgagatgtatgtagaagcacaaggcacgcagtgggctcattcagttgccagtactgttgcttataccagacatacacatcagattcgaattttgttttaaattacacatacatgtgcctgtcttcactgtgggctaacctcagttatgattgagcttaaatggggaaattgaactggataaacccttgcaaatagcatataaataaaactatataattataatttcctgtttctgttttgtttagggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtaaaaacttagatattagctatgatgtatattaataaatgatgtagcagtacagttacagaagtttgttaaaagatcacttcataatggcacagggaaattgattcatttattttgtactgtctttatgcattgcacctcagataaatttttaaattgttttttcattaaattctgttcatccccttctctctttcatttccaccattcggtatttgattccatggctgctactgctaaaacctagatgttcaaatccaaacatctaccaaaaccatacagatttgtaggtcacagtattttggtttggatgcctaccacatttgtgacttatttttcttatttttcctttttgtcagtattgtgcatatgaacattttgggtcatgggcatttttcaagattctgatgaaagctaagattcttccctgctgtaaaactatatagaaaattttgtatat

SEQ ID NO: 96530 - DNA, 1079 bp, Homo sapiens
gtatcagaagttttgaataaatgaaaaatagaataagcagtgttctgaatcagaatttctcagacctggggtttgccagccactgaagacttctgctgtattcttgaaggtccttgattttatattaacttatttgtgatcttctaaacattcattaactggttactcagaaaaccaatactactagtaattttctgtctcacagattgaatttagtttctaaagtattttcttactcagtttccatgggtcttgggaaagtctatgagaattaggttttttttaacagcttcattaagatatgatttacatcgtgtaaaattcacctaccctatgggtgcagttagtttttaatatattcacagagttaaataatattccccatgatctaattttgaatctttttttttatcacccagagaagaaacactgacccattagctatcactcctcatttccactgtccagccaatgcctacttttcctctatagatttgcctattctggatatttcataaaagtggggtcgtacaacttgtgatcttttgtgaatggcttctttcacttagcataatgttttcaaggtttatcctcaaaaatttccgttttgaggttgaataattctttgtagattctggatattagccttttgtcagatgagaagattgcaaaaattttctcccattctgtaggttgcctgttcactctgatggtagtttcttttgctgtgcagaagctctttagtttagttagatcccatttgtcaattttggcttttgttgccattgcttttggtgttttagacgtgaagtccttgcccatgcctatgtcccaaatggtattgccaaggttttcttctagggcttttatggttttaggtcttacagttaaatctttaatccatcttgaattaatttttgtataaggtgtaaggaagggatccagtttcagctttctacatatggctagccagttttcccaacaccatttattaaatagggaatcctttccccatttcttgtttttgtcaggtttgtcaaagaccagatggttgtagctgtgtggtattatttctgagg

SEQ ID NO: 96531 - DNA, 7724 bp, Homo sapiens
tcatatgttgaaccagccttgcatcccagggatgaagctcacttgatcatggtggataagctttttgatgtgctgctggattcgttttgccagtattttattgaggatttttgcatcaatgttcatcaaggatattggtctaaaaatctctttttttgttgtgtctctgccaggctttggtatcaggatgatggtggcctcataaaaagagttagtgaggattccctctttttctattgattggaatagtttcagaaggaatggtaccagctcctctttgtacctctggtagaattcggctgtgaattcatctggtcctggactttttttggttgaataatatgcattatatgtatataccacattttgtttatccagttgacagacatttgggttgtttccaccatttgctattacgaataatgctgctgtgtctgcaagtttttatatggatagatgatttcatttctcttgtatatatacctagaagtggaattgctgagtcatgtggttactgaacttattattttcagaaagttaactttctgaacttagtattttctcaatcagtggtccatacgtcctaggaacacttaagaaaattgtatccttttttttttttttttttttttaaatacagtgtcactgtcacccaggccagagtgcaggtggggcatgatctcggcccactgcagctgcacctcctggactcaagcagttctcctgcctcagcctcccgagtagctgggattacaggcaccgtaatttttgtgttttttgtagaagggggtttcactatgtttgccaggctggtcttgaactcctgacctcaagtgatctacccaccttggcctcccaaagtgctggaattacaggggtgagccactgctcccagccagaaaattgtgttcttttttttaaaaaaattctatattttatttaagcttggaaatctctggtatagacttttttataccacattcttaaacttgggaaatagaatgtaattttcttagctgccatggctatatttcctgagaaaaccattatgaaatattgttaaattctaaccctctctttgaggaaatactttgtaatgctttattttgtgtagttagaacctactttcttagcagtattagctcttaattgtgatgggtggtagaacataggttctatgcaatgttttccagtgtttgtactattactcctattaaaagtaaagtttcaatttgttgttgttgttgttttgcgtttttttctgctccaactgtaatcaaggtgaagactcgtggactagaagagattccagtttttgatatttctgaaaaaacagtaaatggaatagaaaataaatctttgtcacctgatgaagaaagacttgtctcaggtatattttagcaaaagtgggataattttatttagaagatcagctgactttcttgaaatatgttattttttttagtctgatttgaccatgccttatttcaacaattattttatgtttaatgtgaagtatatgaaaaactaaccgattggacatcaaatgtgtctacttgtttttcttgtcaacttctccatcaaggtctcaaggatttaaactatacactttctcttctagttatattaataaatgaagtagtctaccatttttaaatttctttaatagcacagaataatctatgagaatagcacagaataataagcagtggtaggttgggtatggtggctcacgcctgtaatcccagcactttgggaggccaaggtgggtggatcgcttgaggtcaggagttcgagaccactctgggcaacatgaaacccagcacctactaaaaatacaaaaaatagctggatgtggtggtgcatgccagtaatcccagttacttgggaggctgaggcgggagaatggcttgaacctatgaggcagaggttgcagtgagctgagattacgccactgcactccagcctgggcaatagaatgaggctccatctcataataataataagcagcagcggcagctctggtagatttttttgtgtgcttgtcctcatgaagacttaagcctgctctctcaatttgaaacctaggcacttggactaacttaaaagatcatgtaaaaaatttaatttttgtctggtatagatttaattgtggttttttttttctcttttagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcataataacactcaaatgtgtcttaattgtcttatgcatatttaagaagaaaaaactagtggcatacaggattgtcatgtagtatctttttttttttttgagacacagtcttgctctgttgcctatgctggagtgcaatggtgcgatctcggttcactgcaagctctgcctcccaggtttacaccattctcctgcctcagcctcccaagtagctgggactacaggtgcccgccaccatgcccggctaattttttatatttttagtagagaaggggttcactgtgttagccaggatggtcttgatctgacctcgtgatccgcctgcctcggcctcccaaagtgctgggattacaggcgtgagccaccccacctggccattttcttttttttttgaggtggagttttcgcccttgctgcccaggctggagtgcagtggtacgatctcagctcactgcaacctccacctcctgggttcaagcgattctcctgcctcagcctcccaaatagctgggattacaggtgcctgccaccaccactggttaatttttgtatttttagtagatacggggtttcaccatgtcagccaggctggtctcaaacttctgacctcagatatccacctgcctcagcctcctaaaatggtggcattacaggcgtgagccaccgctcctggcccatcatttccatatctatgaaatctattttggattttagagtggatttaaattttcaatatttcagtgacctcattgttaaagctgctttgccacttgtacaagtttgaaaaccattgttgaatcatatggagctttactctaattccaaatagttaaaggatgaatcaggttaaataatgctgttggataatacaggcaaaaacaggatttaaacccgcacattaaaagcatgactgaaggcccggcaggtggatcactttggcccaggagttcaaaactgacctgaacaatgtggcgaaatcctgtctctactaaaaatacaaaaaccagccaggcatgttggcgcatacttgtaatctcagctactcaggaggctgagacatgagaattgcttgaaccttttaggcggaggttgcagtgagccgagatcatgccattgcgcgacagagcaagtctctgtctcgcaaaaaaaaaaaaaaagtttaattctaacattgcccatggatttttttttttctgtacagcttgaagataagatagttaaagactctgttacaatttaaacatcataaaaatgtgaagagtaagtggtgaggcaagaaacaaaattgggggaaatggtggggatcgtgaatatataagtgaagttttatttttttaaggtgtaaaggagtgagaatagagtaattgctttttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagatctgcattgggccccgtgagtctttttaaacacagtcccaggtgattcatgcagatgcctgtgaactgcgctggtagatgggcctaagaggcttcaggctgtgttttaggttttggtaagccaggcagattcaagtccttttataactgtcaattttgtgaattggggatgcagactggttttgaaggcttaaagttcaaaaattataagaaagttaagaattttgcttaagagccttttaaaaatatggacgatttattttttaagtaggcagactaagaatttcaagttataaagaatcttattgataaggcaaagtagacaaagtattttctcatgagtatttgtgggttatgtttttgttaatataaaagttgatttctaagtattagaatatatttagtctctaaataaatcttgccttctattatggatcatcgttattaataaacatggaaaatcaacactacccctaatattaatctggcagttaaatttagtagtgctataatgaataagtcagtctagcagatatgccctgtcattatactgcggacctctggtcacttaattttctgttatattatgtggttgaaaattcctgtttcatcgtaaagtgaaatttgaaagatggagttgaataatatgattctcgaaaagtgagtttttcttggaattctgttaaggtgttagattttcctcacatatttaaataatctgtaagaactaccctgaaagcactaaggaaaatgtagccgaaagttaagtaataggttttaaaaatttatcaaaatttattgatagtttgatctgtaaaacaaattgggtttcgtgctttctgatgtccagttaataagtatattatgtgccaggctttacatattgctctttgcaagtagccgttaaagtgtaagtcattgaagtttgaagatctataaatatttaatatagtagtctaaacagttgtgagaatttactcagttctgaaatagaatgttaaattttccgatgtggtcctaatcatttttttctttacatactaagccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgag

SEQ ID NO: 96532 - DNA, 2301 bp, Homo sapiens
cacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgagggggggcagaattctatgtttgattcacagtaaaacttttcatgaatcattgagggttaactgttatcacttgccaatggaaactggatattgaaacatttttttaagaaatgcacttttacctgaaataaaactataaaaactaaactctggtacttgtttttgttggctacattttggttttttgttttgttgttttcgtgagatctgaaatgagtatgaatagtttaattcaaataccacaaagtgtatgttatattcctccacaaacatgaacccttccttttctttttccccttttatggcctgctttttaaccacagaggttttctgatttatgcatagttttatgggttccactggtttctaaatccagaggtggtggtttttctgttgttgttgttgttaatgagttcagtttctcattgaacttgttagaagagaggtttcgtcaaataagggctgagtagatgcaggcaagcttggagaggcagtccacatggtgtgggcgagggcagaggtggcactgccaggctagtcaccagatgaagtaaatgcctcaccccaacatgaccttaacttcctctgcagaaccaagcatgttgatggcagccgaagaaaagctccatagttttaaggaaaacaacaacaacaacaattagggtaaacagtgatgttgaaagacactgtattagtttcctagggctgctgtaacagtaccacaaacctaataagttaaacaactgaaatgtattgtctcagttttgaatagtagaggtctgagatatggtatca

SEQ ID NO: 96533 - DNA, 1019 bp, Homo sapiens
ttgggaggctgaggtggtcggatcacctgaagtcaggagttcaagaccagtctggccaatatggcaaaaccctgtctgtactgaaaatacaaacattagcccagagtggtggcgcacgcctgtagtcccagctactcaggaggctgagacacaagaatcacttgaacccaggagggagaggttgcagtgagtagagattgggccactgcactccagcctgggcaacagagggagactctgtctccaaacaaaaaaatggctcattgtaatggagatagcatatactttagtattctaaaagtttgggagttggaaatcacaataggattgttgcctacttgcatttttatccagtttaaggcaagatggaagacttgggagcaggagagtagcaccatttggcaccatttggatggttaagcataatctgccttttcttgggtctgcaaattccctaagggcatcaactgtctcttgttcttcacttgagcttcagcctctaacccagtgcctggcatagaggtgtacgttggtcattcgcaagtgagtgcgctctcttcacaagagcattttctccctgtgagtctcagacacattaagaagcttgaggcagcattactacggctgtaaagttacagggacttacctaccttctaggaagaacagtctgtaaacttaaacattaagccattatggttgcttcttctccctttgcctttgccacatgctgccatcctactggatacagatgggaaagatgcccttgaagttaggattggagtccacagatgttcttaaaactgtaatagaagcttgctgaatgcaagtatagatagaattttgagaatgtctactcttaggcataacagtacattttttaaatttagataattttttagtaattttatgtacaatttgcttcattgaatttttataggtagatattaaaaccattaaacataaataatgctcattccatccacagagttgcagaattagaggttttattagttgctggt

SEQ ID NO: 96534 - DNA, 1051 bp, Homo sapiens
ccaaaggaaaaaagggtaaatttgctaaagaaatttcacaaaatttaagttgtctttaaaaagtaggattaatatgtattattttaaatcataaaagtagtttttaaaatcagtaagtagtttttttcttttctcgccaagtaccgagctaatattttcttgattgtgtttgactcgctccatctcgggagtgacagctaaaggagttcccttgcccatgttttctttgtataacacctgtgcgatgagaaagcatccagaaaaacaaccatgagtaacatttcatttgttgagaggttttaagggtaaggtcaacttccttgttaagaaaacacagtcgtccaaggagccagaagttatatgctgacaaaatgccaccagctactttagtggaagctgttgttgggatggggaatctgcaccctctagagaagcagggacctcagctgctggggaaaggctgtcagagttatccatgttattttttttcatttttgtgagtacggtgcctcctaaacaatcacatgaggatttgagactgttagaactcagtgttgttatccacacaaacggaaaaactcatttttaaaaaatgattgaaaatatcagatgaaataaaaaatcaaaattaactgtattatggaaatggtgttaggctagaagtagcccaaaggaaaaaaggataaatttgctaaagaaagaagttcacaaaatttgtctttagaaaataggattaatatgtattattttaaatcatgaaatagtttttaaaatcagtaagtagtttttttcttttcttgcccaagtaccgagctaatattttcttgattgtgtttgactctctccatctcaggagtgacaggtagaggggttcccttgcccatgttttctttgtataacacctgtgcgataagaaagcaaccagaaaaacaaccatgagtaacatttcatttgttgaaaggttttaagggtaaggtcagcttccttgttaagacaaaacacagttgtccaaggagccagaagttatatgctgacaaaatgccaccgacta

SEQ ID NO: 96535 - DNA, 1116 bp, Homo sapiens
tcacagtttagtaagtaaaaatatgaatacaggcagggtataagcatgatcagttaacattaaatatcaaatgaaagcttgaagttaatagaatgctaaggtaatattcaaataaaaaattagaagaattaacatgggtaatagattaggtggtagtaccaagcacatgagaacccaatttgaaacccacagttaggtggtgatgtaaatggtaggaggaacacattaatgagtgtcactagtgcaattatttggattaagagggaaagaaaagaccaagtgggcactacctcgcttgctattttagttgcatatttgacatgtaacaaagctggcgtgacctccaggccagtcaggtttctgcctttaatggactcttcataatctttcctatattctttctaatgtaagtaggaaggaaagacaagttaaaaaaaaatctttattacaatatatctctccatctcaggaagaaaaaaaaaacagcattttctatgtatgggctcttaatcatagttctgctaatggtcacacatttgaaacatgtatgattgtacttgaaatactttgtctggagcaaatggccacaaggaaattcaggctgagacactttgatgggcccctcactcatcagtctaatgttgtgactggggcaggcccttcacagagtggaaggatggatgcaccatcaggactctgaatcctctgttgtctcttctgaactttcccacacctttcttaaggtgacaaaagactttatttcagaattacaagtcagtgaggcaaggggaaaaaaatcgcagtggaaggagagcctaaggctaccaaatgctaacttgctttttttcctaatcatgacctgtttttttaatatggggtcttgctatgatgcccaggctggtctcaaactcctgagctgaagtgagcctcctgcctcagcctgctgagtagctgggactacaggtgtatgccaccacactgagttttgacctgttttttaaaaatcactgaatagcttaggtgggcagtgaggcacagaggaattgtatggttttgtccactctgcctccctgccccatctcctctccagtctccagacttagctgactcacagag

SEQ ID NO: 96536 - DNA, 1066 bp, Homo sapiens
gtttgtttttaaattataatgatatgaccttgtacatttaaaaacattaactttttgcattaataagttcttgttacatctcattactcttagagattccactgtttttttgttggtggtggtgatcccatatcttagtttcaaatacttatacaattccattaatttataataaaatatgttacataggaattttaagtttaaaaacttttaaaaaataatatttgcttttcatcagtcatctgaccctcttgtgttttcataattctaacttgttctgtcacttgacattactgcattatatcttccaaaagattggaatcccatgtttgctattgctgaaagtcagtcactcacgacaaccaaatgtatatcccaaacctatttcttcaaacagatacctgagaggacaaggaaaaagaaggtaggatctgtaaattggaggagaaatgagatattcttaagctaaagtcctataggatcaaacttgcactctgataggtctggtggtagatgatgggatctctgagctaaagtctgaaaacctgtcataacttggggaattttagataattggcctaacaagggaaaataagtcatgtggtaactgggtttgggcaacacatttctgagtccatttgcttctcaataatatgagatctgcaagaatgtggcattctccatcagcaccctgtgcataccctgatcaaacacttgccaaacaaaattttaatgatttatccatggacaagtaatctgaagacatctgctcatccctacttcctagcccgggcagttaatatatgtatgtttaatgaaaaaaaaatgaatattttcatctggttggattctagaagttagaatttcattgctcttcatgttaaatctatcccaggtgactcaagtatgaatcagaccccgaggatgaaactcttaaggcctggggagaggttccagtaggatctcatgaactgatgtttttgtcacataaagatagttaagcacacagacacccagacaaatgcccataaatggtaaagtggagaacaagaaaggtctagacagc

SEQ ID NO: 96537 - DNA, 1160 bp, Homo sapiens
tggcgtcagtctgggacttagataagacccatattctagttcttctctgtcatttgtgtcctgcaacccaacactagaaccacctggcaatcttcggagaacctgggtagaggcaaattaagctcttttatttactatttctaccttttaaaaatatatggaaccatatgggactcatataataccaaggttactacagcattattgataaggatagagcaggcagagattactgaggcccaaagaggtagttttacctttctaaaattgggtagcagtttaataataggagaggccactcctaatcaacaatgtttccttctgttattaataggttagtaatatctgatatggctagattacatgtcctgtagcaaaacccacatttgccataattgccagaattggaaagccaataaatactgggtcattttaaaagtcagagtttaagattcacatgtagatattgatggtaagagtgaagctacataaaggaagcaaaaggcaactgacattatttcaccagattctacagtcaagtggcattgttgctgccaagagaccggtggttgatcacttacatcactgacatgcttggtcacttccttgacgtgaacagtgtcccgggtctctggtagtgttgtgtatgagccctgtgccaagtgcttcttgacatggtccttgtacttgttctgggggaatccatagagagctcattaaggcatctgcctggggcgttctcccaagagggaagcagaactcatgggcggctgggggttacctcagacaccaggttgctgacagtcttcgccagcaggatctgaggcgtgtcaggtacggcatggcaggttcctctttccttgacatgtttctctttgtatttcagcttcaggggcaggaaaaggggcatttctttagctctgctggatatcctacatatttttattacaccctcaaaccagtagaacagcagcgttgacaatactaaactcaataaaagatgtgatacttgcaaattttgggaaatattcaaaagggttttttccttatctctagcaagttgtggttttaataacaatcaaaatggatctcgtgatgaatctttatatagtcacacttacgttcacagcacgctcagatatgccatttgtccctcccat

SEQ ID NO: 96538 - DNA, 1055 bp, Homo sapiens
tctgtcccccctaattttaaccactgtgtcatgcatcattcacatgatctatatgcaattaagagaaaaaagggaacaaacattttctgagtaactaggagcccagcagcatgctagacacttatacattatcttgtttggttttatttaattatcacaattctcattatcattccacatatatgaaaagagactcggaaaaattagacagatgatatagagtcatacagcaggcaagtaacagcatcaggatttgaatccatgtctggctgactgcaagaccataattttatggataagtaaattaactgtcaagtatccccagaaaatgctgctgaagaattataagaaagggtcatatttttattcaggagagaattgagaagaataggcttctggtatctctcagctattttgcctgactagtattgtttgggcatttttttttctctttaaaaaaatgtgtgtttttttcctaggccatggtttagaactatggatatggctgaaatatgttatgtttcttaggtacttcaacctcagctctccccatcacaacagaagaaaaaaggaagggatgcatacatcactggcattccagtaagccctcttggctctgatgaggattggcgtatctggaaccggagtgtacttgtctttcatcttttcatattgaatcttgtactttttctgagaaataaatgcagaagagagagacaagcttaagtgtcttcccaatttccaaccaagccacctacaggtcttgtggaggggcacaatgtgttacacactttaagagaatagctctgccttttgtgttttgatgatgctgagcaccatttatagtaatgagctctctgatcagaggtagcaggggaaggttttaacaaagtatttttctttttacccagtgcctcagtgctgaattcccatcttacctcactgaccatgtccttcacgtctttagcatgcttcaaggctgtggtctggtttccagcgtgatgatggggtctctctttggtggcaagttcaacatacagatactgaataataga

SEQ ID NO: 96539 - DNA, 1045 bp, Homo sapiens
acatattttcccctgatttttgcgtgactgcatgaaatacagcttcgtttgtctgcggataacaggaagattctatagaatgatcaagcaattattttcattactccaaaacacaagttttataacacttaggaaagaagatgtggcatcccttacctgagtaaaacacaaccataattatcatggcccaaaagagaactgcttcttcaagtgcagtgttaatgggcatgaggttgcagccaggacaaccaagtgtgtgagtctgccactggccaggtgaggccaggcacatataatcaccccctgtgatgcctgagtggcaggcttatgaacctctgagcttacctgactctgaagcttctgccctcgcttggctcttaaaagatcaggagtatcaggaactgaagtaaagattgacttctgcttcttgcctgcagctctgtagaccagctagacataaaccaagttatcaccatcatttctgtttcatgggcatgttatgttctctgcagatgccttcactgcttttacatagaaaaggcaggagccctcccactgcaacgattgcagtttcttcccaataaaccaaccttttatttacctcctgcaccctccttttcttttttcccttgtgtcaaaacaagagacattctctagcctgtccaaaattcaagactcctgctgtgttcttggtcccatttgcagttgtcccttctagtaccctattccagcaactgtctccatctcctctgtatcttccacccttcctgttttcccaatcccctcttttcacctgcaaacagactcaagacctcctgtcattaattaagccttttccagtctctagccaatggccttcattcttcttttctcagccaagttgcctgtgtttcttctttgcctctcttttgattaatttctcaagaccatagtttggctcccacctacccacatcagtgaagtcacactcattgagactaccaagaacttcatgattgccatgaacacttctctgtagcaactgaagctgctcagtgtttcattc

SEQ ID NO: 96540 - DNA, 1086 bp, Homo sapiens
catgtgccatcacgcccggctaatttttgtatttttagtagagacggggttttaccacattggccaggctggtgttgaactcctggccttgagtgatctgcccaccttggcttcccaaagtgctgtgatgacaggtgtgagcccctgcacctagcgaaactcatttttctttaaacatattcaaatgaattactttaagacaaaaaattatttaaaaaaagacagcattggtgtgcgtttttcagtctgaaaaaatattaggaaaagtaacataaacatcttcatgattattagcagatgagattatataaggcatgagcctctaccacatctattctgcttttctgctttgtggaaaattgatggtgagaaaacataaattttgccccttcagttaaagtgcagcaaagacatgaatgacttttactttatgagatatatatttctttctttttggtttaatttatttttcctttaacagagattatacaaggaaaactatgagaagacaaaggcaaagagtatgaattactgtgagaccccaaaatatcaacttgatactcagctgaagaacttcagtgaggttcgaaaagccacggttacctttcgggtaggagggctttcctactgtttgacaaatgattgttaacttgaattacatttgttttatttttcaggctagatataaagacttatatgtaaaggatgttttgggacattatgtaggcagcatggaggacccatatcacacacactgcatgaaagttgcagctcaaaacagtgatgtaagtttgaagacaatggttcatgcctcacagtgacattgtttgagagccataacaatcatgatctatttttggtttttctcattatagaaaagttacaaagcagaatatgaagaagataaaggaaaatgctatttccctcagacaataacacaagaatatgaagcaatcaagaagctggaccagtgtaaagatgtaagttagctgccctgaattattgaaattgagcttgggattcctgtgacatctagtggtaaatttagcaggagtttacatgctaatatctagtgattagaaggag

SEQ ID NO: 96541 - DNA, 1006 bp, Homo sapiens
atttaaagaattctaatattggcatctatatgctatacacactgcaagctggtcttctgatggactccacatctctgataatgctctctaatgagcaaagtccaaatcactacctcaagccagtggtgagaagatagcaaggaactagaaaagctacatagaaaccactggtttggaaaccattgtctataacaatagttacaaagaaagtttagaataacctccaggacagagatctcttcactaatagtaaatgaagatacaggagagcaaaggatacctgagctatggggaagctgaccttgaaagcaatgaggtccagattacatttggagagtgggagaggtcaaagttacgaggagaaacttgtctctacccagccttgaaaaagtgattgatgacaacatacaactgggcagttgagagaagactggagtttggagataaccgatgatgtggtattatctcctgtatacaaagcagagcctattacacgtacattcccaaaaatgcctccagagaaaactagaaagttgtctatagattttctatttacactaatataaacaggtttggaggttgtctgtactgtatgtggttgctgtagtgacaagaaatgtaaagtgcctatacaagagggaacaatagagtcctatttctaggcatcttaatactatatgctgagacaaaaaggaaaacaatgtcagggacttcatgcctttgctcaagctctgtgcatttctctgggtctcaaatgacctactaggcactttttaaaggccagaaaataaaaactcttcttccctctatttcatcccatgcttctaaagtcactttcactgcctatattaaaaatgccagccatcagtgctaaagcacttttatattcttaaggcaaaatgtcacataagaaaatgaatcccctatccacttccccactataacccctatacaacctgccttcgttgtatcctttgcccattatgaggaccaagaggtactggga

SEQ ID NO: 96542 - DNA, 4205 bp, Homo sapiens
aaatttaatattgtaacatagttttttatgtctgcaaaagcttgtcatagataatagttaatacttataacagttcttcattttattgcaacttaatgtgtacaaccatttctctcttgctcaacttttagtttcttttcccacagtgaacatcgttttctatattttgggttatgttcaattaccagttgttcagtgataactgatgttactgataagaaattttattgccttcaaaagttttacatacttacattttataatatttatgtaacatgtgtatactttgttttaataactacaatatatattttgttgaatatcctgccatttttcatttatatcatgagcattttatcctattataaaatggttttatttcctccatttcctggtgatgagaattatgaaatcattttttaaaggaaaattttaaatatttcatcatacaaatgtcttgtaatttatttttttctgtatttttagacaaaaattattttcctattaaaagtactttaatgaacagttttgtatgtaagtctatgtttatgtctgattttcttttttgggatacatttctagaagtagaaaaaaggatgcagagtattgatattttaaatatttttgatacgtattgccagatatatttttgacatatgttgctttctgtgggcactcattgcataattataaagcttttttaaagtgtcagacagcgttctgggtgctagagatataactgaaccaaaagagcacagatgtattagctgggtgtggtggcacacgcctgtagtccctgctgctggggaagctgaggtggggagatcgcttgagcccaggaggtcacggctgccattgattgtgccattgcactccagcctgggtgacagagtgagaccctgtctaaaaaagaggaaagacaaaaaaagcacagatgtattgtgtatgagaatatggcttcactgcagcagcccaagcactgaatattattgatttttaaatctttgttatttagctaaatgaaaaatgctctcttttagtttgctgttcatagtttgctgctcatagcttcttagttcagaatttaatcaaatgattttgttttctttatagattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttttatgtagtttaagtggaattaagcagagggagatgcttttgggtttttaatatgccacttctgagtgaaaacatctcgtggagtcattgtgttcagctctgagaagaacaaagattcatagttctgtacatgtggctggatttaaatatcctgtttttgatactaattttgaaagtcatgtaacttcttttgatatctgggcaaaagtaaccatatgctataagcatttgaatatgtttaattttatcataatagcatctgtaaaagtacatcttacacattatatagagggttcttgtttgaaattttcagttctctttatcttcccagtacctcttggtcctcataatgggcaaaggatacaacgaaggcaggttgtataggggttatagtggggaagtggataggggattcattttcttatgtgacattttgccttaagaatataaaagtgctttagcactgatggctggcatttttaatataggcagtgaaagtgactttagaagcatgggatgaaatagagggaagaagagtttttattttctggcctttaaaaagtgcctagtaggtcatttgagacccagagaaatgcacagagcttgagcaaaggcatgaagtccctgacattgttttcctttttgtctcagcatatagtattaagatgcctagaaataggactctattgttccctcttgtataggcactttacatttcttgtcactacagcaac

SEQ ID NO: 96543 - DNA, 1060 bp, Homo sapiens
ataatgactctttacattattacaaaatacaaaactgtaaaaattttaaaataattttcaaagttttatcataaatgaagtatacaactttagaactcattaattttaaaatggttccaaacaccaaagtctgaaattttattcagaatgactcaacttctaggagttaccttcacaaatgaagtttttttttttgttgttgttgttttgatacagagtcttactctgttgcccaggctggagtgcagtggcaccgtatcggctcactgcaacctccatcttctgggttcaagcaattctcctgcctcagcctccagagtagctgagattacaggcgcccaccaccacgccagctaatttttttatatttttagtagagacggggttttaccatgttggccaggctggtctcgaactcctgacctcaggtgatctgcccgcctcagcctcccaaagtgctgggattacaggcgtgagcgcccagtccccaaatgaagttttaagaaacaaattgacaactatatatggtatatagaagatgctaagtaaatgtgtcttgcaattgctgttattcatctccttgataaaactaaaatatatcttagactagaaatttgtagcagaagtggttttaaagtgtttgaaatggtttatgtacaaaagatcaccgttgttcaccttatactttgacctcttgttaagtcacgttgatgaacagccttaatttaatatatctattttctactgttctaatatatacatatttggttttgaggttatataataaaaagcaaatgaagattttcttctctttctaaatatgtaaaaattgataaaataacttcttagaagtcaagaactctaaattaaagtttgaaccttttagatctagaaaaactgatttaagatatttggagaccttttattaaatggctttgttttttgtgtttttcaattttcagttcaggggcttctacaaataatttcatcattaagagtgaatacagattacttataataatataaaccgtgtgtcctaacttgtgccaagtatttgtca

SEQ ID NO: 96544 - DNA, 1049 bp, Homo sapiens
aattctataaacagaatgcttggaaaacatctagatttgagtccttatagttaatctttttgaaatatcacagtatgttaatacatagagagtttaagcagagtaaaatctgatttcctattccaaggtcattgttcaatatgtccactatcattgaacctctatagggagaattggtggttaattatgttctgattgtgtattgatctcagaacttgtctttaatagttttttttaatgacttccatctcatagtttataatttcatttctctctatttatgtttgactgagtttagctcaccaaatgagagggttttgatggtttgaatcctagccagttttactattttcttttacaaaacacaattgcacattaaataattgtttttcttttgattataaggcattttagacatagtcatatctttttatttacacattatttcccaaaggaaatttcagacctttgacatttgagtgcttcattgcatagacctgtgaattaaaagactgaccgttgtttttgtagtgttcattattacaagttaataaagcatggtttataagtatataaagctgacttttaagtcattaagaaaccattaagtgtatctgacaacttgatttcctaacactgcattaggcatttaatcattttttaataagggaagttatgtatgattataaaggtatatatgctactgtatacatatgctataggtttcaaattcatgccaacagcctgaaaattaacagttttattaaaataccttggaataaaatgggccttacagtgataaagccacctatcagtaagctgtcaagtgagaggagaggtaaagtagcagttctctcatacatctgccttttggttgatgaagtctgaataattgaaaagatccagaaaatcataataatttatttaaaaattaagatctaggtcccaaaaataaatagtgcatgttactaataggcagtcagaaccaacttgggcatcataaatgttatcataaagtaagtaagttaaatctccatctgttcctgctg

SEQ ID NO: 96545 - DNA, 1006 bp, Homo sapiens
ccacacacatgcacccagttgatgccttaagttccagttagaacctcattgatgtaatccaatgtgaaacatttatactttaagtcatttgtaaattgtgattatgtttggtctactttactgagagtaggcttgcctaggaatagaggaaatgtagtgccatggcttcctagagaggtggttggaaagatgagagttgtctctagaataatggcgatggggaaggtgagtataatggcacacttctgctggtcttgctaggatgttcttttgacttctgagaaagtataaagtgccatgcactgaattatgccatagatagaagggtgagatacagagtatattttttcctataattaatctttttttttccttttttgaaaaaaaatcactggtgttttctctatttcagagcacaaagttatcattgttgggctggataatgcagggaaaactaccattctttaccaattgtaagtattaactattttaaaaattattttatttctagttacttttttggcctgggtgatagtcgatcaatgaatgcagtaagaaattacatgaaacctaagttaccctgtaagaaagcaggttggctataaacctggagccagatctcagcaatagttagtagaaagcaagaaatttatatgatattgagcatatagttggcattgagttgtccacttgttttgtgctaaagctcttttgtttgtagaaagtagaaaaatatggccgggtgcggtgcctcatgcctttatcccaacactttgggtggcagaggtgggaggatcgcttaaagccaggactttgagaaaccgcttgggtcacatagtgagatgccatctctttataagatatatatgaatatatatatattttaaaattagctggatgtagtggtgcacacctgtagttccagctactcaggagactgaggtgggaagattgcttgatcctattcaggaggtcaaggctgcagtgaacctcatgccactgatta

SEQ ID NO: 96546 - DNA, 1267 bp, Homo sapiens
ttgcagtgagccgagatcatgccattgcactccagcctgggcgacagggcgagactccatctctaaataaataaatataaataaattaaaaaattagctgggcatacggcgagactccgtctcaaaaaaaaaaaaaaaaaagaaaaaaaaaaaaagaaagccgggcatggtagtgcctgcctgtagtcccagctgcttgagaggctgaggcaggaggagaatcgtttgaacctgggaggtagaggtttcattgagccaagctcacaccactgcactctagcctgggcaacagcgagactgcgtctcaaaaaagtcattggtgctttattgtgaaaatacaaaaaaactcaaatagagctacgtcttgggaggaagcaactagaactttgtaatgaatgtagtttgtaggtgtttgggtggagtaaggaggtaaagatcctctggatcatggattcttcattggaatggccctccagagatctcagaccacatgactacatgtggtttttttggatattttccaggttctgcttatgtttgattggagtttctttcctcctttttgtttttgaagtattttaaccatttggtaagaatatgatatgttcaaatatattagtttggtttcccttgattgactttagaaatctgcttaggtcttaagagtttgggggcatggttgcatatttatgcatttgtaagtatataggaattcattgaatttgtaaaataggtaggcagaagagtaagattgtagtgtggagaatggcatgagcaaagttaaatgattggaaagtttatgacatgttctagagactgagtagagcagcttttctaagttttagtacgtaggtcaagaagagttaggggaagatttgggctaaggcttagctagctttgtcacactcatcctttttcatcatgtttatctaatgatcttacctggatttagttattcactttcaggtgcagacagaaggttatgggtcctccaaagcttcagaccttggctaatttctctcctcttgttcatagccattttacctttcatctttccttctaccctaacaataacctaacctttcacctgctaggacttccggacattcttaaccttgtagggcaggactggatttctttcccggcccaaattccatggctagccacttcatttctttcttatcactgtctccgacacgcttttctctattaacattttccaccatgccagacatatggattctgtttttttttttttttttttttt

SEQ ID NO: 96547 - DNA, 1519 bp, Homo sapiens
atttattttctgctaaacagtgtggctgtcttatcaatagggtcacttttccgaatatccaccatttaatctaatgccagatatttgttgggttttgtttttgtttttgtttttttgagatggagtcttgctctgtcaccaggctggagtgcagtggtgtgatcttggcccactgcaacctgtgcctcctgggttcaagcgattctcctgcctcagcctcccgagtggctggactacaggtgcgtgccaccacacccagctaatttttgtattttttgtagagatggggtttcaccacgttggccagaatggtcaccatctcttgacttcgtgatccacccgccttgggctcccaaagtgctgggattacaggcctgagccatggtgcccagcagggttgtttttttttttttctgtataggacatatataagttagatatgtgttggatgctcttgttttaccttcagtggattcagaatgcaatcttactttcttttcatagaaactcttggaaagtatgtttcgggagattacagaatttgccatctgatgaaacttaaactatgcagtatctcctgtttctgaaacccctcgagaacagctttttcagttaaagctcagattgagtgcacagtgaaagctatttgtataccgctcgaactagaaaaaccagaggtcacatttagttgatactgagattcagtagagtacaaactttatcctagatgctgtcatttaaatcattttattttattttattttatgttttaacaatcttttgaagtagttatttcccctgaaaagggaaaactgaggcttaagtggaatgattttttttccccaggccatgcaactggtatatgccagagccaggcaagttaaaaccctgaaggaatctcttaaagaagagattgacatcatttttccctccctcctcctccccccattaactttttcagttgctaatctctaagttgtctttagaacttcgaaaagttgccattagtaacttttttttatagaagagcttgtgatcagtggtttacttgttctcaataaacaaatattttaacacctatttagtccaggaagtgttctacatggtgggataagggaacaaaacagacaaattccactgcctttatggagctttcatgtagtgttgggagacaggaaattaactcactttgtctctacaagtaaaataatagtggttaacacttgtgcaaggttcacacaggttgtttgatttaatattcacttagttgatttactctttacaacaaccctacaaggtagatattattccccttattttacaggggtacggaaacaggtaacttgctttaagcactataggtaaaagtgatagacctggattttaaccacgattacgtagtgccggagttatttctcctacgcacacacacctggattttaacaagattatctagtgccagagttagttctacacacacatgcacgcacgcacatttgcacacaacttcgtgtaagaa

SEQ ID NO: 96548 - DNA, 1103 bp, Homo sapiens
gaaacatttgttaaccataggtaactagcaagttactaagtgtaaagtgtgttatatagggatgcttaagttcagccaacttcagacatggccatgaaatacctatcaggcttgttaaaatttgttacaaaatgactaaaactggggaaagagaatacaattttaacccaaagactggatacttattaagatacagtggtgtacttttgtttctttttaactcaagttgggtggttcatcattccgctgtcaggaacttagtttgtgtttttctgttgtgtaagctgatggtgtcacgtcccagttttccaataaagacttacgtgaatggtggcatctattatgtacacctactactaccacctcctccttcatgatctagctgctcttttaagaagcttaggggaagcaagcagaactagaacttgtgatccctaatgtatcttttacgcacacacacacacacacagatgtgtaggtcacgtgataccgaaagaaagggcagtatcaatttttctgataagaggatttttcataaagtagagaaaatcagttctaatcagcactgtctctgactggactggctgttagtgttgggagcaggagagtgggaagcagtcacttgaactctcaggttttctggtctaggttttctcacctagaacaccagggatctgtggagcttccaaatcttgtaaactttatttctacattgcaaatattaaaacgtacattgctgtaagactgatggtacttatagtagataagatctattctagttttaacatccatcattttgtattatttttagcaaagctagtgtttcatctgctgtgaggtttagcaagactgtgaattgagctctagtgctgccagaaaaagagttatcaccactttctattttgagtcaatgataaaattatttgtttctgtaagttaagaataaatgagaactttgccaacagctccttggagtagtaaataataagggtgtgtgctctggtatcactacaaattgctaatagtagtgtttttataacctgtattttgtggtaatttttgacgggacatttatggcagtttggcggaaattaatagagaaa

SEQ ID NO: 96549 - DNA, 1037 bp, Homo sapiens
agtcacatggtttcaacctgtggagctgttacctaaggcagttctgagcagtgccgaatccactggccccataacagccctatctgaacaaatcccatcccataagacagtgttagattattttggtctataacatacttatacgcaacagtgctgttaaaggtttgccctcaagaatgaagaatctgatgttcttcctcaatcctgaggcccagaaaaagggaatttatttaattgtaacagcagagatttgtctcgaatcaagtagaattgtcgcatccattactgtacacatactactgaagttggttttaatagaaattgaatgcaaatttcaatctcaagtattcatggggtctgatgacatggcagagggtctggaggaagagcccagcagtagcaaaagtaatagctgaagagagagacttagccctggagaaatctgatatatttctccagcaggagaaagataggtagatattaaaggggtgaggggtgagagaatggacttgatttcaaatattaagaggccaggcagcagaatgaacaataaggagttccttggttgagtgtatgtggagactttgataagaaagaaattcgctggtagcgtcacactgactctgacatgtcttcttcgtggggaatatcgttaggttttgagctataacatcatgctgcattatgttttaccaattgatacaaggagagaaaaaaacaaatagtctttaattgaaaccagccaagagaacaatgacaaggaaggctttagcacagtgacacggcataaacaatatgttctaatggaaacctactctgtgtttcatgggctatgaatgcagtacgttagacaaaataggagaaagtcctattatttttcagaaagtacaaagaagggatctgttggctacgaggctttcttctttaatctgcttttcagatcttagtagaaaataattcaacaaattggatgaaagtccaacagtttgactattgcagaatcataaacttgggatttttttgataccttagaaatt

SEQ ID NO: 96550 - DNA, 1021 bp, Homo sapiens
tttgcagtaaaaccaagttctctggaattctttggtaaaacaatgattgcttaaaatgggaaaggcttgtttttcaaattctcattctcaatataagcctcaacctctacccagggaggcattgtgcttgcccatcattgtcaatttttatgttctttggttataaataacttctggaacaagcaccagaccacatttcaatagcaattttcaaaacggaatgcacatttttaaaaactccttcgtgatcttttctagtaaggaggttttttttgtttgtttgttttgttttttttctaattgtaattttgtagtattgtagatggtattgtattgtcttggacctgcatagctaaaattggtgaagaacctttccacaaaatattaaggttactaatgatttcctggacttttcagtaaataactcaatatatttaaaaacctccccacctctactacattttatttttcagctctgatattagtttctccttgtctcagctgaacatcagaagatagacaaactgctgatggtttgttgataaatttaacacggttaccaaaaaaatcatgaaaaggccaggcacggtggctcatacctgtaattctaacactgcaaggctgaggtgggtggatcgcttgagctcaggagttcaggaccagcctgggcaacatggcaaaaccctgtctctacaaaaattagccaggtgtggtggcacacacctgtagttccatctacttgggaggctgaagtgagaggattgcttgagcccaggaggtcaaggctgcaatgagtggtgattgcaccactgcatttcagcctagacgacagaatgagaccgtatctcaaaaaaaaaaaaaaaaaaaagaaagaaagaaagaaaagaaaagaaaatcctgaaaaataccaaagtcttcaagttgaaaatggttaaattaaaagatgttttttcccctttagtcaatgtctaatgctgtgcttagtgtctgttaagcagtaggtaaattgtgtatatcccct

SEQ ID NO: 96551 - DNA, 1062 bp, Homo sapiens
ttattggctgatgcttagcaaaaacgtttcccattagaattctgtaggccagtctgaaattatctggccaagactgatattttgtacttgaagaatggaatgtcagctagatgccatccgggcctccacccaggcttcctccagctccctgcacctagtttctataacagcaagtcatgtgctcagcaaggggctacacggggtcatgggcctgctgccaagactggggagcaaagcatggaagttcaagtctagacagcaatgtgttgaaagccaagctagcaggtgagagatccagcacataaataaagaccaagatgggatggcagagtctttaaggacaccctgccctatgcaactgagagggcaaatgaggtgaggtctaaaagcaaagtagtggagtcctctggagtttaggtgttggacccagtttcagaatagaagcaatagctaggaggaggagccaccacatagtctggaggctaactctgacttgcagttgcttttgtttggttgagcatagttgttattatttcttaaaataatgcttacctgaaatactttcatgtgctctccatttcaccatggttccacctgttgcctcacacccattcagacaagtccgcaatgagcccagccttgctgtttcttcagagttctgggtattgcacaactgggcagggagtgagcacagttccttaagacaagctggcaatcctcatagactcacaaatatgaatgtagagagattccaacttgaggttcttttgcagtaggcaaaatcaacaaacgctcagtattgactacatttgatcttttaggaatcaactcaatgttttatgaaactgacttgcaaaattcaaaaggtctaaaaaatattagaatgaaaacaggatttgtgagttttaccagctgctggagtccacaaactgcaactgtcttggtaaatatcttttggaaagttctgattgtcagaaaacttcagactatacatgccaaagatctgatactggaaatgtcatgaatcatataagcccctgcctcacacagggcaaatttcat

SEQ ID NO: 96552 - DNA, 1915 bp, Homo sapiens
ccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacct

SEQ ID NO: 96553 - DNA, 1572 bp, Homo sapiens
tatttctttgcaaatgaagactccgcccacagtcagtctgattggttgtggacagcaaccattcagaggctgaagttacaaagttgcaaatggagactggacctgtaatcagtctgatttttttcggacacccaatttcccatctgctgcacagaaaacgtggggggtttgcaaaggaagtagcctctggtccttttgttacttaggtgtggaaagttagggttggttttcctttcaatttagttataagaagtcagcttgaaaatcagccttagattccctgcctccagaccctattctcctgcctcaatatcagcctagctattacaaggattaagcagttcttcctcttagtttccctttgtgaatattctttcattaaatataaaaaagccttttaatatattaatagaaattgtgctaaattaaaaaaataatttatattactaaatacatgctaaaaactagaagagtattataatacttttcttctacatcaggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcaggtgagcatgttttttgagaacattttctaaattataaacaacttttaaaagtaaaagaaaatgttttatagcatagtattaagatttcttttgtctgtgaataaaattataaaatttatctttgattgtttcagtaaatattggctaaacaattaacattcaccagagcaaattagacagatactgatatttcacaaatacattttagttcagttttaacatggatgaaaagaccattaaatatgtgagggtagttctggttcttcatatgcttttgtaagtataaagcataaatcttttatgtaaacataaatcctttttgtaaatatggagtataaatcttttgatttaggacaatacctgacatatcagaagttccccaggtgaggtactaacgctttcctgctgctcaacaagatttaacatttctttacaaatttccataaagatttatttgacttacatgattattaacaggcacaatgaacttctagagtatgctttatacttcctttacttagctgcatgacttacattgttaaaaatctgtgcatagcaaagatatgatacatgtctaggaggtacagactccgtaagccatccatgaacatccataagccatctttttccagtacttttcaccttttttgtgtgcttgccatgtgaagcgaatacttacatttgtcagtatccccattcggaagcgttttttgaaatttcagccaattagccaattgaattcagaatgagcttggatgagcaaaattcatgttaatttatgaaaactggtatgtaaaggtgcatgtgaaggagacaccaaggagaaagggtagaatgtgggtgcataatttagatgacttgacacaacataattgttaagtaaaaaaagaatagtcactatggtaactgtcacgtcag

SEQ ID NO: 96554 - DNA, 1025 bp, Homo sapiens
gatctcctgacctcgtgatctgcctgcctcggcctcccaaagtgctgggattacaggcataagccaccgcgcccggcctgatatttttgataatagagtttgacctgcttaatgcagtcattcttaccagagagagaagacttttcgttgttgtagttcagacataacagactctagtagaggaaaagtgacaaatcttgataggactcagtccaggctatttacttggtagtcctgtgtctgtctgtgtgcctctgcttgttgcctctctgtgtttatgtagaaagaaccacattcagtaaaaaggcttgtggatgtttcaggccagatgaaaagtggttgcttagcttttgtaaatttgacagtgcaaagagagttctttattactcccaggggaactatcaagtagaaagagtttgctctgaagcttcttgggcaaatttgaagatgcttttatttgggtttgttgttattacataataaagcattggtttactttctcaaaatcaaccaaccaacaaatgagctgtagagattagtcttacttacacattgtttttacttggattttcaaggataattatttaagtaggttttttttttttcagttgacactttcatggatataaacaaatgaaaatgtgtgtgtgtggtttttttttaacaagtgtttttaaatttccatcatattgtacttcatagaggttctgagccttgcctgggtactttcttttattgagatttttaattaaggcccagattcttacccaaattgagaattttctttttaataattgaattctcaacaaaaaacctagaatgtgtgaaagtaaattctctcagcaccgaaattatgaattgattgcattttatgaggtgtggaaggacttttccctaatattataaagtcatattgtcaccagtagaggattgtgactgcaagttgtccatgttcttagcattttgaacaaagaattggacaaaatgcccagcaaagcaaagaaagatggaagcaacaaaagaac

SEQ ID NO: 96555 - DNA, 1027 bp, Homo sapiens
caactccactgactttttcctctttgagaccatcctgccttaagtccaggagggtccccaactaagagcagctgccaagatggctggggagcctggtgttttttatttaggtaacagttttctggggtttttttggagattgacttttgctctgatgcccaggctggagtgcagtggcatgatctcggctcactgcaacctctgcctccccggttcaagcaattcttctgcctcagcctcctgagtagctaggattacaggcgtgcaccaccacacctggctaatttttgtatttttggtagaaacagggtttcaccatgttggccaggctggtctcgaactcctgaccttgtaatctgcccaacttggcctctcaaagtgctggaattacaggcatgaaccactgtgcctggccaagaattgaattcttatgagaagtggtacttataaaaattttaaatgaaatttctctagtgtttgaagctaaatcacaccttctcttttcatttcttgtccttgtatttgtttctattgctcttttaattttatcctacatagttttgtttttctttttttctttttttttttttttgagatggagtcttgccctgtcacccaggctggagtgcagtggtgcgatctcggctcactgcaacctccacctccagggttcaagccattctctggctcatcctcccaagtagctaggattacaggtgcctgccaccatgcccggctaatttttgtatttttagtagaaatgtggtttcaccatattagccaggctgatctcgaactcctgacctcgtgatccgctcacctcagcctcccaaagtgttgggattacaggtgtgagccactgcacccagccttatgcccagctttttttttttttaaagacagggtcttgctgtgctgcccaggctggtctcaaactcttggcctcaagtgatcttcctgcctcagcttcccaaagtgctgggattataggcatgagccactgtgcctgtcccttattgtcctttaa

SEQ ID NO: 96556 - DNA, 1027 bp, Homo sapiens
tggttatgaatatagaatacagcgttgtgctctttattgtgtcagtgttcacattgggaaatacacagtatgtttaatcttgaaatgtcttaagtaaatgaaaaatcttcatatctgatgggcaaaggttacatagtttatatactgtggcttaagtttgttttagttaactaatcatagttttctagatgtctttaagactttgggataactccagatttcacagtctgtcaacttagttaatagtttcaagaaaacataatgaggtttttattttaaagttgaccttgcttttagtcacatgatagtaatatgtagtagtagtgctgaatagtagtctttctctagcatgagcttaatctgtgtgtattatgcatagtgttgtatattggtgctatattgttaaaaattgttgaaattggcttaaactggattaagtttctatatttgtaagtatttttgtatttacagatatctgccaacagatgggtccaatgatagatgaaaaacttgaagaaattgataggtgagatttttcgtgcaggaataaaaagtatagttttggggggttcacttgtgttttggcaaacagtaaagtagggaaagtttttgtggaactgtacaattcatggaaattgtttttcagtttcccaggcttttaacaaatttatagcaaggtggtgctttttatcttgtttttgtttttctaaaaaacaagctctgacaagttttattaaataaaaattttgcatggcttacttttaaccagtctgttctagcatgcttctagtgatattagaactgcctggatcagtgatagccagtgtgcctactctctagtattttctgcatgccgtgcccatcattgccactgtagtgatggacagcagttttggccaacattgtatagcactctatttcagatttcctcaaagctggacagttttagtgaggatgaccaattttgctttgccttttctgatcatcttcagagtctacttttaccccagcacatactttccacttt

SEQ ID NO: 96557 - DNA, 1019 bp, Homo sapiens
tatacccttgatcagagcaccaaaagctatacttggctcctccccaattcttaatctactactgtattctcctcagaatttctctgccatttaaagctgtcataaaaaatagatcaatctctgtagagcttaatactgttctgtacttttaaaagaaattcatgaaatttagcaagagtgagaagtaagcttgttgctgtgaacacagattgcagatgtatttggtatccattataaataacttagttatttataacacactagtctaatatatttctagtattttttaaataaagggtagataaataatggttttactttactgtggtaaatatttcttgagaaaatgttatgtaatcaactatttaataacaaatgaggacacagttctgtcttcataaaacctagaataaaataagggagttaaaattaccatatagacaattgtatggaaggcagaatgtggtgaataccataaaagaggtgctgttggagcccagatagcagatttacacttggtgcaagcatctggcaaagaaggcttatcctgcggctccatttcaggtgtgtatcttgattggttttgataagataaaaaattttgcaagaagttgaggatgggaaaaggaaggtctcttaggcaatcaagatagtaccatcttcacttagaaaatcttttttccataaagaaaaattttttaaataatcatttggagtggaacaccatgatccctgaaggagaatagatagaaatacagatgtttctcaacttatattagcctacagttgggcaaaatcatctaacacaaaacctatttattataataaagtattgaatatctcatgtaacttattgaatactgtactgaaagtaaaaaccagaatggtttatgggtatctgagtgtgtatcacttttgcaccatcgtaagtcatgccatcatgagtttgacactgtctgtaaagatggagagatagtgtgggctctgaacactgacagtctgaaatgtcaggcttatga

SEQ ID NO: 96558 - DNA, 1097 bp, Homo sapiens
gtaggtagatattgatggaattattctttatcatattgttagaatctttctaagctatttcacattgtatttgaggctctttttatacagtaatcaaagcctggtgatgaaatgttatgacttacacccaccaaatgccggcgatttagcatttaggccccaggagggctcttttaattttctacctctctatgcgtttgacacagaataatgtgatatagggccccaacattgggcaaagtgacatgctataaaagaatggtttcttaattataatatttaaaattttccaggggtttaaaatactcctaagtgcataatttaaatgttatttagctcccttgaaaaacaaagtcctttttggcaggccattatgaagtcttcagattttatatttttaaaaagagtaattgtgagtcttatatttgtagagactaaactatgcttgatagagtattcaaatcaggaatttcccattttctatggaaattaaataaacaatagtctaattagatattttaaaaattgttgggcggctttagaaggcatgagataggcttcatatttaatgtattacatgaccagaattggaaaaatatcatgaaaagttgagttctagctggactaggtaggttattagatggtctaaaatcagattcacgtgattatgtgtgtgtctttgtactcatacatatccatactcataaaatttgataattgatgatactggctcctcaaatcagtgaagaaaggatagattcttaaataatagaactgacaaaaaattcgtaaaaatatttttctgttcctgcctcacaccacgtgtgaggttccagatacactaaatgaagttctaaatacattaaagatttacatgtgaaaggggaataatatacagaaaagaatgtgggtagatatttaatcttcaggtaattcaaacagtatgctaaatgacactataaaaagaaaaatggtagattctgttatagcaaaaactgcatcataaacaaacaggaaagattagcatgaagctgtaatatatatgatttgcttttcagacttagtatataaagttagttacctatctaagaagcttt

SEQ ID NO: 96559 - DNA, 1510 bp, Homo sapiens
aaggcgcaaaatagaattagacaaatgattttaaaacttaaaaaccgtgaattcttttcttcaatataaatttttcttgaaagttcattgttttctgatggaaaaattctctggtacaagtaggcagagttgctctgtctgttctgttctaaacctttccctgcctggctcccgaggccccagcattggtttagtggatcacagtttagtcctacagttgtaaaggaggcactgctgttgagattaaaaaaacaaacaaacaaaaaaactgtgtctagattattttatggccagtgccataagccagagcttcaagtagttacatattagcttaagcatgactgaattcagaaccccaaaggcattttaagggtgaaagaatgaatttgaggccctcctgtaacttctggacaagagaatggaattagaaaaagtagaatgaaatactaaagagctcaaattggacttgcacgtatatcatagaagaaaaattatatattacgtttttaatatcttaaaacttttcatttcaaatcgttaatacaaagcaagggtcaggcgcagcggctcacgcctgtaatcccagcactttgggaggccgaggcgggtaaatcactggaggtcgggagtttgagaccagcctgaccaacatggtgaaaccccgtttctaccaaaatacaaaaaattagccaggcatggtggcgcgtgcctgtagtccctgctactggggaggctgaggcaggagaatcacttgaacccgggaggcggaggttgcagtgagccaatatctcgccactgccctccagcctggcgacagagcaagactccgtctcgaaaaaaaatatatatatatatgtatacatatatatatatatgtatatatatgtgtgtatatacgcccacagacacacacgcatacacaaagcaagtcattatttgacttgagatgtctacaggaaatgttactttacattgtcattgtctttttcacttgttctctttgattcagtcagatttttgttacccttttttttttttggtcattcctttgttcactcttcattcagcaggcatacattgaataattactgtgtgtcaagcattgtgttaatctatggacacaaaatgagtaaatagactgtgagttcctgccttcaaggaactctcaatctaatggaggaaacagagagacataagacctgtaatttagtacgataagtatagtgctacaaatatacaagaagctttaatcctcttttatttaaaatagtcatagtccctgaagaaaagacaaggaccttcagataggagctttctctgtaaaggtgttgacactatcctctccttcccaccttttcttttttctttttctttttttttttttttgagacgaatctgtctctcaggctggaatgaagtggcctgatcttggcttactgcaaccccgcctcccgggttcaagtgattttcctgcctcagcctcccgagtagctaggactacaggtgcgca

SEQ ID NO: 96560 - DNA, 1036 bp, Homo sapiens
agtattccactgttggggtgaggagggtcaaaagtgacaatatgctatctccagagactacggatcgcctttgctgcaaatggtcccaacccggcctggcgctctagagcaggcgtggtttctgcgcgcggacactttggagagaaactacgcgtcccggcagtccgcggggcgagtgggcggagccgggccgggggcgggggccgggcgccgggcgagaggtggcattgtgtaggggagcgcggagctgcatttgtctgctccaggtgctagccaggcaggcgcagccgtggccggctagggctggaagtgtcagcggcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctggtaagtgcgcggcggcggtcgggcgcggggacccggggccccgggccgggcggcgcagctgacccccgcccctccccttcaccccgtgccgggagcgagcctccattcccgagggggaggctcccgctttcccctttgtggccccccagcactcctcttcacccccctggcagtcccccgcgctcagtctctcggggtcccgggatggggatgggggctcagggccggctgccc

SEQ ID NO: 96561 - DNA, 3441 bp, Homo sapiens
tggactgctgttggtcccccagactaccagttttagtgtcccagcctcttctaagggatgttgggagggacacacacaggcgagattgggctcattcctactcctgacacttggacacttctcttttcctagttggttacctctaaactccacaagactaggcagcaagggaaactcgtgatccgggcagccaacgattgtgcctgcctgcgggttttcttttcttcttttgttttcatgaaaacttagaactttggcagaggactcgagttctagatcaaaaatcggttttctgaggtgtgctcagctacaggacgttcaaattgcctgccttcaggccttgaaaaaggaatggtttggtatgggaagtgatgttctggatggcaggttagctgtgtgctctttgggagaactgagctctctctcccgccacctggaaactctggtgtggccgtcggggagacagatgaggttgcttgtgttgctttgcatctcctgtgatctcccacagctgctcccaccgttgtgcaagatgggacactgaaatgaaacggcctaggcataactctcaaggcggcctgggtgcatacttgacctgcttttccagagacaaacgtttttcttcaaaaccctcttcctactagacatatggttcttacctcctggctctggctttttttcctcctggctctggcttttttgtttttccatccatgctgtggtgctctgtgtgtgtgtgtgtgtgtgtgtgtgtgtgtgtctgaatacttgtggtggaggagccagtgacacagggaaaccagtgcagcagccataataataacaataatgcaattaagttctgcttgactaggatagcatttttttttgcttgagctttcatttaccctgctgattaataacacatggtgtgaattaatctttagaaaaataatgtcccatcattaacatggtggatttgtgttcttgttaaggctagcagttgcaaatatagtatttagacaattatgattgtacatcccaagcttcttggggcagggttgttgtggctacttttacactactgtgtgtcgcagttactgggtgcaattccttttaaaattgtttacaatattctaagcctctcaatcaagaaacaaaaacaataccaggctgaccttttattgagtagagacaaagcttttgggggaccaggtcagcttgggaaccctcttcctagggacgcatttggaccattgatgcgttccttgtcccaggtcagctccacttgctctttgacaatctgtgagaggagttgaaaccttccagatcatctccgtgggccaatagaagtgcgcagtgttggtgatttctcttgttttttttttttttctggagttgtgtgtgtgataatctcaactttgcttttcttcatgagttgcttaagaaatcagttcaaaccatttaattgtggacatcaatcttgaaggacaagttttaagtggcagatttttaagtatgtatgtggagggcaatggaaattgtgttggcattattgataccagttcaactttcttgtataataaagatcatacgggtgttttgggaggaaaaccagatagtaataccgtatagaaaagtgtctaagcacctcattgtaagtatggctaacatcaataattaacagactgtttcaagctaggagaacagttcctcccaacttccagctctagaatatttaaggcctcagagagaagtaaacaaaaattaaaatgacaaaagtccattttatttcttgttaggaaagccttaagagagaacaaatctattcaatgactataccctccctccccatcagtttatatgggttaaattgtgcgaatataaaaaattagtgggtatgaatggaaatgagagaataaaagactaatgaattaagactagaggggtgaactttgaaaagtaatctttttaatagaaaaaaatggagttagtgactagcaaaaattggatcccagtgttaggagtttaatcctcccaaggataggtatcttcagtatcattatagtaatagttataaaacttacatttaagggaaaaaattactgtcttagtgtatacatttaaaccatttgcttccctgtattgacctttcaggtacagctggaaggtgagatacacacacacacacacacacacacacacacacatatatgcatatgcctttgtgtgtgtgtatgtgcaatgtttctgttatactctaacctatgtataatttatatggaagtgtttcataaattataaagtcagccacgtacttcaatctttgttcttttaggatgtaaggatgtatatatttcataggtaatattagcctgtgttttttgggggttcttcatatctgtaatagccatgtggccctccattgtatttattaaccattgtctaattttgggggttacatcaagcttgtcaaccactgcctgtgggcctcatgggcccaacgcaaattcataaactttcttaaaacattatgagatttatttcatgatttttttttaagctcatcggctatcgttagtttttgtgtattttatgtgtggcccaagacaattcttcttcttccaagtgtggcccagggaagccaaaagattggacatcctgggttacatacacacatccacaaatactcccatgtcttttatttttaaagatgatgataagaaggtggttctgggtggatgtggtgaacaactgatggtttttgtccgagaatacctgtttctacattagacactgcataatattattcactcatttttggcttgcagtcactgtttacaacttaaaaggcacacccttggatgcctttgttgaagagctatccttaaaattcttttgttgagtttcagaggaaaggacaattttaagtctgtgtcttagctgctgtatcttgtgcaatatcaggtgtcaggcagcactgcaaacagatttaaaattattaggaagtaatggtttagggcagtattatatttggtatcaggaactgctttggtatctgattaatttgagtccatttccttctcattttttttctgcatgtcctgagattgaatgtggtcattttgttttaggaaggagtgggaacattttctgagtatctactatgagtaggccttttacatgttctcatttaatgctcacagtaactaatgctatcagcaatactatagatgcataagtaatgattatttaggctgggcacagtggctcacccctataatcccagcactttgggaggctgaggtgagaggatcacttgagcccaggaattcgagaccagcctgggcaacatagtgagatcctgtctctatgaaaaaagaaaaaaaaagattagccaggtgtggtggcttgcacctgtagtcccacctacacaagaggctgaggtgggaggatcatttg

SEQ ID NO: 96562 - DNA, 2573 bp, Homo sapiens
gtagaattccccagggtcagtgactgaaagtcatatgagcatagggaaaaatattctaacatgtagagttgttgaaaatggatggtgagttctccgttaaagttattcagataatctgtgtgacaaacactggtgattggaaggccctttgcagcccaagaagataggaagtacattattggctcgaaagttgccctctttgaggtgagtctgcaacttgcaggttctagacatagaattataacacctgagagtggggaaagatctcctggtaggtgcttcctgggcttaaagaagaaaaagatacgtatgggctgatgtttgttctggaaattcatttgactttataagaactgttgcttaaagggtttggtcttaatgaacagtgctcttctttttcatatttagagcttggggaatagggacaaggtaaagtgggctctccagccctcaggtttaagcaagtaatagatgtcaaaaaagtagctaatacaagaagcactgattatagatgattgcccctcctttgcaagaggacgctgtaactggagtacttttaggaacaaagcattgaatccttataaaagaaggaacagcctagaggaacttaggagggaaggtgagttacaagctatacagttgcttggcagatctcatcttgtagagcggctctttatggagtgccactgccatccctgcaaataagaagtgtgtccctaggctttggagtcatggttccttagagagccttcatgtaccttcttagttctcacctacttgaacactggggacagagatagctcattgcttgtcttccctttagaattccatctgttcatactgcagggtgatcttcctccctcctccccagtgaccccttcctcctttccagaaacctgtctttcaacataaatgccaaggactatgcagtttccaactgatagcatataatttggaagcaatgtctaagggaagagctgttaggttggagagctgcctcttgaactgtgatctcaaccaaggcccggagatgtggaccagacgggcttggaattctgaaattgggcaacattcagccctatttaccaggtatgatggtatttgatgttgacagataaaaatgtacattcttttcactctctgaaaaaacaaacagaaaaacatgaccatcagtgttcactggtaggcaattatcacaaactctctatgatttctagtcttgtatagtttctaggacaaacttcatatagtttctgtgattccatgatcttcagtgttcttgtttagcctgtaattgactttggtgactctcatttcacatgtaaccttagtctccttttttctttgcagaagttctgatgcatttgtaagcccctgtaaccattgccacagaagctgaaagccttgaggtgtttagaccctgctatccccagaagtaatctcacttgactgacttctgtgcatagaagatgcccatggcttggttttgggaatgatgtcaaatatcaaatagttcatatttttttgttttgagatggattctccttctgtcatctgggctggcgtacagtggcgtgatctcagctcactgcaacctctgcctcctgggttcaagcgatcctcctgcctcagcctcctgagtagctgggattacaggcacgcaccaccacacccagctagtttttgtacttttagtagagacaaggtttcaccacattggccaggctggtcttgaactcctgacctcaagtgatccaccagtcttgacatctcaaagtgctgggattacaggcataagccaccacacccggcttaaatagttcacatttttgaccatgtgcctggtgctgggacactaacgtgtgactgatggtgcttttaaataacacatctcactagtctcaagacctgtcttggttgagggtttgctcaggaacctgacttcccttccttgttttttttctctccgtggaagtttggcagaacaccttatttaagctagaataagggtattggtaagttaaagtagtggttctcaaacttggttgtgcattgacatcacttggcgatcctcagaaagtacaagtgggccaggtacagtggctcacgcctgtaatcccagcactttgggaggccaagacaggaggatcacttgaggccaggagtcctagaccagtgtggagcaacatagggagacctcatttctactactaatgaaaattagcagatgtggtggtgcatgcctgtagtcacagcttacctgggaggctgaggcaggaggattgcttgagcccagaagtttgaggttgcagtgagctatgatcatgccactgcactctagtctgggcaacagagcaagactatctctaaaacaaaaacaaaaacaaaaacagaaacccacaaatgcctgggttccactcccagaaattctgataaatttgtctggaatgtgacctgggcatcaggatttttaaaagctccctagaaggtttgaatgtgcagccaaggttgacagccactgtgctagatgttttccccctttttcttcctaccccaaagaccaagccaatttg

SEQ ID NO: 96563 - DNA, 1001 bp, Homo sapiens
acattattaatagataaaatttgaggggctcatggccacgtttgttggtctctcttcttttctctgctttgtaactcctgtatccctcacagccttcttcctgaagccagctacgacttggccagacccatctcctcttctgtttctttacaagtccctaacttggaagttttttttttttctttttcgttttttaatccctgtccccagattaggcctgtgctttctctccttcgtatttttttcccccggtgattcccctgcataggatgggctctcttcgcttctctgcttactgaaactataccagccttcaaagttttctacagtcccactttttccgagggtccttacagacccacgtcagcatgggggtgatgagaaaaacaactctccttactttgatcgctttgtggtatgaattatctcttactcatgaggcacttgattaaatatcactttgtataacttctgattgtaaaatagggagatgctttcatatgtagctttgtagttgctcattacattcttagccatttgtttgtgtctttgtttcacctgccagttcacactgtgggctcctgaaaggcaaggatcatgtcttacggggtctgacagcttttacttggcttagccttgggaagggtcccagcaaatgattgctgacttgataagggaacggtgcccactgaaagaggactgggaattggagtggctgctctggatacctatttaactgaccacactaggctgactattaattgcacataacttgcctttgtgttgaaatgacacttggtcatagattcttattcatcttggtattccccttatcacttgactgtggtaggtgtccaagaatacgaaacattcagagacaacaagttggcatcatgcttccctgactccttgtgaattagcagaagaggaggagggcagtttatattttcttttttgttggagtgaggtaagtttaaatgggcagcgttctttgttttggc

SEQ ID NO: 96564 - DNA, 1003 bp, Homo sapiens
cagtggcacaatctcggctcactgcaagctccgcttcccgggttcacgccattctcctgcctcagcctccccagtagctgggactacaggtgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacttctaagggttttaaataaatgagacaaatagggcatgagactggatggcttgaagttatataagaaggtggtgaagtttgtgatccagtcctaggtcttcatactaaaactccggggtgcattccactgtaaactaatgatgtttatgaattctctcgagttctgttaggtgctttatatgcattatcgttgatgctcatgacaacttttccagggaggtattgtcttccttttactaatgagacaatgggctgagggtgttaacgtggccactacccaatcctgggggcagagtttgaatccaggcctgcctgagacagcctgcttctttctactgcactacactattatgttttctgagttagctctaagatgtcattaaatgtatgcttcttgttcgttcttcacataccctctgtactaaactcattatttcatacaatagctgctttgaatgagtccaacttgtgttatatgctgcaaaatctgaccttaatctcaagggactcaggatgtagctggggaaacaagcaacaataagcaacccagagagcttcataatcagtgtagatgtagatatgctaagggtttggagggaaggtgccttttctgaattctgagtgttcagaaaatgtttccttggaataggaagtaggtgagattctagctcagtcccaaccactgctgggctgcacttttcattctacattgtgcatttttgctcctttggtgcttatatgctttattcagacag

SEQ ID NO: 96565 - DNA, 2898 bp, Homo sapiens
cctgactttaataatcaccattctaactggcatgaggtggtatctcatcgtggttttgatttgcatttctctaatgactagtgatgatgagctcctagaaagcaattcttatgcgtgttaaagtttgagaacctttaagcatgattaaaagagaagccacaaaagaaaagtgggcaattctgacttagaactctcagacctctagcagtgactggaggatgggtgggaattttggtatcttcctgcttgccagtaggtttacacaattcgatatcagaataagtctttaaatacatattagtggctttgtttattgtgaggattttaaggtagccctaatgtgggtttaaatgtggatttcatgcatgttcagtaataatacaatataggtcacttgtgtatttctttaatcgtttcagtaaacatgaatggtagctcaggaaacctgaaaggtaggtatatccctgtctcatatatgagaaactcaggattagggaagttaaaaatcttacctgagaacacatatttctagtaggtaataaagctgaaaatcaaatttctcgactcaaaagccgtgctcctaacattctgttttgactcccaatgcaaaaatattatgtaaatataagctatatgtagaataaatataaatgtttcaaagtaaattgacagccttgtgatggcaagctcatcatcttttcagtctgtgttcattttgttatatacccagaaccaacagtaactacatatccttcagaaaaattacagataaaatgagaactggatgaataaagccactgttcactattgaaatagtaaaggccaaataagcttgtgatcaaatcttttttttttttttctagtaacagttgtcctctgaaggctttctgaaggctctctttcagacaactgtctctgaacctttgtttttttaaatgcccctagtaaaatggctgtgttgttacagcttgaaggctgtgtggtaagcctttgctcagccctcagtgataacccatagacttggacttccatgtgagaagaacaaccattattatattgtgttagtaggccttgtgttggagattgcttatttttaaaaaaacaaatgccatgtgatcttatttctatttaaccaatgttttgcttgagtgtaccaagcaaggcctcttgagatgctgggacacaaaggtgaattttattttcccttttgcctttgagtagttaactgcctagtagatgagatactggaggtaagagaatgaagattataggatatttaaaggcatttatcatacatatatgtgttatgtttataatgtgctatagaaggacatattaaagttgaagtttctaatattttagattaagctgataaatctagacaacttactttggctgaaggttataatacataattgcatgaattctgctctgtgcctgaatgcttagagatttgagtgtgtgtctaggtatatctgtgcaaacaacttggaagaatctggtaaaaagtattaataccaggatcagccttttaggtggtaagagaatctaccccaaaggcagtcgactctaagccttacttctctaggttgcaagcatcagaaagtaagtatatgtccctatactcactttgttagaaagcccacagtcttttctgcaaagtctatttaacaaagcttgtttatgatcttggactttggactaaacctgagtttgaatcaggattttgctgcttactaattgattgacctttctaagccttggtagccacatccgtcatgagctcaagagctacctttttgacttgttatggatattaagtgatattgcttagtacagtcaagttgtggcagtcaggtaagcacctcacaagaagtggttgttctgattattttgtactcttttaaaatttgactttattaaagcactggctttagggtccaagctgtggactttaactggattctagtatattttacaggtaactttagttaaatcatcatcaacctcaaatgtgaagaacaagtgaagcagggcccccagaacgcccagaattgaactaatggtggcttgtatttgctactcttgccataagattgtacctactgaccttctgtgatacatcagtgttttcaaagttctggtccatgcatgcagccccacttggatttatgttgactcttgtatattttgttctttctagaaaaagagacccaggtgtttcagggcattgggctattccatttcagagcctaatggaagtgctagtgttttcataattggaacagacaactgccatgctacatatggtgctgtgaccactgagcagcttgttcacaatgagaaaatacattgaagttgtgaccatttgagccttgaagaaactgctgttgaagttttgtttggctccagctccatcctggaatggatggagtcatttggaattattctgaattccagtagtggcaaaaaaaaaaattgtgtaacttgtatatagatggttttctgtttgattaacagcattgttcaataaaagatgcattgttttaaatcaagaatacggtgccatctgacttgatctaggaggcacagaaagaagacattacagattacattccccagtaaacccctgcgttattttttccagaaggttctatattaatctgtttgggttgcgtcctacgtgatcttgctgagtcagacagagctaagcttatgaaacaaaggctagtcccaaatcaaataaaaacacaccaccatccagaaatgagagcctagaattttctaaagatgcacacatctttcttactatctggtgaggaaaattgctcatttttctctcagctgataaatatcacttttgccctaaatttttgtagtggcaatctacttttttaa

SEQ ID NO: 96566 - DNA, 1034 bp, Homo sapiens
aaacatttattttttcttgagcagaaacaaaattgggagttagatgatatctttttcattgccccaagaaaaccactgctttattccattgaaaataagaccttgatgggtcatccccggtctttggcagtagaaactattcgtcttgtcttggtttccattcaggagctttccttcccaaaccttgtcccctgctttaggagtaatttttttagggctttaggtttttctcatgtcccagtgactaagcttgcttttgggtggttctctgtgctgcatgtagtccttctgggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttcctttctcccgctacagaggaaaattaccccgaattggcacatctcattcctatgcactcttgttaaaaataacttatagtttgcttctgaatttatagaaatggcactataatccatatgtacttttgaatctttatacatttgatttgagaagtatttatgttgatgcatgtggctttaggtcatttattttattttgtttatttttttgagatgaagtctcgctctgtcacccaggctggagtgcaatggcacatggcaacctctgcctcctgggttcaagcaattctgtctcagccttccgagtagctgggattacaggtgtgcgccaccacgcctggctaatgtttttgta

SEQ ID NO: 96567 - DNA, 1262 bp, Homo sapiens
tatcttaagtctttattgcctgcctttgcatgttgtcatgatattagccagagaaccaggcttttaaacccaaacattagtaaaccgtaaaacatatcttgagacaatctagtgcaacaagagcaaatttggcagaatttctgaagcgattccatgaccagtatttccaatacattaatctatttagatatgctttgggtacttttcctggcaaaatggtaaattgtgcaactggcgattaactcagatcttggaattagcctgtgactttgatcttacataaataagtttcctcagtaaagtttttgtttagtatctgaaatccagcttttttcaagagagcttttagctggactatcttctgtattgatactgagaattcagaattctctctcatgagtgaaatttgttaataagttcttgagagattgagaggtcctgtccttctgtctagaacacccctcctgcaaaccctaaataatgccttagttaagctgaagattcggaaaattgagatataacatgaagtaaaagtatttttgaagtcttttcaatccacctatgtattgcacacctgtgtgcccagcacataatatatgattatccatttagtgacaatgtattgggtgaccatggtgtgctgggtactgtattagagtataaagagatgaaaagacaatgtctttatgtagttaatgctataataggaatatgtattaaatgggagcctagaggtgatacatgctctttggaggcagagattgacgaggaattagaaaaggaacttaaggagagttgacttgaattggagagtggaagatgaatgtaatggcttggaattgaggagaggtggggagcagttttgggaggaagtcattctagggaaaggcacggtggtatggtgtgttttgaaagactgcatatagttgctatggctagaagaacatagtctctgtggatatggcaagagaagttgtggtcaaacttatgttttagaaatgttatttaggagtaatgctgggatggcttagagtggacaaagacagcccaatcaaaagtctcctgccatgaccgggcgtggtggctcatgtctgtaatcctagcacttttggaggctgaggtgggaggatcacctgaggtcaggagttcgacaccagcttggccaacatggtgaaaccccatctctacaacaaatacaaaaaattagctgggtgtggtggtggacgcctataatcccagctattagggaggctgaggcagga

SEQ ID NO: 96568 - DNA, 1051 bp, Homo sapiens
ctcagggctccaggaagctgactgagcacgtagtccaaagaaattttgcattctggtatttttcagtgttttcttgtgattttcatctttaagctaatttgttgagaagggcttataggatttgctctctttgggcaagcttcctcatcagtatcaatggctgtagtcatgcagtcctgttgtgaccatgttcaactgaattgacaactaatatgtatcacgccacaccactctgcggttttgccctttgtaaatgttggcttcatctgggaaattgttagaaatgaagattcttggttcgtgttcttgacctactgagccagtctacgtattaacaagatctcacacgtgactcacgtgtgcattaaaatctgagacttactggactagctcaggaacatggcctctcagagcccttttgctgaagttcaaggctttttctgtttattttctcctcagaagtgatgagaaacatctggtcaccatctttcatgcagtatacattttcatggaattaaagataatgatttaggtgcctctaagctgtctcttcttcaagcttaataactgaagtttgtgtgatctctttcttcatagagaagatgatcttttagcctttcatcctttattgcctttggtctctgtttcctagataagtttttaaaaaacgtcatttctgaaatgggcagaatactcttatcagagtgtggttgctactaaataagcaaaataacttaacccatgtattttttaagatctaggggcatttggctaaattttttgttttattttaaaagtttttttttttaagcagtaaaaatagcaactaattcttccttgagggaacttcaaacccaaaaagtacctcctctcttttctgaaggatggaataagttgaccaatggtctttggcattcttttgggttggtacttcaggctaattttacaatagaggaaggaatgatggaaagagggaaagaagtaaagagagaaaggaaagaaggagggagagaaagggggagcgaagggaaccagattaataattcaaagc

SEQ ID NO: 96569 - DNA, 1003 bp, Homo sapiens
aatgacttccagttatctattgatactataaacaaggtggtatttcattaatgataggacctgtgttggtcccttaggaatgatgcattctttgcagagaagagttgatcaaggtgagtcctgttacttgaacctttgtgaaggacaaagtaaagaatcatcccaaaacaggaaatgccacacttttatttcctgaggattgagttcatcaggaaagatataatagttatctcttgttgtgtaaacaataacaaactactgcaaagctagaggcttaaaactatggtaaatatttattatctcccagtgtctatgggtcaggaatttgggtggttctgccttagggcctctcacgaggtcgcaatcatatgatggcttgaccgggccacggggatttacttcagaggtgtctcgctgatgtagttggtaagttgctgttgcctaatgatgtgaagcctaagttggtaagttgctgttgcctaatgatataaagcctaagtgccactccataaaggagtttctacagactgcatgttaacacagcatggcatctgggagcaatctgagagacagcaagatggaaactgcagtggattttattccctagcttaggaagttctttaccatcactttccaatattctgctgataacacaagtcagccctatttatcatggggggactggacaagggcattaatatcaattggctaggatcattggaggctggttgtaccacaaaggacacttgattggctttttatctcagttgctttctctaatgttgtcagtgctatggtttgaatatttgttccttccaaaactcatgtcgaaatgtaatccctgctgggcgcggtggctcatgcctgtaatcccagtactttgggaggctgaggcgggcggatcatgagttcaggagattgaaaccatcctggccaacatggtgaatccctatctctactaaaagtacaaaaattagctgggcgtggtgccatgtgcctgtag

SEQ ID NO: 96570 - DNA, 1182 bp, Homo sapiens
tggtatgtattttgtccctgctccctgctaggctgtcctgatgcatttagactgaggtggtcactgcttttcactggtgctattgaactggaactatagtttcccattggtgagatgttgttactacagtttttcacatacatgtatatttcacatacatatattttaattttttacatttattgtttctccagtgagttaaagccttagaggattgagtttacttttagcacctaagaatactactaccttttcatggaggaagatcattgaaactgtaagagtttgcagttacagaagcagtatcctctctggagcactgaacaggtgttgggggccagaggattcaagccctgtccaccattccctgctgagcaccttctctaccagcagtagctcttcagcctctgaaggcatggcggaggcctggagtagggccctgccaaccttgaatgctcatgcctggtaggttatgaggattaagttacataagattgtatgtgcttaaaataggagttggcatagaacaagtactccttgattttgatctggtctaattcattcatatttaggatgaaaaaatggtagcaatgttaagtttaattcagatgacaagacttactaaaaggtctttctgatacctcatctatacatatagtattctactctgtgtagatcatctaaaatttctataagttggagatgatcttggcttttctgttttaagattacaatgaaagacagtgaaatctgcagctgaatttagggaagactccttgaaaacatcatcagttggctttctcatttggaatacaaatggacagttgtatcctcctgccattgctttgttatgattatctaggagttttcttatttttttaaaatgtgactttatagacatttcaagtactataacatttagccattgaagctctctctctctctctctctctctctctatatatatatatatatataattattattattttttgagacagtcttgcttagtcctccaggctgtagtgcagtgatgtgatctctgctcaccccaacctctgcttcccaggttcaagcgattctcgtgcctcagcctcccaagtagctgggattacaggcatgtaccaccacgcccagctaagttttgtatttttagtagagacggggtttcaccatgttggc

SEQ ID NO: 96571 - DNA, 1027 bp, Homo sapiens
gtccttaaaatgtttcacaattttggcactgagaagccagagcgaagtgaaggagttgctcattgttctccatacactctgggttctcccacctctgcaccttggctcaggttttcccctttagctagaatgccctttttccttggctttggctgtctcctaatggattactcgctgtacctacccttctaggctgagctcatagctagcatatgtaatctaacatttgaatcagttgagaaaactcttattttcctgctctatacacccagtatagttggtttgcaggtgtctgtggagtttgttttatacagtgcctgttgggctagagctgcattatagctagtgtctgtaagaccgttctagtttaagagcatgcagggtggcgacagtgagatgagactggctgtatcagtttatggctgttcagtttatggcaggtgacttaaactgagccttcattttctcataagcaaaatgggaacttagtataactaagtaggaaaatgtatataatgcctaggaatggcttttgctaggtgcctaataagtagagtttccttttcttctctttatttcaaatgatgtaaaagaagccttgttttgaaaccaagagttgttaatctgaccaaatttcatgaaaggatattgatcacaacatatttgttatcagagtttggtaacacctgactaattttttgtattgctttgggatttatttaagcatgtgagactggtattacctaaggttttagttgacagaagatggatagcctgagaggtcgaaattatgagagcaaaagacttttgaaaatttctgccatggcatatttcatacgtttcagcttggtgtccagggtttccctgaacagacgagtttgtgacatacgagctcataaatatacttgcctgtgccctcttccagaagggaaagccagatctccagggatgctaactgttggggagacaatgagaggagcttcttgtctgaatatctttgttcacagcagagatcatatttgaagtt

SEQ ID NO: 96572 - DNA, 2495 bp, Homo sapiens
ggcagcctgcctgggtcccttgagtgcgccttcatcctggggcatcttgggatttaggaagcttgtatctgaattttggaatgcaagggcttctggtgggggccattatattttcagctaagattggccttccctggtccagagcctgcacacgtttctaaaatctttttcaaactctctgctgcttcattaaagtaagaaaaaatagctacactctagatttggtttcttgtttcttcaatgacactttgtctcctcatcctaacacagtaatcaactaacctagtaaactaacccatgttagtgtagctaatatccataaatgtattagaggaagaattcttttttagcaagaaactccgaggccatgctccctatctttgtctaactccttggtgactttagtaatgagaattttaatctagaggctccagggagacaccctccccacaaagtgtgggattgctcctgtattctgttaatgcctatttgttaaaagagttaacagtgacccttgaaccatgaagcaactctttttggtgctaaaagaacacaagtgcccaagaatgcagcagcatcgaaactggggatgaagtgatttgttcttgacatcagttggcaggtacattctcttgcagagagtaaagatgaaatagaatcccattcatagaaggcagtttgtagggagggaggctggggatgggaaaatgagctcaggctcagaggccttttacgtcttagtgttctcacaaatatgcttccaataaaaaccatttaaaaggcaaaatataaaattcttccatttaggaggaccttgctgagatctatggtggtggtttaaactgtgccgtgattagaaccatgccctatgaatgtgtaatatgttgtcgaccagatggtcatataatgctcactgtcctggtgagtttgaattagggagctggggaaatcttggctgagaaaaggtaagataaggcaaaagtatatctgcttgaggggcaaagttgcattcaactgatttggtctctgcagaagtttgccatagaaatctgtcagtgtgtactgctttctactattaattggggttttagtcacatgctttgtggtttgttcatgaagtttttatttaaatgacttatgagaactatcaaaatgtttgctctgaaggcttaaattgtgttcttatgccatggattttttttcagatgatcaacttacccatgtgaaaatgcttgagcaggttggctgccaaattgtaatgaaaggctgtcagcaatgccttgatttatctttctttcacctctcctggatatgctgtctgcttcctaagtctaagagggatatactcagtcctgcagacaacatctgtgcttctgcatcaggttccctgcctttcttgggagctttaaacataagagtatcaggaaaggttccatagttggtgacaatagaagataggttagttttgggcaaatgaggaaatgaaatgagcttctctttctcctagcataccctgctgagatttattcccagcaccttcaagggggctattgtagaatgcaatccccagtgctctcagtgaaagggagaattacaaagtacagagtcttatcctttcactgtaatcccgggtgcacacttggattcttgatctgtaagtgggagtgtggtccagacctcattcaatgtaaagctcttatagagaccctgattttttaaagggaatttctgctgttgccacttgtcttgtcatcttctccctgagaatgttttaccatagcagttaataagttatgtgattttaaatacctcttcacttggaggagtcagtgcctgtggtaagtcctttgaccattcattaactcattcaaactctaggctttagctgacaactttttcattagcagctttctttgcttgttattttactttgattttcatgcttttcaccttatatgtgtctatctgttttccctctaggactttcatgaccctacattttcagcaattcattgtctgtctgatttgatgttattaccttgaggcctggagatttcttacacagaggtgtttttcattgacctggataaactcagaaacaagtcatcactgtcttttggcatcccgcctccccatttatgtgttattcaccatagtctaattaaatatgttaagtagcaatgccggaagaagtagattctgctttcaaaatggttttaatttatctcaacaaaggtagagaaaacctttgttgctttaggagtctaggagactcccctgggcaaagtttgctgttttttcttcccagattccccttgcccttcaccattcctccaagacgcttgaggaatgatgatttaaaagaaaaaggtcatgagggaggactggttcatagatatttcatgaaaaagtgtggcctgtcttgggattaaaccattcctgggaagtagaaatgagctcttcattgctttgtaggcaaccacagtatataaata

SEQ ID NO: 96573 - DNA, 1135 bp, Homo sapiens
ttataagatatgtcttaatttcagatacattaatacttagaaacaacacccatgactcttaaaacagagggaaacctatgaaattgctactggtttttcattgtgttaaagataccataataaatgtctttatttataaacttgcctatatttgagattatgtccataggatagatgagaagagagttatggacattttctaagacttgtttctttttgccgcattgcattctaaaagggtaaaacatatttagagtgccacctgcagcttcttagctcttgtttgactgtccccctgacagcaatgtgtgttgacttttccacaaatctttcctaatctgataggccaaagagagtctttccatttggaagtgaaagtgaacattttctattttattaacaggttgtatttttcttttactttaaaaaaatctcttttgcctatttatttattgggtcttactgtttttcatatgcatgagctctttgtgtagtaggtcagaggttagctaactttttctataaaggaccagataatagacacttcaggctttgtgggccatacagcttctgtagggtgaaagcagccttagacaataggcaactaatgaggatggctgtgctcccatatggacgctgagatgtgagtattatatagttttttatatgccctggagtatcattcctctttatttttttagccatttaaaaatgtaaaaaccattcttagctcacgggctgtagaagaacaggcggtgggctggatttgattagcgggccatagtttgctgacccttgtaatagatgataactcatttaatttattttgactattttcctcacttccttttttagataaattttttaggcctacagaagtttgaatttcttacaacatcaaattttaaatttctgaccatttttgtcatgattctgaaagttagaatgttcttactaacgatcatatccaaaaatacacgacttaattttagcttcggagacaatgttttttaaagaattcgcttttattcatgtggaatctagttgtgtatagtgtgatttggaggtctaaatttaatttttttgcaagcagcaaaccaattgtgggttgcttttgaatcctcctggttagtac

SEQ ID NO: 96574 - DNA, 1561 bp, Homo sapiens
ttaggtagtttcagatgttgtgtttaatctttttttttttttttttttttttttgagacggagtctctttctgtcacccaggctggaatgcagtggcgcgatctcagctcactgcaacctccgcctcccgggctcacatgccattctcctgcctcagcctcctgagtagctgggactacaggcacatgccacccagctaattttttgtatttttagtagagacagggtttcaccatgttagccaggatggtctcgatctcctgacctcatgatccgcccgccttggcctcccaaagtgctgagattacaggcgtgagccactacgcccggccgtgtttgatcttttaaaagcccataaatgctaagcgttgttctcatctgtaaatagtggtgaaacatgaaggtatgaacaggtgtgctctaagtcagagggcggagtggaggggaacctgcatgaagtatctttccttagcaggccaggcacattccctgctgtttttggggagcgggctccaggatcctttccctcttggaaaagagcagaaagtgccaattggatctctggtcactgaataaaactgatctaccctctgagtgtggcccagctcttaacaggagcaaattgagacctcaactgaattctgccttgaagatcttttgtgatgtttactggtccacgaagacaggagagtgagggtaggaaggtgcaaggacagatagttgctgccaaaatgaatttggccaggttcattcatctgctctcccttgcacacagctctctcattccttcctctttgactttttaaaaaataaactttttgttgtagtatagtttcagatgtatgggaaaaatgaggctataatacagagaattcccacatatcctgtatctagtttcccccattattatcttaagttagaatggtatgtttatcacacttaatgagccaatacagttaccttataattagctaaagtctgtgctttattcacctttcctcagttgatacttaatgttctttttcggtccggggatcccatccaggatgcggtgtcacatttagttgtcgtggagccccaggctatttttggttgtgacagtgtcccagactttccttgtttttgatgatcttgacagtttcgaggagtactggtcaggtgttttgtagaatacccctcaattgagatttgtctgttgtttttctgtggcgattcaactggggttgtggattttgagggggaggatgacagaggtaaagtgccattttcatcacatatcagtgtgacttatcacatgctgatccttatcacttggcggaggtagcgtttgccaagtttctgtactgtaaactgaaaaaaaaaaaaaacccacaaaactgtaaaaacaacaagcaaaaacccaaacagctctgtcatcttcagaaggacgtcactgtgtacagcgtacacttgaggagtgggatgttgagagaggaggatctatctaacttatttggaattcttctgcctgggagatttgtctcttcttccccatttatgtattcagtcatttgtatcagtg

SEQ ID NO: 96575 - DNA, 1131 bp, Homo sapiens
ttggacattgaagcacatcttcagacttccatctctgggtctttctgcagccccagaacatgtttattgaatgaattaatgcatcttcaatgaatgtaactgttactactgtgtatcatcggtttgttcagttaaatacgtatcaatggacaagcttttcctttcctacataaacattttgttttttggttatcttgtatctcctcacatcccatagcattgcagtggttcacaggcacttaacagagaaaggggacaccaagctgaatttaaatagaaaaaataatgaaatatatatcatctttggggataatgtcattttctgtttcttcctacaacttgagccctcagaattactcgtaatggggtgtttgtgtcatctgattgccaatgatggctgagtgagtgaatgcatatttggagtgacctggaattctgatgtaggtaagggattcagaaggattatgtttagattaatttttctgcagagttctccagcagagtcctaatcaaaaattggtggtggtggcggtggcagtggcagcagcattaaacacaacaaaggcagaacggatccttatttgcatcattcagtccagtgggtgccgttagctaccatcctagagtgggtgtggaataaattatatgtataaaatttttttgagaagaggaggatgagctggtcacatgtggcattttctcccatgttgaaataacatgagatggagaacattgtgtgttgatgtctatctacaagttgatttttgtcttaagataagcagagcctccctacaacaggccctgagtactgcatcaccttcctccagtttgaaaaactgacgggggttcttaccagtctttgttaattcctgtctccggaaagaatggttggtaaaggcacatccgtattctgacatgttgagaaagaaaggatacatgcttgggaacagaagttgaggctgtaaattgttggtggtcttactagtattgggaggctgttttatccctggcatctagctgcttgtatggacgctggggttctagaaataagtttttactcctttggctataatgagctgggcattatcattaactagaaggctggattggaaaggtttgggaagcaaaggt

SEQ ID NO: 96576 - DNA, 1007 bp, Homo sapiens
tacaaaaggaggctggattagattagtttcatttgttgtttcaggctctgaaatgttatgattccctatgtctataagtgtatgctgcacatttttttccttcagtagtagagaatgtctgcaatgtggttaaatccttattctttaattccagtattatagaatatgggttccatgtaatttacattcatgttgtttttcttgtcaaagagggaactgagatagttatctactgtgttcagtagcattttgagtggggagagagagctatagtgtaagcttgaacttgagcagacattagcactctgttaggttacaattggtgttaacagtagagaaaagaatcagaggaagaggaggaaagagactggtgtgtgggagctaaggcccattattttgttatgggcttcttccccttttgagtgacttaaatgatgtgattgaagatatttgatagctccatcaagatggtagtctcaattccttctacagcccacactttctcctcctagatttgaattgttatgatggtagcataatttttgacaaatgatgtttgtgtggaagtgtaccttttatctgagttgagtcattgcttttgatattatcacctccattttacagatgagcaaatttagtctgagagaatggttaaatttagaatttaaccatatgaccttccaggcaccacgtactgttccactttaagtctaagacgtttcatttacattttgttcttactgatttagaaaagtttattgttttcattttctcacattacttcctggtgcctggcataggactataactgaaacatttttataaatgatttaaaggtattgaatgtgatgaactggaaaagaagaaaaaagcttcctgagtcacccagacttcatcctggctctgtcactttgtaatcttgagaggaaagattaacttctctaagcatcagttttcccacctgaaaaagtcaggaaaatattattttccatactgggttgctggga

SEQ ID NO: 96577 - DNA, 1962 bp, Homo sapiens
caccatcacattgtcttctcatttagccagtgaaatgattggcgtctcactgcagtagtacagtgatagtcattgattgacaagaccttctctgggaaggactacatttattctgatttctccagatcagacttttagaaccaggagaggaagtctgttcatggtcagagttcttgctgagtcaatgtagtattttgaaagctattgtgccaaggccccaggattctcagacctggctgagcaacatgtaactgatccaatttctcactgactcaggaggaatgctagctaaatcttgaatttggtactgtgacttcaatagtgggccagtcaaggggctcacgcctggtggaccaccatcccttcacccccaccccaccaaggtctgtctgtgcttggcttttcggactcatggtgaatgcttgaacctttttattcccttaacataaacttattcttctgggtaaaaaagtgaatcctatccccatgaaggatttgcttgattgaaatgagacccccccttgggagagaagtataaatgttgtgagcagagtggccttacggtagcttgctgacttcctagaggggtcgttgtgggaggagagccctgctagttccctttgccccaaattatttcccctctgtgcttgctacagaatcactaagtgtactgatagctcttaattacttctagttaaagaagagcaagccacctggtctctgaattaattagagcaatactctttaaaagaaacatcctcctttccctccttctttgccccccagcaaaatatttcctattagaaaaaacatatgaagccattggttagttttcacttcctttcctaagggatagtcagctaaatatgctgtcctgagagaatttgacagaagcagataagatttttgataagagttgaagagaaattctgggaagggaaggtaaattatactccctaataaaagccctaacaaacagcaggcataattggttgtgtatttgggggtgtgtgtgtcagtgaagtggtgtgtattctacataccaccagtgggaggaagaatgctgaaaaaagagaagtaggtgcttgctcaagacaggaaatataccacttcccttaggaatctgcccataggccatctttgcttatattatccatgcatttcattggcagtactctcctggagtgagaagtggtgtatgaagttggtcctaaaatccactcctcccatctccttcctaagagaaagttaacccactttgggctaactcaagagccagccagttatttttgcccatcactgtaagtaggattacagctcaccttaaatattggggaaaagtcctgatcatttgttcattctattagctagggccaggtgttgtcactgtctctagcaccgcttccatttcactcccattaaatcttagcaaattcctagcactctgaacagtgtattttacttgaatgattcccatgtggccagacttctgggagctgagcacatggtacccttttattgggtgccatgaggtaaccttggtaccctttggacattcagctttcctttgaggttatagctaattctctgatgaacatttaagtgggtggggctgtgtgttagccctactgtgtagcttttgtgatccagggaggtgtgaccccattgtggtattcccatagctgagatcataaaagcatcccaagtgtcatttggaagccaaacagtaggttacaaactcattttgggttaatctccctctccctaagctacttcatctccttgaatgctgctaactgtaagcttttatttcctttcctgtgttatcactcattaaagccttctctgacctgtataaatgagactggctttttcctcttagtattgtcttcgagcacttggcaggtggcatttggagccagagcctgatgaaagttgcccttgtgtattgtttttataagc

SEQ ID NO: 96578 - DNA, 1216 bp, Homo sapiens
agtttcaacttgaatttgtagatctggatagtcaaaccttaacaatacaggcataggttgtcctctgtgggtatctgtagtgaattacaattctgtattaacttctacacgattacttatcctagtctcattagggaacacgaaattacctgaacaaaccataaggtagcatagacgttcaaatctgacatgtgcaaagttccttaagctaattagaaaatacacacattgatctgtgaatggatgcccttctgctcctttagggccagtgattgagaggtgtctgttggaggttggtgttgaacttgtgcttgaagtctccggatacaaaacttcacggttctggtttaagcagaagtcttcattgaatgacatcgatgtggagagaaaattccttggctttctgtcagctgaatctgctgatttgtaagactcttggggcaggttaacagccttgttggttgttgtgctgtgctgacagtgggaccaagcggggatcaggaaatagtctagggcattgcaaggttggatttgcttacattgaggtgttcctgtgatctgtgcacatcacccaaggtgatcagggccttgaggcttaggctgaaaggctggctttcgaggcaaaagatcagaaggaagaaaacatgctggcacctgatgtatatccccttttgctctgcttccatctacggttgctgcctgctcctctgacatgtaactcacctcctctgtgcctcatattgttagagctaaatttcccactgaacccagactgttatttttgacctgccctgcctatttatttgtgcaccagtgagtgtgtgagtaaatgcattatttttattattattattttttcttttgagacagagtcttgctctgtttgcccaggctggagtgcagtgtcatgatctcggctcactgatctcgctgattgaacctctgccttctgggtttaagcaattctcatgcctcagcctcccgagtaggtgggactacaggtgcttgccaccatgcctggctaattttttgtattttagtagagatggggtttcaccatgttgcccagggtggtctcgaactcctgagctcagataatctgcctgccttagactcccaaactgctaggattacaggcataagccactgcacccagcaaatgcattaatttttaaaaattatagcagctcttttggaagaattgaaacatagaaaa

SEQ ID NO: 96579 - DNA, 1172 bp, Homo sapiens
atgattaaatcaagctacctaacctattcacctcaaatatttaacttttttataacatttgagattttctcctagtgatatcgaaatgtacagtatgctattattgtatttaccatgctgtggaatagccctcaaaaaaggaagaaattctgtcatttgcgacaacatgagtggaattagaaaacatgctaagtgaagtaagcgaaacacagaaagacaccacatgttcttacatatgtgggatcaaaacaatcgaattcatagaggcagaaagtagatgagtggttaccaggggctgggggaaatggtaacgtgatggtcaaagggtaccaagcctcaggaggagtaaattaatttatttttgagatctaaaatgactaattttaatagcttttttctgggatccatcctgaagttaccagttttctgaagaaaagcatttgaaccaagaatccaaatgtgggcttcactacagaaaggagaaacacagggcaaaactgtgtctaggcgcccctgagaccaccccaggaggactgttgggctccctgtgacctgttttggaactctgggggagctttatcagggaatacacttgctggaagctgcagaatatgggagagactccgattgtaacaggcaagtttctggtgagacaaaaatggattaaaccaagactaatgccaggcatcagagacagcaaaatcatccaatttatcatccttccctcaaggctgagaggtttttaagtagtttggaaaaacttggaaagggatagggaaagcttgagaataatttaaaaacttgtcccctgcaggccagtttgctaaaagccgagttttaccaaaaggctaaagcagtaattaaagcaaaaagcctttgaaaaggaatcttgaactaccccattaacagagattacagggtatggttagtaaacaccagagtatttaaaagagagtagtgacacagaaatgaatgccttgtgaaaagacgaatttggtcaccacaaattatagaaactttcagaatatacagagaatgcctgtaagccaaatggaactgttggtagaactgagttaaaaagtgttttctgtagagtttcatttgtaaacgtgatttttaagagtacaagctgaatattacttaaaatgccagtaggaaaaaaagtcacaccc

SEQ ID NO: 96580 - DNA, 1360 bp, Homo sapiens
ggaaacagccagagcttcagatagccctgggtctcagatgccttagtacagaataaaataagatccgataaatccatcctggtggtctgcatggcatttgtcagtaatctaggattcctctgtccatttaccctcctcttctttgccttggtatcatagggagcaaaacatgctttgatggacttttgctttctatattggacctcagagagctagagtgatgtgcttttgaggtcccttacctgagggagttgggggttgggggtgtctgtgttctggtcaaaaggtccttggtgaaggtctgaaaagcctggtctggaatgatctgtgggaggaactgggcccattgccccatatccttagcccacctccttcctcttcttttgcaaatggttgtattatagttggtgggtctgcccattaaccttgcctattttgaagcctgggaccttttctttgtttagggggaaggccttttgatctcctagtgtgctaggattctggggagggaagctcatgaggctggtatagtcattaagttcagctgttcactaaaaattacctttctctgaatttggaagatagcaaccatgatagtaattccctctcggcctcaaagggaaaatgaccactctagtttttgtttagcattcccctgtccttagggcacaaaaaccttgtggaagtattcggtggtacacatgaaggaacccgggctgggtgtctgtccacctttgtatttagtaaatataacggattagcgcgttttggtgggaggaaaatttgactcttcatacttaatgtgtaatgtacttgggatttattaattgattgatttgctgcttgtgttttttgggcctaccatcttttttttttttttgagatgtagtctcattctgtcacccaggctgcagtgcagtggcatgatcttggctcactgcaacctccacctcctgggttcaagtgattctcctgcctcagcctcccgaatagctgggattacaggcgtgcgccaccatgcgcggctaatttttatatttttaacagagacagggcttcaccatgttggccaggctggtctcgaactcctgaccttgtgattcgcccatctcggcctcccaaagtgctgggattacaggcataagccaccactcctagcccgggcctaccatctttttattctaccaagttatgcccctccatttgcttctggcagactttcatccagttcaagacccttttaacttatcaaaggtcacaagaagatgctcaagagggaatcaaagtgagtatgtggaatgcagggtattctgtcaaaactgttagaatatattaaaaattggaaaagccaaagcttgaa

SEQ ID NO: 96581 - DNA, 1060 bp, Homo sapiens
aagacttcctcctcttcatgtaaattctatcccccagtattaacgtttgagataacctctatgaagcttcttataaatccttccagaatcgtgtatgcagtcaagcagggcccctgggattagatatatggattgtatttagattatagtaggaatgactccccctgggtttgtgcagtgcacatacccttggccacacgtggtcaccctatatgcagagtatactctacctttaaaacaatacaacataggattacattcagtgtactgtgctataccttgcctttttcaattaacagtatataatggaaactttgccattgtctttaaaggatattgtcacactgccaaattgccacattccccctttgtaaaaggcaacacctatttaaattaccagtggtgtatgagagtacctgtctcaacccattcttgccaactttgcattttatcaaacttgaaaaatatttgctgattggtaacatattcattccaaaaatgttttaagtgacttctgtgtgcaaggcttcttgctctatcctgcaaaacaaaagcaaatcagaaccgtgctttcttcttttctagatgtctgtggtttaatggcagtgagggacaaaaagcaagcaaaccacaatttacaattattttatgtacagatttatcatggaaacaaaggggcagctgtagtaagccattatagtttaatgtaaagtttaaaatgccatagaaatatgggttattgctctttgtgttgcctgcagtatttttcttctcatttgtaaatatattttccatttagtttcttgatgtcttctaggttagcttattgcataatttaagagcctttttccttttgctgcatcaaatatatggtagatagccaactttttaaggactctcttttaaaaaccttcctgaaatgataccattttattctttttgtaaagacccctatagaatatctagggaggttgagaagtttctagtattttgaaataagaatttatagcaaaccctgtgttttgactaattgtgttctataattctgtgatgtggctat

SEQ ID NO: 96582 - DNA, 1001 bp, Homo sapiens
caaatttattctgaggatagacttccctgccattgcaagtagaccttctgtcagttgttataaataaactcaagtctttggatgttccttctgaggttgaattggcatagggggccgttaattaaactgtagcctttcttgggactctaacaaattttaaagatgagtaagacaacattggaggtactccctgatagtcctgcagtgtaggataatacaggagaagctccaggatccatctcctgagagctggctttgcagcgtaggataatacaggagaagctccaggattcatttcctgagagctggcttcaaaagaagttttcaggttgcatggcaggcattgacatggactttggagtcaggcagacccgggcttgagttctgcctctgctctatactagcagcgcttacctcatggagctgttagcattaaatgaggaggtatttatctatctgtcatttcccagaactgatccaggacctaataggcgctgaataaatggtaggccacttaattttatatcacaagagcacattcttaaatctttattcaaggacaggaggccctggaactaactaatgaaggaaagggaaattgctgtgtgccatcaagcagaggatcagaaaaagaatatgagaataattttattagcacttacaattcactgcgtttcaactattgcaaaataacagtatgcaagagtgtaggttgtcttacagaaatgatgtgctcttgtttgtggcagctcattttaggggagaagtcatctaggttaccatgtgtttgtagagcagaagacttaaaagtggacaaaggaagttggcattattctggaggatagaaaatcaacccaacttctcttctcttcccaccactggactctgggtgagcttgagaatgggaagtcttttctgttgcctagtgagtcaactcttaatgtagtctaccgtggacatcagggttggtctgaatgtaaagttgcatgcccctggacaca

SEQ ID NO: 96583 - DNA, 1018 bp, Homo sapiens
attcaatttctgtgacatcagttctagaagccctccttgatgtatatgggtagttcacaacagtgagtaactgtggttaaaaaacaaagaagagtaagttgttacaggtagaggcatgtagagaacacattcttattagtgccggaagtccttatccaagagtctgcatgcagaacacagaggtgaatttcattctttttctttgaagcattttcttaatcttttcacatcaaaatgagggaggacttttgtgggaatgatgaaaacactacttatgaaagattgttaagttcttatttgagtctgaaatatgactaaatcttgccagcctatcagatgcagttgaaatgggaacctctgcaaaactgtgggaatcaaagaaaaactgccttcaccttgtctttttcaaagaaggggatgtagggaaggcaagatcctcttcatgactttttggaagggtgatttctatagtcttaacaacatttgtagaccatgtaatatgtgcagagcactaaatgggtttataggtaatgaaattttagacttggagttgaccttaattgtaattttattcaacctgcttattttgaaaatgagacaattaagaggaagtttactgcctctttaggaagttaaacagctacacatctttataaatatttttgagttttatgatgtagcaagtgattgatactcacaagcacacccagcacattcaaatacagaggatctacagagcattaacaagttcgctagataatagtgatacattttctaggaagaggtgggatttgaaccaattttagtaaaaaggggaggaaagacagagtggtagtgcatgcatgtagtgctagctacttgggaggctgaggcaggaggattcttgagcccgtgagtttgaggctgcagtaggctataatcatgccactgcactccagcctgggtgacacagagcaagaccctgtcttaaaaatgggggacaggaggccaggcgtggtggttcatgcctgtaatccca

SEQ ID NO: 96584 - DNA, 1036 bp, Homo sapiens
tggagtgacccaagatcacatcattgcactccagcctcggcaacagagcgagagactccatccaaaaagaaaaaaagaaaaaaaaggagaggagagaaacagcatcagttgctgctggggaatgccaggaaattaagtactaaagagggttcagttgagttcacaacatggaagtccgtcgtgcattcacacagtgctgactcagcctgctttgggccaggctctacgctagacactgagggttcaaccatgactgagattttcttccagtggcttggaagaagcagaaggcagccagcaatgggttaggagggtcaggacagaaactgactatttaagcagtaagttccagaagactggaaggagagagggcagccgagtagagggtggggtagctgggggattttcacgatgatgatgatgatggaagagacttgagagtgtttaaatgtaataggaagattcagagggagagactgaagatttggaagggagagaaaagctggatagaggcatgtccatgggagtatgggatgggaaggagaccaccgcccagaccctgcatgggtggtctgcatgactatcccacaagaaccagcttgatatttagtctgatttgagggtgcttaaaggccccattcgggtttgcctcacttaggtgccacatagccttaatttccagcatgaaagatttattcctttggactactttcatttagagatatgcaagatattcctggggcaggcaggataacacattacagaaatagactctaacgagcaagtaaatacttagctcccctttatcctaatgggaggtagtgagcttgcgtgctcaggaggaagagactgaatcctggagtctgtcctagcctgcctagtttcagttctgatttagtggagacaaaaggccctgtatgattttaacatagttgtggcagctgtttccttgagatcagttcaataatggtattaaaatatgatagagtcgattgaatgttcagcaagcctatgggtaactcagtgtcccctgctc

SEQ ID NO: 96585 - DNA, 1068 bp, Homo sapiens
cccttctgattaacataacgaagtgaggacagagccagctcagttctctccttttgcagtgttccgtggagcgtggagacaacagtaccttcaggtactaaaggcttttcatgttttgtagttacagcagttagaaatttagtaagacatttcagtgttatacttaaagatgaaaactaaaaagcttttctgattttaattagattgtttattcgaaaaaccattcattctcctaaaatttttgtttaaaaaaagattggctcatcttcattatccagactgctgcatataccatgcacagccagaagttgccatagttagaggggccaggagcagagccatcctcagctcctccctactcctcccttctcacttaagtcagccccatgtggcatctcctcctgctgtctgacctcccatcgcagtctcctctgcctgacttcactgtctcctgcccaagctctcacaaaagctcatagcctcttacctgtccactcgttccttaaaatcattgacggttgtcatctttacaaacaggacaagatcatgaggtgatgtccctgctccatgtgtccattacccatggcggtggattttgaaggttcttctgggatgtggcaggtcgctgggtctccaggtcatgcccttaccccatcctcagttggcacagctctacttttgttctgccttctacgcttggagtaagattttgttgaataaaacattccaggttgtagaaaagtttgaaaaccatgggaggagataactgctaaaatgctgtgtctttccctgtattctgttggaggtgctaactttgaactcttggacttcagtttttttttgttgttgttgagatggagtctcgctctgttgcccaggctggagtgtggtggcaccatcttggttcactgcaacctgctcctcccaggttcaagcgattcttctgcctcagcctcccaagtagctgggactacaggtgtgtgccactatgcccggctaattttttgtatctttagtagatacggggtttcaccatgttggccaggctggtctcgaactcctgacctc

SEQ ID NO: 96586 - DNA, 1059 bp, Homo sapiens
taattggaaacaatacatgccccaaatgtgctctcgtgtcctagccaagaacatggtttcaaaaacatgagaaataaggataatgaaatgaaaaacactttagaaagcttagatacctcaggtattgtattgtgggggaaatgaaaaattaagtattagatttatatgttttctggctgggcgcagtagctcacgcctataaccccagcacttcgggaggctgaggtgggtggatcacttgagggtcaggagttcgagaccagcctggccaacatggtgaaaccctgtctctgctaaaaatacaaaaaaatttagctgggcatggtggcagatgcctgtaatctcagctacttgggaggctgacacaggagaatcacttgaatttgggaggcagcggttgaagtgagccaatagcataccactgcattccagcctgggccacagagcaagactctgtctcaaataaagaaaaaaagtgggttttttctttgcagttgggaaaagaatatgaaataaagtggcaaatatggctcatttgattattttcttaatctttattttttctcttgtattaaatttaagactgtagacttcccactagatcttggagacactaaggtgaaaatcttcacacattaagttgaaaatatctcttttgggtgggtgtaatgtttcacttgtgaaagaactgttaaaatcctgctggatcacgggtagcatagggtgcaaaggcacagaaaaagctcatttttactgaaggagttttagagcctatgtcaggtgacaaactttgtctatttctgccaccttcctggagtatttgctccattgttggcttgctgtgaaggaatgtgggcagaaagggatgctgggagctcttcattaagatcaaggcctagttcttcaaggactactgaatgattggacctttcatcagcatacaagaggaagggattgagagtgtctgttcatgccattgatttaattggtcagagaaagggccaaagaaggggcaataacctcagagaagagcactgactgcctgtagctgttcttact

SEQ ID NO: 96587 - DNA, 1033 bp, Homo sapiens
aaaaaaacctctgattgtctgccactcccacacattctggtttaattgatggagatgacctagtcattcggagtttacaaagctccccaggtgattgtgatgtataacaaatttgggaacagatctatgcttgtattataaattctccacaaatctatttccttgctattcatattatatgtaagtttgctaggaacaagaacaaataaagaaggaaccacatcaataccttgtgtttgctagattcctaagactactacatatatactcttaattgatcataccctgtgcattagatggggtagaaatgatcccacttggctaacaaaaagagattcaaaggttagttgacttgctgaaggtcacatagctggggggtgatggagtcctgtcttaaacctggatctcatgtttctgccaccacataagcagagaaatgtagcgtatccagcttcctccaattcgtggcttgttttctctctcttcataatagagcccttgtgcttggatttataaagaatgtttcttttgatatttagggggaaaaaatctcattaacaattggatgtttgtagtccaacagattcgttatcctctaaggggcactgtgttgggtgttagcagttctctgctctcttcctggtacaacatatgatcttggtgaccttgggttagccagttagcacgtcggatttctagttgttagaagaggagttatcaaacctgtttgttctatctcttaaaggattgttgtcaaaaaatatcattgctttgtaatggagaccaacatttatacttctgcagttatacttgctcctgaaataaatttttttcttacctttttgaaataatagtttttaaaattgagccattttcatatgttagacatgaattaattcaaccctcacaacagccctgggagatagggcctattacccttctcttggtgatgaagaaatcaaggttcagtgacttgctgaaggtcacacatcttattagagacagagctgggattagaaccaaggtggttttg

SEQ ID NO: 96588 - DNA, 1012 bp, Homo sapiens
ttgacatttgtgcttagcgaagtggagggttctgtgggggataccaaaaaattgccctaatctctgtcctcaggaatcttattgagaaggggagatgacctgattgctagacatccatctagcttccctctgctaggcacgagatgtacaaaggtttaaaaagagccatgaatgctaacttcttggcttacagcttagcagggaactcagccatgacttgtaatacagtgggatcagtactaccatggcagcatcaacaagaaacaagtgcgatctcatagccctgcgcaagtagtgaactaccagcaaagtcggagaggcttcatagagaaggggagttgagcagagttctgaaaagactcccctctgactagtgggacagggcattcgtgcaggcaagaacaccctgtgcgaaggcactgaggtgtgaagcagcctggtgtgttggtgagtgctccacaagagccatgtcagacctcaattcagtgctattttgtgtgttgcaggcaggaggttcaaaggagcccgagagcaggaaggctgaccaagccagatttggaaatacttggctgggatgttcctggtcagtgggctatttgggcaaagtggttaaagtgggacaaaggcacagggaaggaatccatggagggaaggggagaaatggctcctttagtatcttgaatgaggcttttggatgtgagtccaggtacagtgctatagtttaattgcttttgcttctgtttctttaaggatacattgcacttaaaccccagtaattattccagattttgttagtggatatatccccaccccccatctggctcaagctaagcagttggcataagtaggggaacagaaggctcagaattgtccactggaagtactcggcttttctttggagagatcaggtttcttccatgggaaaatgatgtcaacacacttatcttagcactttgcctcgagggcacctgtgggcttgcgcctagagcaaaggaaaggggttccctaaaac

SEQ ID NO: 96589 - DNA, 1048 bp, Homo sapiens
aacctcctgtgtccttatgctccgcttggagaggtcatcaattgaaaattctttgcttaattgagcatgcaattaagagtaaggaaatacatgttctgatctttttcttctgctatgttttctggttataatttttttaaaaagaaaataatgtctccgtcctttagttttcccaccttgtaaaatgggagcagtatgtgcatcctaaggctagtctgaagaagcattatgccgtcatagagaaacacagtaattctatggtgtgccgtatttggctgtatactgcattttagagtagttaactaccattggatttgaaatagtacatgaaactgaaacactgcatttattaatgagggtaatttattcctaggaaacctttttaaaaatgaatgtctcctttaagtgtttgttggtttcccctttcctgaccataccctccctgctttgtgtctgtgttatttcttttaaaatttcaaatagatttgaataacttagcttaaaagatagcctctcccctccctaataaaggacaaaggtggctattttagaggtgggtgatatttgaggctgaataatgcaatgtttacggcatacacaggaagtgggaagacctgggttctggttccatttctgccttttcaatcattttgtgagctgagcaagtcccgtaatctcaggtgatgtgtatgtcccttagcacagggcctgttctctagtaattgctcaataaatattaaccattattattggttgtcttctgagaatatcacttgaagatttagatgaaagtatttggaagattgctgtctacgatttgtcaaccgtggctgacaactaggacgtgggaaagtagagaagaagctgataaagatgaaaagctcatctatagaaagatattgaaaatttatttcttctagattacaaaatgacattagatattataccctatgagaaaaaatacgcttaatcaacccattttcctcttatggccataattagtacatagtcgcatcaataaagattgacaatatagccttctcatatt

SEQ ID NO: 96590 - DNA, 1081 bp, Homo sapiens
aagaaatatgtacaatgaatatcttggaccatggagtatttgtgtagtttatcacatttggaattttctgccccttggagtttgtttaatcgtaagtcaaatttatttatttacttacttagagtctcgctctgtcgcccaggctggagtgcagtgacgcaatcttggctcactgcaacctccacgtcccaggttcaaacaattttcctgcctcagccacctgagtagctaggattacaagagtgcaacaccacacccagctaatttttttgtatttttagtagagatagcgttttgctatattggccaggctggtctcaaactcctggcctcaagtgatctgcccgcctcagcctcccaagatgctgagattaagggcatgagccactgcacctggcccaaatttacttaaaaccaaactttttcttgtcccatctcacttgcttacccagtgttacctgctcatcctgttcctgtgacactgacatcaggaaagccactagctctgtgatttacagttgccttttgagtattggctgaagagaaattttacctctaaatgtaaagctttttaattaaatggaaaatgagcttcacttactttatataattaagatgcagtcagagctgggtgcagtggctcacgcctgtaatcccagcattttgggaggctgaggcatgtagatcacctgaagtcaggaattcaagaccagcctggccaacacagtgaaacctcatctctactaaaaatacaaaaaattagccaggcgtggtggcgcacgcctgtagtcccagctacttgggaggctgaggcatgagaattgcttgaacccaggaggtagagtttgcagtgagctgagattgtaccactgcactccagcctgggtgatggagcaagactctgtctaaaaaaaaaacaaaaaacaaaaaacagatgcagtcagcacttatttcacgtacctgtttagactgtgcttagttgccaatgattgataggcattagttgggtctgaatggacctatggagccatggagcttttatttaacaattctttatctgatgtctgggaagcagaggaga

SEQ ID NO: 96591 - DNA, 1345 bp, Homo sapiens
ttaccaagaattatagtgcagtaagccacagcagacagctagctgctgaaatctataaaaacttatttagagacgagcttactcatcattagccttcacttttggagctagagtttttattagttaatttcattagtaaaggaatactcctacaaactggggaagtctcaggtgctcagattcttcatctataaaatgaggatgttggaaataaatgacttttgaaaaatcttccaaaaaaccccacagtgtctagattttggtgctgttttacccccatcccaaacttgtttcttcttccttgatttcctgtcagctctgattgctgtagatcctggatgatgacaaattggtgtctcagagtaaggagcaaacaagacaggagcctcaagcaggctgtccgttgatttgttgtttgggtttttggtctatttgcagcttctcaggtcctagccaatacaaataggtgaggttcttatataattttacactggcaaattagaacaaaacaaaacagtggagggaagcgggagatggacattgagtataggttggacaataacgatagaaaagtggtttggattctttataattatggtctgacatggttccagtaaaggtgtctttggttaaattaggtaatacgtggtgtatatatatacacacaaactatagacacatgaacatagcagctgctaaatttaatgccccagcgttgcttcatactacatgtagattttaatgagtcagcacagcctgctaaaccaagcttctggcaccgagagcctttttaaaactcatctaaacactattattgatcattcacaagtggtggttaaatttttttttaaatagcagaatctttgttacccaaattaaaagttacacagaaccacagtatataaaatagttaaaagccaaacactgccttgttcctgggctccctggggcctccaggggactttgagaactttggttacattgtttgaaaaattctgactaaaatgtatatacttaatatacgtatacatatatacatatatatatatatatatatattttttttttttttttttgagacagagtcttactgtgtcgcccaggctggagtacagtggcatgatcttggctcactcccgggttcaagtgattctcctgcgtcagcctcctaagtagctgggattacaggcacgcgccaacgtgcccagctaatttttgtatttttagtagagacggggttttaccatgttggtcaggctggtctcaaactcctgacctcgtgatctgctggccttggcctcccaaagtgctgggattataggtgtgagctactgtgcccggcctg

SEQ ID NO: 96592 - DNA, 1059 bp, Homo sapiens
actttttggctccttctatagtttgagtatgtcatctttatttctaagtctgtatgatatcaattttgcattagcacctcgactttgatgtttttacattctaaattatctacatgatgtaaaaaataattacttggaaagaaaaagcttaagtacattggctttaaaatatatataactgggagattgatggattcatggatgttgtgggttgtttttttttttttttttttttttactctgtcatccaggctggagtgcagtgtcgcgatctcggctcactgcaacctccgcctccagggttcaagcgattctcttgcctcagcctcccgagtagctggcactacaggcacgtgccaccgcacctggttaattttttgtctttttttttggtagagatggggttttttggccatgtgacttacgttgcatgggagtgtatgtcctgctttacaggtattggccttggcctataactcgttcggcggaagaacataaatgaatgtgatgcaagcatatacttaaatgggatgccttaaatgtaattgggattttgtgctaatgtgagtatcatgagaaactatgccccagctacctgctacctcttcagcctggacaccagaatgacgtaggtggtgtagcagacctgattcttagccttagcaggcaggctgaagatctctaggatacatcacacagcaactacctgttggtctatcagatctaatttgaccactacaactcacaaatctaataataatcttgcatttttttgtctgaattagcagaaccagaagttacacttaagataggttaggtaatttctaaattaaaaataactctgggccaagcgcagtggctcacgcctgtaatcccagcactttgggaggccgaggcggatggatcacctgcggtcggagtccagaaccagcctggccgacatgatggaatgaaaccccgtctctactaaaactacaaaaactagcagggcggagtggcaggtgcctgtaatcctagatacttgggaggctgagacaggagaattgcttgaacctggga

SEQ ID NO: 96593 - DNA, 1018 bp, Homo sapiens
gggctatgcagtaacttgggattcttggcagtaggcattttcaagaatacagtatacatggaaaccagatgcatgcagtaaaaaatgtatcaccagccttgagtgcactgttcatttttccagtgagaccttcaaagggtctgtgaaatgaagcctggtgttttcctcttcaaggactcatttttgagtacactaagaacaaaattttggcctctctgttaggcataatttcagagtctctctctacacattcattggattttgcaagatatgtctgtatatatacacaagtggctcccatcttagtctgcagatttgaagcatatgtatgtgcttgtgcatagtcattctgcctctgcgcatgtttcactaaatttattgcatggactcttttatggctctctaaaggaaagtaaacacttaactgaacaaaaagttcagctttacattttaaaaaatttcttctaagcagaagagtttgagataaaacatgtctagtgacgcctccatttatctactgcttacctagtttactcgccaaaatagatcatttaattgaaactatccagtttgtgtgatgtcttcctaaaatacacttaactgattgaagtttgacccacccgttcattattatccattttcattcaaataattaacttgattatgacttcgatatagcactttcaacagccaaaaaacaacgttttggcctttttagtacttttctaccctggtatttcacgtgagactcacgtggggagctttaaaaaatagtgctgcccaggcttttcccccaagattctgatttaatttgtttggggtggagcccaggcactggtagttttttaaagcctcccaggtgagtctaacttgtagtcagaattgacagccacagctacagctacagctacagcgtttttgtaaactttattattgaaactaagcaattcaggttgaaatttgttttacgtgtaggattgtcgtgataggtcctctccagtgttcagatcaacctgat

SEQ ID NO: 96594 - DNA, 1022 bp, Homo sapiens
aacattatacatttaaaaaatcgaatgttttaacataaatatgggaggagtactccatgaaggtgaaagccagtgattctccttgaagaagggtattgttctgtgctagcggcatctccatttcgcctagcaattgtagcagaatagagactgcatcccctctcattctacaggtaaagaatagtttgaagagaaagcttagtgatttcactgccaaaagaaagcttttaacaaaattgcttattaaaccacacctcaggctgtgcagggacatgggaggagcgtgcaatttctgaaaaagaatatttagaggaggattttattgtataattggcaaacttctcatctccgagaataattgcttgatttcatggaaaggaccagaacttgggtatcttgaggcctaagataaatagatagcaacggatcatgctagtccccatggttactgggaactgagctcaagtggattgttatcctgaacaagtctgtgtcaggatattcttgtcacctttcagctctttggtatttgctctctttcttgaatcagcaaaagaaatcgctgtaaagttaatgtaatttacgggaagttcccgtgccacactgcatgcttttgtgtgtcacaagacttaagcttcctgctaccctctgttaaaggagaactttttatgttcctaacaatatacgattctttcaggagctatttacatagctgggttggttaatagacaactggggactgggctataagcattttgacctggaaatatttctttggggttatgtgaactactgtacaataaaacctcaattaactaggattacttggagaaaagacagtttctggttgaattttcttttaaatggaaggttaaacactttccttttctcaacccttcttattcactttcttcctttggcttttggaattcagatgttaagatcttgaaaataagttaatgtttcattgagttagtccgtaacagtgctttggaacatccttgagttatgaagcttgttat

SEQ ID NO: 96595 - DNA, 1057 bp, Homo sapiens
cttagttaattataacttgagtaggatgggaggggtcaatggcattttaacgtagaagaaccaagtgttagtaaagagcttttcttctccgggagcttggtcagctatgttttctgtgaagcctgattggggagtcaaagtcccagtggaaaagtgttgatgagaaggcagattctagaggatcaatatttcgaacctccttttaagctcatccaacttcacagctaaaaagctgttgaggcttcagaaaaaggaaaggcacaaaggaatgaatgaatcagaatttgcctggatgtgatgttcctgatgatggtcaaaagtcctgagagttccagccttgaggcctggcttccctctctctgcaggcctcttgctggttgcttttggaggaagctgagtgtttgggttgttgtgattgctgctgttggggatttcatataacatagctctggaaggtcttgtactcatgactattagttattcaaggccacctaaaatctaaatcaaagaaatgactagacagaagtgaaaaaaagggcctgattcgtgaaacgatttcccaactttgtgataggtcactcaaggcttagtgtaggcttttttcaaggtaggtgtcttttaggactgaatcggttccaagctatatgagaaagcttgtgtgtgaataggtttctgctggcagatggttggcaggctcaaccatcagccttccagacttgggattctaacaaaattctattctgtggcacaagcctagaataagtatgatccatataaatacattcatttatgcacatattagcagtacactgagttcttgtttttgtgattttgatgatctggtgcttttggttttcctaatactggttcatggagaaataagttgtactgtgttggctaaaacccgactctggatgcactaaataattcttctgagtttctttctctttttcctctagcctggaggaagtctgtctgctttctcttttgcagtctggagatagagcattgacccctgaagcaatgctgggtttactttattagagctcacccgcag

SEQ ID NO: 96596 - DNA, 1002 bp, Homo sapiens
aagtccatgttttttctctctaagcaagtggttatatagtagaagagttcctgttataaaatctggtgactgaatgcttgtgagttttaatttagagattacaaggacaaagatatattacataaggtgtatttcatactgttcaatttccctcctgtgtgtctccatatcactgtgggtttctaagtatgagccttgagaatatttgggtaaaagaaggattttacaagtttgcattaataccatgaaaccaggtcaggagctgatatcagaaaactctgttttgctaccacataggtctatttggttgtgaatgatttgggcaccatcattctgttctgtgttgtgtatgataatctgtgggtataacttgagatgtataggctaccatagattcttcttcaccataattactttctttataaagtactcaggaattttgggatattctatttttctttattttctagttataatttctattttcaaaaggttctgagatggaaaacacatttaaaagcaaattaagattgtacaattatggataaaaaccaaagtagagaccatacatgtaactaccacttggaatagataccaatctgaattaactggcactgaaacaaagttcagattcatggtttcatggtttattgtatgtggcagaagacgctcatttttcttttcaggaaaatattgctagaattgaagatttttttcccccgtgagttttttttggaaaataataagcaacagatattatcatggaatgatgttttacaagaaactgaaatactgttcagtgtgtagacattgttaatagctataatataaatcctaattcattaaggatatttgcaggctgggcagtatggctgattttgtttgctcttcagtattcaacaacctgcttaatgcctaccgtttgccatactgtgccatacgttgatggttaagaagaacatcaaaaattgttcttgaagcactcagtccagtgggaaattt

SEQ ID NO: 96597 - DNA, 1038 bp, Homo sapiens
tctgttttagaatcgatttctaaaggttttctgaaatctccaaacttgtaaccttcaggctagatggctcagacctcagcattgagtcctaatgctcaccctgagttgagtgtggcagagatgctgatgtttatacagaagactgagacctttcctcatgcagaattcatcctacctccaaaaaattccttccacatttttccagttctgaatagaaaggaaaaaatatgcacactcctagggagtgctgcttaggcccccacttccataccccacatggaggaagatgcttagaaggaagaggtgggcttcctcctggcacagttccaattttcctttagatcagctgtttctgggtttaggcaaagagaacaaagtgaaacaaaacaacagataagcttcccagaaaatgttttgcttcctcacaaataataaactggagcaggacataagatgtctgtttgggccttcattcccgacatttctgccctggcccatgtgcgttcacctgaatggccatgtttggtctgtgcttcatctttcaagatcagtcattcagctcagaaaaaataaaatggatggtggattaaccacccctgctttagtaagattctgtcaggagctggcaggaggaaatgatctgttccacacaacataattgtaatgcttaaagcctggaaaaaaaggagatttgttgaaataagacatggcttgcagttaaaatgagcttaaaattctcagctgtattatggtgggggagaaaaagatttcaattcggggctttaaatttcagccagacagtctaggttgggcagttttcctttaactgtgtctggagtcctcgaatacttgattcgttaatcttttgtgcaaattgaatagaagatacttaatttgctttttttaaaaaaaaattttaagcattttctatttagattttcttctaaatagttttaaatgaaacctctcgggcagaaaaggaagagcctaaattagatatctctatgaacagaactctccaaaccagcctccttattt

SEQ ID NO: 96598 - DNA, 1937 bp, Homo sapiens
cctcagcctcctgagaagctgggattacaggcacccaccaccatgcccggctaatttttgtattttcagtagagacggggtttcaccatgttgggcaagctgctctcgaactcctgacttcagatgatccacccgcctcggcctccccaaagtgttgggatttcaggtgtgagccaccgcacccaacctagaagcactcatttctatgtgtgtttcctttttctgctgtgtgagagtgaggatgagctgagaggaacacacgctgaatggcgtgggagctgtagagtagcctagcgagggcatcaatgccacgagtgatttcaggatgccctcctcgtcttaccttctctcatctcagtgattgctttctctttttagcagttaaaattttattagattaccccattctaactcttttatgttcagtattacctcctgcagccaaaggcatgacagaattgtgaccagttgcctccatggactttgtgcatctatctctgctatctgattagtcttttataggtgaaagtcatcaccaattttcagatgaaggttctaaccaaatattttattttggcagttatacttttataaaaagttacactttgatttccaatatgtattattgttttttcttctgcagtatcctctaagattttcctgaggatattaagtgtagctaccttctgattgttctactgtctgatcaggtgttgctatggatagaaacaattaatacaatttcttttttttttttttcttttgagaaagcacagttactttgtgaggggggaaatgcatggagcacaaaagcctgtctgtttaaaaactttgttcctaaaactatacaagagtgagcaagttaacttgtcatttattctaacatggttaacatgagtaataacctcaaaaaatgtcagagaaacaacagtcttactttaaagagcaccacactgggaggagattccaaaatcaaagcaaatccataactttgctagtaatgtatcacatatgcttggaaaagtacacttgccaacacactaggagaaaatgctcagtgaaaattgatgggtaggaataaattagtataagcctaacatattgacttgttaaagcaaaatgaagacagctgtaagatcttttcccccttccatcataccaatgttagtgacttatatattagcaagccttataaaataaaatacaaataatatatcactatttaatttttgctgctcattgttccattattcttttgccagacccattatttgtcattctgtattcttaaagctaacactgagcccatagaaattccattatatttcctttccagttttctttgtttacaaagactttccatactaaggtgcagatgtcttgtaggaacagcaagttatacatgttcgtttatacatgtgaatgtgaatttttcagtcttcaatggcatttctcttttgttttagttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcggtgagttcgtttaatcaggaggcaactttggcaggatgcactgggacagcaggctcctacttcttttgatgattctgggcactgtatctcataaattgccatacagcactttcatttgcaatgactctaaatgaatgtttctttaggagttcatgggatcttcccttgggcaatgtttgataactttaaatagcttctggaaacaccataccttgattcagcatagaaggtgggaaaattctgctgccaagtgatagaacaggatagtctcataggcagataaggttttgaaaccaggggaatgttgacatcctgatg

SEQ ID NO: 96599 - DNA, 2872 bp, Homo sapiens
tgaatatgtggctttcagacctttggatttggttgtctaattacctcttgtccctttgacttggtttttggtcatggaaagttaaacatttctctgtaatgaagttaagttctgctgaaggatttgatatttgagtatgatacctccagtaaatcatttagattttccttgtttagaactggaaaaaaatgttaatgggtttggaatgaattgattcaatattaagagcagtgtttcaattcaccttattatatttgcagtaggccaaaggttgtgcaacctgctaatctgcatcagcttcacatgtgggcaggaatatatgggctgatttggcagatatataaagaaaggctaattgtctgaagaatttcctgatcaccttggaaattcaggatgaatttcctgatcaccttggtactggaatggaaattctcaccactagtttaactgtaattatttgtaagggatttaatttacaaagtacattttaatttggttttctatcattggacacttagaaagtatcatgtattgccaagctaccaccttagtaaggatttgtttttctggttaataattcagtatgcttactttttaaagtattttttccagtagagcagaagaatcgggaaaatctgggaaacttcccaggttcagggagggatgtaaccctggatgctggaggtcgagggacatccaaggccagcctgttttgcttcacagttttgcttcaaagtggatcttgctagaattaatttcaaattggaaagtcagaccaaaagcatgcagatagggaaattgtatctggaaaaacataggcattatatatatgatgtttctggttggcaggtgtgcttgaagatgaccagctaagaaaccaataccacattcttctgttttgtgttttaatattttcaagctcaagaacagaacatttaaatttcctttgattctgctttatggtttctagtagcccaagaaagctgataaggcagtaactttcatgccacttaaggacctgaagcttagatttttgttttgttttttaaacaatgtatatcaatagttttccagctcttgtggttcatggatttatgtctggattctaattctgtatttggtcattggatatagcatctgtgacataaaaacagcaatcagaagtacaggcatatggtacatgttgcttttcatatacccaaacattgtttacatttttttcttttcctccttctctcccctttctttctcttctccacacgctgccttcacttttggctttctttttaccatcctcccttttcttttagccatctcatttctgattgtcttctcctcttctactttgtcctttctcatcctgctgtctccttcttctctggtttcattaatctctcatgccaccaccagattggtttctctgcctgagtattttcagttccattgccactagagctgcttctcccctcttgcctctggagcagcttcagtttacatactgatgatgaggcttcaaaccggaaaatctcataagtctcgggtgaaaacgacatccaagcgagttcacagtgcatgctggcagggcaatccgactgctctccatgttataatatgataaccttgtggctttgtgctgacatgccatactagaataaagcctgctgccttttaaactttgatacactctgttatcatattatgattcctcatttttagaatttgaacctttacagtatcttgcattttaatagcacaggttgtttttttttttgaaaaagaaaaagtatataaattcatgctctatgaaaatgatttattctggtagctttgtttaattagtatatgtcttctgtatccaaatgcagattttagtttcttctttttaatctcccgataataagacagacatattaatcttatctgataccacttggcaaaaggattggttaatcttggaagaaaaaaaatgagatttcaggaaatttaaaacacattgtaaatgggcatgattaaagaaaaaaatgaaaaacactgtgttcagctgggcacagtggctcatgcctataatcccagcactttgggagacaaaggtgggaggatcacttgaagtcaggagttcgagaccagcctggccaacatggtgaaactctgtctctactaaaaaacaacaccaacaacaaaaactagctgggtgtggtggtgcacacctgtaatcacagctacttgagaggctgaggcatgagaattgcttgaacctgggaggcagaggttgcagtgagctgagatcatgccactgcactccagcctgggtgacagagcaagactcaatctcaagaaaaaaaaagacaaacactgcgttctaaaatacaaggttggttttttttttttttttttttttaaccaaattctaatgttgacacacattttcctccttgtagtcatactttactttttaattattcaaaattgattgttaaacattttatgtcataacataccccttgagtcatatcagctatgggattctgtattaccatgtatttgtcagcttggctagagggaaactgttgctattgatgcagtagagacctggtttgtattgtcttctaaaattagaatgtggtgtgccttcggttaagataggtttctgtcagtgcggctacagagctagctaaatttaacaatgccatataggcacatatgtgcacatcagatctatgaagacaaaggctgtgttatttcagatgcaagagaaaatactttctgatttttaagaaggtccaagttaatgctattaactcgagtaagaaatgacatagcaagtaaatgagtttttaaagaaagaggtggagtactaacttagggtttggag

SEQ ID NO: 96600 - DNA, 1026 bp, Homo sapiens
atattaaataatatatttgtatatgatttgtggctgacaagggacttaagtatatatatgtttgtgtgtacacatgtttgtgtacatgagcacatatatgaaatgtcatgtgagtgtaacaaactctaacaatacggaaatgtagaggtgagagtaaacagcagaacctagggagtgattcacgagacttggtgtggatgtgaaacaacaatgagtaagacccagaggggtggctgggaaaagggagaagtcaggagagtgatctgagcggaggttcagtggtaagaccgcatgcttcctttaggagacagtgaagagatgagcctggctgcaagtcgtttagagacagtttatgtactattctgaaggttagtctgtgaaattgtcactgcagctcattggcagtgattttgttggtttttgaaaagaggggataatatgggaagaacatagaaatatttccatttaaaggtcacaggagtgagatggtttccttggacacatttcacatggggctatgtcctgattaattagcccccccaatagcaaatgcctttgacaaatggaatataatgaaaaataagaaaaatcaggctaatagtgactctccattcatatgatgggttgccagcctcccctttcatttgctccattcaaaaagtatgcactgaaacctttgattagaggctctgatctagctcttatctggtcctctaatgggacgtatagacagcgtttcaatgcctgatttaaaagttcattaggaattttgtttacttttttctttctttccctctttctcttcttgatccctctacctctcctttgaattatctggattcagctgtttcagctctatttcttttggctgtagagacagtcagaaaactgcctggcccctttttttagcatcatatattttatgagtttaattgatagaaaaaatatgcccaagtgatgtcatgtctgaaggataagaaagaggaaacctaaaaccccaaatcttggttaaagttctattagccc

SEQ ID NO: 96601 - DNA, 1854 bp, Homo sapiens
tgacaaatgagtcttaattacatgaatacagatagtaagcttatactgtgcgtggtttgtgacatgcctgaaaacatgagtgtattgagtagatgaagactaaatcattaacagtcaaccattgtgctccttgaattcttttttccttaaaaaacaattttttaaggggattaacacatctggttttgtgttgaaatatctcttaacgaaaatttatggtcttgaaataaagaccagggtgagaaaaaggagtcatctattttttcttattggctaatttattaatagccccatggaaggacatatgaccatcttacctaaattgatgttttcttagttgtgtggcagtgtatatttttgagccccgagactaccaaacagaaaaaaatacatttggaagtaaaaaccaccctttggatatttatattagttcagagtcttctttgcaagaagcagaaactgactctaacacatagaggaaagggttgatcgaaaagatgttgagaaaagcacagacttgacaaggagcctggagaaccaggcttggaaaatgggcaggcattcctaaaatgtggctatactctggctctgcctttgaagctgcgccaccagaaataccatttggggttctggtcatgctttttcttctcttccaaatgacatggaccatagctagcaatctgctggctcataaaactcttatctactggttaaggacctcaaccagtccccacttcagatttctaaacactacgcttcatctcattaccaaggggaaccttgaagtcttcaacctagctcttgctctcaactttttcttagtctttttactttttccattatattctttgatatatttgagaaaatggcttgcttttaaaaagtgtctccaaaggtttggcaaaaaaaaaaaaaaaaaatgcttccttctgaagtcaaagaggaaaagtactgaggccctgtagactctacagtggaacagccactatgacatgagtaataaaatcctctgagggctttgaggcaccagctctcccaggctgctgggaggtgcacctggaattcatcaggatttcggatcaattataactgtattctcatctgcttctgtaatgacagcatctggctttagcaaaaaagcctgagtttggttattaaaggctcaactccctcccacttttgaccttccagtacagaaagatggagccttgttgaatgagtcactcgaggccaccagcactcttgtgcacagcactcttggcagtagttgttcttttttctgcctgttgctagaaggcttcctaagaaagctgatgtgtggtttagctactgggcatctgaaggcactcgtgctacacattattaagttgaactaagaaagcctgtcaagttttatttatagtggaccaaattgggcaggaaggagagtgaagattttggtgtgcttccagcatccctctgagtttaatcccatgtaatctaacctcccaagcatttgagggtataggattgtaaatctagcatgagaccatccagataacttcctaagtggtaaagtaagggtactcacatttttcagtctctcattgaactataagcaatgtattctctcaagtctcaaactgtaggagccacagccgtagagcatgtatgtatttcatggtatcaggccagaattagattgatctaattaaccaagattcttcttgactggtcctcctccttagcattaggaagcaaagtcctagtcttaatgtggtgttagtgctgctgagtaactttttttgtctgtttatcaactgttgcaattttttgctgtggatacgaaagtaccccacacttcatttttttagg

SEQ ID NO: 96602 - DNA, 1137 bp, Homo sapiens
aacccggatgcaaggggaaggcaatggcttctcttcttgatgattggccgtcgggttactgtgcagaacatgtggggtgggagagagagctgtgggctcataccattgtagtctgtatacctcagtaagtctcgtacctcagtaactgtatgagatttaccaaaatgtttattgttattcgtctttcattttctccctcttctttactcaatccaatacttggtttttccttttgactgaaaactttataaactttttgattggagataaaaaagatagtttttaattctttcatgtgaatctactatgggcaaatgatattgtgagagccttccctagagaaaggagccattttcataggatgtccaagtttattttctggtaatgaactagttatttctttaccattagtgtctttaacatctggttaagggaatgaaggctggtatcctcctgattgttaagggatgagtcatactcacttactgaaaaaaatgtgagtgctttctatgtgtcagaaacattgataaatattggaatatgaaaatgaatcagacatatgccctgcctttaaaagagagcctcccaggctagttgaggaagcagataaatacttcgacagttgtaataccaggctttataaaggtaattgcaagatgctctgcaaagaagaggaacagctgaccaagacaaagtagggctggaggcagatggggaaagagctctcaaggaggctccttataggagagggtgcctgaacagagtttagggtgaacaaggttaaccaggtgtattcctttcccattgctgctgtaacaaatgactacaaacttagtggcttaaaccaacaccagtttattattctacagttctgtagaccagaagaataaaatgagtgtatagggtggtaatctctgaaggctccaggagagatttcatttccttggccttgtcagcttccagaggccacttagattctttggcttccagccccttcctccagctttaaagccaacaacatagcatcttgtctctgtctctctgcttctcttgacacattgccttttctctctgacttctctgtccttcttcctttaaggacccttgtgatgacattgggcccatccataataatct

SEQ ID NO: 96603 - DNA, 1052 bp, Homo sapiens
cttttaaaccagcaattctcttcagaaagaaagcatgagcagagttcagaatcaattccattttcttctttattgtcaacattagtgtatttatgtcatgtacataaaaaggcatatacatatgcagaaatagtaaggctactattagttaattttctatttaataaaaaatttgtttgtttattgtttccttagtgctggcagactagtatatattattttgttaattcttagatgcaccatctgaggtaggaacatagagggagagctcagagcaaatgggcctactgacgtctctagtaaatggcaactctgggatttttacacagatccatttaactcagagttcatatacagccttacataacatgtctcacattccaggcactttccacacatgttcgtatattgtcctcaattttccaccgaaaagcaaacctaatgggaatggttagagattggatagattattggggtgtttaaaattactggtaaaattcagaacagaccatactgtttgtacagggcccagtgggagaagtgggtaggtcctgagcagggtgatcaggaagggaagagacctgatttgatggagagaattctgggagcagagagattggcatgaaatctgtctcaaaggcagcataagtcagaatatatttgttctttaaccaggaaaaatatctgaccagggtccatgttacagaacaaaacatggcaagaggcaggcatgaatgaggttctgaggaaacagtggtggagagactggaaacctgtgattaaaacaaacaaacaaacaaacaaacacctcaactagaagatagatacaaatagaagggaaaaaagagaaagggaagaaattcacagttacataatactttacagtttagaaaatgctatatatatatattgcatttgattctgtggaaatctgcaaaaagccttttatgtaatttggataaaactttaggagtattgtgtagctctgcagaaaatacagtagaggggagagatgctggagtctggaagacaggtggttcagttgtcaaatg

SEQ ID NO: 96604 - DNA, 1019 bp, Homo sapiens
tagacgacccttctcggggcctgcctgagaacaaaagttctgttttcttttcagggccttgtgaagtaaacagttatttcatagttagtcctaggtgaaaaccatcttttaccatctactgagtgcaccagcagtctgagggctatatgagggccataatggcctgacaaaaccacttttctggggtgttctgtggctgtcaatggtctgttattgttgtctcttgaagtgattggacatttcatacacatacaccatgcagcagccatgacagaagcagatcactccaacctgctgctggctctcatgtctccttgggatttaactgtgaatatgttcatccagctgaaatgctctgaaactgaacaaccttatctcactccgctaaaacaaaaactaatgaaagctaagcaactaaatgtattctataacctagtcaactctcctccttcataaatacaacatttgtatcaatcctggaccaggagatgactatgagcctgaggtttcattcgcataatgctaaacacccttgtgaaaacttcagtaacttttccaggtgtttccagatatccagatgtttggcaggaggcacacagagcagccagatgactgtcttactttccacacccatattttgctgtactgaataaagaacccaaagacagaagcaaaaggatcgtaaaatccccaaaggacgactcattgacgcatcaccccttcaatgagaaatgtctttttactacctctctaaaaaaaaaaaaaaaaaaaaaaaaaaaaaaaagatgaccttcaataaattctagagagtaaaactcctccttacaataggtcataaatgatctctttccgaaatatgcttcaagtccagcctgaacctctctagcttcaatgcaagactcacatctcctggtcattaggaaggacacatagagtctttcaaggctacttgtaatggttaactttatgcgtcaacttgagacggtgaagtgatgtccaagagctggtgaaatatttct

SEQ ID NO: 96605 - DNA, 1033 bp, Homo sapiens
cttacgcccaaagagacaagcatctcttgcctgcaaaaagggatctgtgggtaaaaaaccctgaggttttatacgaaaggtcagaactgcaatgtgaattttctttagcagaaaccccaatacaggctgggcacggtggttctcgcctgtaatcccagcactttgggaggacgaggtgggcagataacatgaggtcaggagtttgagaccagcctggccaacatggtaaaaccccgtctgtactaaaaatacaaaaattagccaggagtggtggcatgcacctgtaatcccagctacttgggaggctgtggaaggagaattgcttgaacccagaaggcagaggttgcagtgagccgagatcataccactgcattccagcctgggcgacaaagtgagactctgtctcaaaaaaaaaacagtgtactttggtcttgttgtgggtgattggtagtggcagtaacagaagaggaaaagaggccatcctgaattcggggagagctaccagctctcctgagaagcagaccgtgattcatgtttggttgaggggctaggcacacgctaaactaaatgaggcaacagctgttcgtgaacagtgacaacaaaagcaattcctagggaggcaaagctcttcgaagaatgttagaaagctgaaaaatgccttttgcataatctgatgctctcaatttatgaattagacctacacagagattagacttctctaacctgatgaaaggttgagagagtggcagaaccaaggctagaaccaggtccccgatggccagcctgaggttccttctcccacatagcccagaatgcccatataaacatattccattaaagaaggtagttaaggcattccagcagtatctgagacacacagagatgaaaaacattatcactaaaagacatagtcattataccatgcatactttgacatccctgcaccagaaacttccatggaacctcgaaaaatgatagattcctagagtctatattgagacatactgaataagaatctccccagatgggccta

SEQ ID NO: 96606 - DNA, 1043 bp, Homo sapiens
ttagctccatgtattttatttcatgtatatgcaaatacctttgggccctggagttaccagtattttatgtttgtttcatctgatcaatgaaaacattaattagctgaatgcatatgtttcaggattctgggatgctacttcacaaattactgcagatttctatactcaccttaaatgggttaatatagcttccacggtgtctatttctgtattgtagtttatgcactgagattttttgattcagttatacatatgaacattttaaatgtgccttttaaagaatttaaatactcatatctttttgcatgtcttttttcctttttacaaaaggaagctatggtcgttttttttttttgttttttttttttttttttaccatgactgcattcttggattccaaatgtatgctaaaaaattcgtgagactgcaaaggcaaccaatgaaagaaaaacacatttgatatggatttcaaaatatcaagagaatctggaaaggaaaccaagatcagcttttggttgcagctcatatggctgtttgtgagttaactagcttagaagggaagtaaatagtttatgagagagaaaaagatagatattctggaaatcattattaagctgaaatttctgcatctaattttggaatgtttatgtttagaaagtcacatgcacaatgaaaatgtgtgtttcaggtttgtggagaaaaacagcgctttgagaagttgatggaacatttcaggaatgaagacaataacatagattttatggtgagttatttcagtattcaataaagcaaactcagtttcaatactttttttctaaatacacacacacacacacacacacacacacacacacacatatttatattacaaaggacagggaattgcaattaatatgctatagatccaatctagaatgtccctcttaatctgtatttctctttgatttccattttattccttacatacacggtatagtaaagacaaaagtactaatcatagcaaataaaggggaagccgtgcagttggaaacagccatgcctgg

SEQ ID NO: 96607 - DNA, 1048 bp, Homo sapiens
cacacaaacccatggacaggattagctggtgtctctgtgatgcatgtctgaacattcctgtcttacggtactcaaattcttaatagagtcatttcaacaataggcattttcaaggacatcggtgtgctttctcatatatcctgttctttgaagaatgtcctcagtatcgttgtcagctctatcacaggacagggtctcatttttctttgagggatttttcttgccatagactgatttgaatatgactctaagggcctttagagattatttgttcattcattaaccacatatttcagtagtaaaagaattaacagaaaaatggtgcttctcaaaaacccaagcattatgaagaccaaattcttttggtgagtctggtgagcactttccttgattatgaaatgaagtgtctccttttggaggattattattttctcctttgaacagttcatttatttttctccacatgttttttaaagagtgctgcatatgctcagtttccttcacctttccccatcactgtgaaaatgggtctcttcatggctgtgggtaagccaagttggtgagccaaaaaccctccctttaaaagtgccgctatgacccagctggcatccgcttaaaaagagaattttacaggcccagtatatcttcccttagaagatttgtgttatatgctgaacccaatcagtgtaaatctccactcttcctccttaccttgcctccctggttttctttacttgtaatgaatttaaaggagatgttagaaatcagaagttgctcagtgttagagccctatgtgaaaagcagctgtttaacacatggctcaccctgtctttctcctgaagcctcagccaacattgcatgaccatacttacatgtccacttttgtagcagcaatctatttgaatggcctcccccaaataacttttattattattattatttttgtgggttttttttttttttttttttggagatagagtcttactctgtcacccaggctggagtgcagtggcgcgatcttggttcactgcaacctctgcctcctggg

SEQ ID NO: 96608 - DNA, 1049 bp, Homo sapiens
attcctgctgatgtagccgatagagggaacatcatcacgcatgggaggcactttgctctgagtagtctttgtcacaaccacaccccacaatgggaggttctgatctcctacaccatcttcctgccttccactggccccaccgagagaatggaagagagacaagctacctgcttgaggatcagtgcatttttgtgggttcagcagatactttctggacacctgtagtattcaaagctcagtattaggcacagacattgagtgcttctggatctttttttttttaaatggtatttttgatgtcatctataaaagggaaacatgcttttatgtgtaattgcctgacgtaggcttccaggcatgtcttctgagcattcgagaacatcagaatttgctagagtggatttaaacttcaaggaggaagtgctgccaacagccgtattatcatgccttaaaatgctgccaaataattcatgtcctcttgccaaccagaagatagaaaacagcatcctcacctcaccagaaataaaatgggaggtaggggttagagcaggaggaagagtcactctaatgccttgaaatctaagctctttgttttgactcacggaaacaaagatgacgctacgagccgttttctcagtcctgaagtgtttccctggcatctggaattgctctaagctttgccatccctgtgacgtggggtaattctgcctcctcatttacttcagcctgttcatgaggtctcttatttacaataaagaactaccactctaatagcctccatttccaaggctgtgatagttctcagagccttttgcccaaagtctaaaagccagtcttagctgtaaagatttcccaatctccatcccttccaggatcccatctgcagctctgccagccggtcactggggctcattcatcccaatgactggagcccttttggatgccccagagtcacctagaataaattcactccacatcaaatccatggttttacttccaccccgacttctatataaaactgtcagggaaacaagattccagttcacagt

SEQ ID NO: 96609 - DNA, 1048 bp, Homo sapiens
tcaaacagctctcaaatttcttttagtccactcaccagatctaaactctgaagtttaaatccataaactgctcctcttttactgctattcatgtagtttccaagggctaagatgatctgcaaaagaaggtgaaaacagaagcccatcagtacagcacatcaggcactgaacgcagctgaagtagtccttcatacctacaagaaaaactgcacttgcctccagaattttcttgagtttttgggacgactttatagagacagatgctgctataatcgcatgtagttgctagattccaatcaaagaaagaaaaaggggaaaaaagacatgttaaaaatgggaaactaattggcaagtaaatattaagacagaagaaaacaggcctgcatttagagcatacaggcttcatggtgagagtctactttttctaagtataacaaatttaattgtcttgctaggtctcaggtaatattgttacatgcacgatctttactgaaactgttcacaatagcaagtaacataggaacttgcttatcacaaaatctgtaaccaatctacaaccactaagactcagagttaagagtccacagctgcttctggtagaactcaatttcctgcctaccacctctaatcatgtcatacaattaatatttttaaatcaatgaaggaggcatcaaaaatgaaaaaaaagggaggggaatataacaccctccagaagttctcagaacatgttttcaacagacatactactataagcagaaaccaacaaatttatctagaaacagaattgggaaagaactgactactataatcagtaacaaagtctatttagaaacagaattgggagagaactgaagtttatgatattcataaatctccaccagattaacacaagggaatgagagatggttggctattatgtctatatcaccacagtttattataacaaacttccaagaaagaaaactcttatggtaaatataaagctttcagcaaaagcttgtaagtctgctcactaaagatgaggcaacatttttagaaatgaaagtct

SEQ ID NO: 96610 - DNA, 1064 bp, Homo sapiens
ttaagacatctatggtcattaccagttgcctcttgttgccgtagactccagccttcttgttgctgccaggtgaagttttgtgtgttcgtcagtggaagtttttgtttccttcccagaagcttgagttctctgcaactgagcagaatgtgggatgtgtgtgtgtttttggccgaagctgcttattagtaacataatgctcaggcacattttggattttcacaaactcctaatgggtgctggcctcactaatctctgcccttctttcttctcagtctccttctcataaatcaaagaggcagcagcaagagttaattgcagaattaagaagacgacaagttaaagataacagacatgtatatgagggaaaagatggtgccattgaagatattatcacaggtaaaagatatttcttcactgtggcccatggagatcccactggcctcacctagactgggatgcatgcagattttgcagcttcttttgtccagggttgtcaagttcattagttgactttattcacacccagagtgatgcagagaggctttgaagtccatttacagcagcatgtatactgccccaatactctgcattggaaccctgtaagtttcagcagagctccttcatttaaaggatttccattgttattgatatgtcatcatgctccattttttttttcctcgtggccacacctagccacctgcctgattaataaacactgtggacaagacccattcagcaatgtactaatcacagtccatggatgctctttaagagcctctttactcattcaaagtaactgaagtcagtaggtactttaatttgggtgagccaacaggcttccagcccagggttgggaactggttttatcagccaagaattgtgttaacccagcctggttcctgtctgattgaattagcataatgctatctcctcgaaccaattctcccaaatttctgtacttccttttacagatcagagtaataacttgggcactagtaggagaggcagcaagtgacttttccttcatgtctgttgcacatgaatgttgcttataagcttccaga

SEQ ID NO: 96611 - DNA, 1080 bp, Homo sapiens
tggtggctggtgtctgtaatcccagctacttgggaggccgagacaggagaattgcttgaacctgggaggtggaagttgcagtgagctgagatcatgccactgcactccagcctgggcaatagagggagactctgtctcaaaaaaaaacaaaacaaaacaaacaaaaaccaaagaacgtggagttcctttttcattagtatgtcctccatcccaattacacctggcgttataaaatgaatgtacattttctatttgcttgatctaagtcattaatctactagaagaggggaatgagtatctgtttatagggcagtttttatcctccttggagtatttttcattttctgatccaccccaaagccccagataaattcctttgtacctttatgaactaacttgagtatatattgccttccccctttcctgcccatcttccccacccccatccccaggtatgattaacaatgcactaaccatgtactaatgcaatagatcttggctttttattctcttctgtttgtgttgtttggctgtcattttcaatgcagtgctgaagactgtgccctttactgctcgcaccgccaagcgtggctctcggtttttctgcgaacctgttctcactgaggaataccattactaaactattactctttctcacctgatgctcttaaaaggttgctacaggttttttgatgtcttatgtccccctctgtgtgtctgtcagggcccaccaacatgctagcatggaattgccatctccatcatgttatattttgtgttgttctcatgctgcatggttttgcatttcaattattattgctcactcactggccactttcaatacatgtatgtattcacattgctgtaacagtctgggtgtgtttgacagctgaattcatagaattgttcacagaaattttcagaaaaatagagcaaaaatattaagagcacttctttgagaatcagtattggtaccaagtagattgcttataagatttttgagctaatgtccttcaacatatccattaataacaataactgctatacctaacatgtattaagaacttactgtgttcaggt

SEQ ID NO: 96612 - DNA, 1222 bp, Homo sapiens
tggagccaatcttcaaagcagcttggaactgggtggtcagagagctgggtgggaagatgcactcatccttcccttatttgatctaacatttcttgtagtaatggcttctcattctcttcctctgttggctaacatgcctgggaatgttgagcactaagttgagttgctttccattttcatcccattttttcttaaccatcattttgtgtttttgtttttttctgtttagccttaaagaagaataatatcactaaatttccaaatgttcactcgagggtaaggatttcttctagcacaccggtggtggaggatacacagagctggcaagcatcactttttacttagcttcctcctctctctgtatgcagatcaatggttttcaatctatggctgagggtaatactggtgagaatctgaccagggagtttttgtacctcacattccaatgatgcagggattgagcctctctgttggactctttctcggcctgcttttaagttctaagtgtgatggcttgggcaagggtatttgctgatgattgtatttgctttgagtgttgggctgtccttcccttacccctgtcttggcctttgagttactcagttaaacccattttgatctgaagcgactgaaagcaggtcctggccaggtaacattacagcctttgaaggattaagatctttagaactaattgctcagaggatgaagaaccacaaagctgcatatgaggcaaaagtgtaattctggcctttcattaccagtgtgggctaggaagcagaggcttgagaggattggggtatgcaaaactattttttccttaaatttaagagtagaggctgggcatagtggctcacacctgtaatctgtaatcccagcactctgggaggccgaggtgggcaaatctgttgagttcaagatcaccctgggcaatgaagcaaaatccccatctctacaaaaaaaaaaaaacaaacaaacaaagttagccaggcatggtggcaaatgcctgtagcccagctacctgggacgctgagatgtgtggatcccttgagcccaggaggtggatgctgcagtgagcagagatcaccactacactcgagcctcagtgacagagactgtcctcccctcacaacccccgcccacccccccagaaaagagtagggcagggtcacacaaattccaatgagtcaaggagccaggaaggtaacaggcctggtaggaactg

SEQ ID NO: 96613 - DNA, 1038 bp, Homo sapiens
ttattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttctttt

SEQ ID NO: 96614 - DNA, 1008 bp, Homo sapiens
cttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcaaaactgcttttgtgattctcagtaggatctagttcaaagccatctcagtgctagtgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatatta

SEQ ID NO: 96615 - DNA, 3140 bp, Homo sapiens
aggaatccatatgcttaaagcatactacttctgtttctgtgataatacttgtggaaccagggggaagctacaaaattagcaaggaataggccaggtgcagtggctcacacctgtgatcctagccctttgggaggccgaggtgggcagatcacgaggtcaggagtcgagaccagcctggccaacatggcaaaaccccatctctactaaaaatacaaaaatgagccgggcttggtggcaggcacctgtaatcccagctactcaggaggctgaggcaggagaattgcttgaacccaggaggcagaggttgcagagagccgagatcgtgccactgcactccagcctgggtgacaagaacaagactctgtctcaacaaaaaaattagcaaggaatgtattatctaggaaatgaatacctggcttccattaaatggaaatattgcttcatattcacacagtctttaaaccctgtgaaatgtgtttctttggaagagagtttatatagatattggattcttttttcaaaggctcagcccgtaaacctctgagtactgatgtcaactataattgtaatcaatgtcttttcagggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgtgtactagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagattttttaagtaaataagtaaattttagcacctattcttcggtattatctgtgttattcttttaatgtgtacacttgaagagatcctatttcaaagttgggattttgaagaacaaaaagtttttttcttacccatcctagtgagttttgaaagtgggcctgaccagaatgtctctttcccattttgccccgtttgaattaaatataatgtctactctttaaaggctgaaggggtgggtgaggggattgtttctcattttgtctcccaagtcatttttctgctgtgaaatatgaccaggcttgtaggaagactcatcttggagaaaatgtgaagtaatcaaattgcttgagattagtctcctattgtatattagagccaaaacacataataactttggcaacagggagttgtctagactcaattttcagaggtcccattgtagtgagttaatattgctaatcatgtcaatcacttgacatggaagtcagtggcaaatctttaaagtatgcatttgatactggcaaatatatactactgatgtttcacaaaagaatcttagaatctgtagaaaacattaattacttccatgaattatttctaaagtataactttaaagttttgatttttctatttaaataaaaagctattgatgtgttttagcatgtcctcaaaatagattcctgtatttcttacagagataatcttactataaccgcaaatccctacaacacagtataaagtttccctgtagttcacccatgaaaattatttgacttaaaaacaaccatagtagtaagccaattgcaattcaaaatgcaacatccttgccataaaagatgtaacttaagtgactgtgatcctttgtctacctttcaggatcccatcaaatgggatttagttgctagaaagatacttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattca

SEQ ID NO: 96616 - DNA, 1093 bp, Homo sapiens
tgggtatcaccacagacctgttgaattacattctttttatttgaatttgtgcatatctaatgaataaccatttaagcactaacgttaaattttaaataattcctactcagcaatttcaagaaaataattttattaatacagctgtctgccttatgtgttaaagctaacagcagtatactatgtacatatataaaccaatattatattgagttggtgagaaatgtagtatctgtctgtatttacataatagatactacacatctattatgtggtagtaagtctcatgagtggtattttatccttcagaatattatccttcccaagggaaagctgtccccatgaatcttgggtaaattttactaaatccttgaggttaacaattcacattttatttcatctctctaagagcacataacctgttacacatagatgttcttaaatattacctatataacaatggtatcttcatcaaaatgctaacctgttattttctattcatacaggactctccagaatccgatgctgagcgagagaaggataaaaaagaaaaagatcgggaaagtgaaaaagacagaactagacaaagatcagaatcaaaacacaaatcgcctaagaaaaagactggaaaggattctgtaagtatttagaattgtttcatgcctgtattttcaaaatgcaaaaatgtattctgtggttaaaccatgatggtgttgaaagaataggcttttttccaggtgtgctaccattgaagaaaacagtgaaaattcagttaagtacatttcacacaatatcatagtttttggtcatgcatgatcctagattttattctcctaaatttgatattttttaaatatagcatttcataactatagccttattaactcactaagaaaggatatggtcactaagaagtgccactggacattttttacctaattttcaaattttttttttaagtgagagactaaatctgggattctacagatgtctacagttgtcactgttattaaatcctttgtttcaaaaggtagcaattccagtaacttttagaaatactgatttggggtggaggaagggcaaataaataggagag

SEQ ID NO: 96617 - DNA, 1051 bp, Homo sapiens
ctgtgtagaaaagaaagtttctggaaagtaatggaataaatggtaagtttttgttaaaataagcaatgaaacaataacatctcaggtcactttaataggtaaggttcactgggcacggtggctcacgcctgtaaaacaagcactttgggaggccaaggtgtgtgctgatcacctgaggtcaggagtttgaaaccagcctggccaacatggcgaaatcctgtctctactaaaaatacaaaaaaattatcagggagtggtggcgggcacctgtaatcccagccactcaggaggctgaggcaagagaattgcttgaacccaggaggcggaggttgcagtgagccaagatcatgccactgcactccagcctgggcaacagagcgggactccttccccaaaaaaaaaaaaaaaaaaaaagtattttgatgacagtttcagttaggcccttgtaagtatgctgaattgaccaataattattgaataatagtattcgatgcctatgtgggccagtgttctaattgctttatgtatattatatttatgaactgaatcctttcaataagcctgtgaagttaataggtgaacaaactaaggcagagagaagtaaagtgacttacagggttggaagccgggcatgttgaccttggtcagtgcttttaacaagtatgccatgctgtcagttttagagtagctaatactttataagctaaaaactagtaggtgcttaatattacagtgttgcattgtaaatgggcataggtcactaaattgactatttcctatttcttgatttattgttcttgattaatataatgttaaccacagttttttctgtaccatgtactcacgaaggccctgtattgtttcacagctgcctctagatgtggtcctgttggcctttttttttttttttttaaagcggggtctctgtcatccatccactcctaggccagagtgcagcggtgcagttatgggtcactgcaaccttgaactgttggattcaaacaatcctcctaagtagctggaactgcaggcacgtgccatcacacttggc

SEQ ID NO: 96618 - DNA, 2272 bp, Homo sapiens
gcttgttccaccactcacttcttgctgtgtggcttggttccggttccgtggctgggggttgggatcccctggtgtataggattaaactccctgaggattgggttggaagcaggaagtgtggaaattgaaactagatatgggtttgaatcctaggtctccaaactactttgggaaaattatacatcctcctcttaaggccccttgttttttaaaagtaaataaaaatacctagaacacattaggcactatttttaaagacagaaagtatatatttaaggaaacatgcatatacattctttagcctcatcatttgaggtagatatccagtaatttaagttaacttttacctttttttttttaaagctaaaaattaggttctatcttaaagggtaggaaatagaaccttaggaagataatgtgcagtttcaaaagttattttctctaaaggacaaaatatttttttgcctagaggcagttgttactttgcccaaatagcaaatattctttgtgcccaaacaggtttgggataacattggtagaagagttttaactatgtcaaagtttttgtgtgttttcatgttagacgcttatttctcatgtactcgagatgactttccaaatataatttttctccctagatatttttagatgaattacatgaacatggacaactgcattctatgtcatcttggatggaattgtatccaactattagttctgatattagattcactaatatgcttggtcagcctggtaagattattttctttcctaatttaccgttatggtagtagttgaaatgggccaaatgcaaaggtgattgtgttgggggaaagggtgctttatttttgttttttaaacaacaaagtaattgcagctctttggttagagctagcttttgacttctttagttttttcattaggatcaactgcacttgatcttttcaagttttatgttgaggatcttaaagcacgttatcatgacgagaagaagataataaaagacattctaaaggtaaatatatttattcttaccttttaaccaatagtatatcttaaaagttagtactgtattcctttgatttatgcattattaatgttaagatttcttttttttaggataaaggatttgtagttgaagtaaacactacttttgaagattttgtggcgataatcagttcaactaaaagatcaactacattagatgctggaaatatcaaattggctttcaatagtgtaagttatgttttctgttgtaagtaactagtttagtagtatagtttttaatttattcagataaaagcagctaagttgcagagtgttggaataagggaatatgaatagaattttacagagtggtagccagtctttcaggtaaggtaaaacaaaaaactttatttagatgatggattgatattaaacttcctttgctcaaattaactggtattatacataaaatggccattataaatcaggccttgggccacacataaagtacactaacgatagctgatgagcttaaaaaaaaaattgcaaaaaatccttatagtgttttaagaaagtttacaaatttgtgttgggccacattcaaagcggtcctgggccacaggttggacaagctcgttttaaacaatgcgtgattcctaaattaacaataaattatttcagctaatagttatgatactattataactgattaaatatgattttcttaatagttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatgtatgtatacttgttatttttttctaatggaattcttttctttacagttgagaaatttaaaatatttttatttttcattttatagccacaaaaataagctaaatttatttgtagaatatattaaatatatttagaatataataaaagcattaaatcagctgttgactctgtttaggaatatttgtaaagaatggtttggacttttgaagggaggaaataatggactttaaggggactgattcatcacagttttcacttgctgttatgatttattttagatgtatcgttgtacttttcttggtattcatatatttattttgtatctgaatttttcagatccgtgagagatttgtaaaagagccagcatttgaggacataactctagaatctgaaagaaaacgaatatttaaagattt

SEQ ID NO: 96619 - DNA, 1017 bp, Homo sapiens
tcacctccttcatttgggttcagttgctgagaatttagtcacagggccacaactagctacacaaaggaggctagaaaacttagcttttagctaagcagccatgtgcccagaaagaaggggaggacagattcttaggagggctattatacactcttccacaacttaagctttaatgtctctgatgaaggttttgcagtggtttaaaataaggagacatatatgaaaaaataataatacagtgaaaataaggtctgggtcatagaaaatacgagactataatgtaaacaatattgaagatggagactgtgaggcaaaattttgatgtgaaggctgttacggttccttaaataagcttaaatgtggctttgaatcagattgctatgtgtctggcatagtttctgattactactaatataattggtgttaagtatgttgtattaatattctttcagatattcagcctggtaattttcctgttgtgctatttcaaaagatttatttaggactttagtgaaatgaattaaaagagaagattggcattagacaataaaagatcattaatggagagcttctcagtagttatgattatgatgatgactagctttttatttagtgttcatttgctaatcagaaaattcatcatgtctgtgacaaggaaactatgatcttgtttttcttatgtcttaaaactggtatttgaagtcagttttgtctggaaaggattgatctgaggctttcaaggagaaccagaggaatgtatagtgtctcagaagccaagagtttggaattttaagatagagcatgatccccaaatgcacagaatcagtatcacctgggaaattatgaaaatgcatattctcaaactccacgtcagacttacagaatcagattctggaaatgggacctaacaatatgatttttttaaacagtccttcaaatgagtctttgagaaacccctgaggtaaaggaatccacctaaagtaacatgttaagaaatttttatggaatgaggactga

SEQ ID NO: 96620 - DNA, 3427 bp, Homo sapiens
cattttgaataattgttttatgtagcattcttcattttagattgctttattatgtaaaattgtgggtaatattaaaatatttttgatatgttatgaagcctattttctgtatgtatttctttgatctcctcagtattccagagaagtctgtaatttagttctgtaggcagtttggtagtctgtgtagctgcctttagatatagagatagtctagactataagcagtgcctaatgtgaattatcccctctatctctaaggagagagggaggcatgtgttttttgtttgtttgttttgttttgttttgttttttcataattatccaggagtttgtctttaatatatttatgaactttgaataggaagtattcattttgtagttttaaatttagtttaaaaattggttaaaattaatttttattgtataatttttttttaacagaaaagcagagcaaatgtttggagagatggaagtttggaatgcaatatcagaacgtgatcgtcttgaaatctatgaagatgttttgttctttctttcaaaaaaagaaaaggtattctttattcttagttattggtatttatagataacacaagatgtttcctcattcggatgaggattggttttataatatgtacatttttctggcttagtttatccagtttatgtggtatagcagatttatttattggaagtaaaatttaatgatggaatgtatagcttctgtaataatcttctttatcgttcatgtagcatattaagtactgatgtagactcagtgggtactcattcaattatttgtattgtcattagttggctatcttatgctcactttgaaaagataccttttttgctcattaggtttaaaaatgctgggtttttttgcttataaccagcatgattgttacaagaatgacagcaacatgcagttgtttctactaaacttacaacattttaaaatacctattttactcatgtctctttttcattgtgcactattatattttatgttatctggtttccaaggaacacatacagatgcaagtattatcaaatttaaacatagctgaaggtcattgaagattttagcatttacctgcaatgcgacttgtccatagtaaccttagtttcagactgtctgtaatacatagtggtagaaaggtttatgtcgtatgggggaaaagccaaaaacatggtttccagattctggcttttagaaggaggtggaaaatttgaagctaagtaccaaagccaagcgcttaggaaagagcattagcaaagtcagcagtgtggccatttaaagtaaatgaaatttacttgaagtttgacttaacctttgcaatttggtcatccgttagaatataaagaagccgtcactaattgcaatttaaatatcttaatttcttggaactttgaaacatacatattcatacttttgctataggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaagtaagaataatggctaagtaagagaaatagttttaaacagcgtcctccagcagcaaagaattattttcactttttatatgagataactaattgaattttatgcagttgtttatttctgaaaaagagttttatttatttccaaataggatatttctttctgattgagtttgtgattcatgacaaaatattttttcaaatttaaagtagctttatcaggtaatccttgaaatatttaaattataggtcacatttgaaattctgcttagccgtttgtatgtaacttggtaagaactaaatgaattaccgcattttactcaggttgttttcttgaggtaataacattatagattttgtaaaaagaaaaaaatgtattagaattatcttaacattaggcttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaatgtcttttattgagttctttgtgaaattttccttaaaactttcctatgcagatgatcacaaatcatatttgagtttaaatacaagtttgtttgtttgtttgtttgtttagagacggggtcttgctgtgttgcccaggctagtcttgaactcctgggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccaggtaaaagaaaaagctctctttttaacttagttttatattatatttactgaactttgacagtgatacaaagagttttgagacaactgttcccagatcatagacttaggctttgtgaggactcatacacatttaactctttaagttcttcagatgaacattggtaaatgaggtttcggttgggaaaaacaacaggagagatgactggaaacaagatatgtgtggtgagtcagtagtagatgatatttagtctctggaggacaaagggactgctaaggtatagtttggggatgggccataatttcttaaacactaagaaaaggacctgggattgcatgttttttaggtagtagttcgttttcatcttcaagtatcatttttattttcagtgatagaaaatatcatggagcaatgaattttttgcatttcatatctcacctatttcaataattataatagctaatattctttgattgcttactgtcaatacaatttacatttgtaatctcaatttttatgacagtcttaccttataagggtacttactgtttttgttatataagtttatataactaaggaaatggagaggtgaagtgacttgcccaagttcaacagctgctgaatagtgaagccagaatttgaatccatgcagttttgattacagggtctcttccattaaccattgtattaggataaatgctaggttacaatggcttaaataagtttttttcttgaagtaacagt

SEQ ID NO: 96621 - DNA, 1045 bp, Homo sapiens
tgaaattttaatttttcatttaaattattttcagcgggtaccatcgaatgcttcatgggagcaggctatgaaaatgattattaatgatccacgatacaggtagtacttcaactttttatttacttttcactttgagcatatagcaggcctagcacatttaaagttgtgtagaaagataaaacatttaactgttgacttctgtttaggataccaagtatagagttgttttatgtctaataaccaaaaagtcaaaggcttatcaaacaatttgagtactccgctacatataaaataataattattttaaaagtagaaattactttctacaatcatttgtaataaatttttgaaaatttttaaattatatgtgtaaacagttttattttttttttcaaaccactaatatttgattcttttgcctgtgtttactcttacatggtatttttatattagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaagtaagatgtttagtgttacatggcctatgtttactacattgttgtttgtgtcatacttttctgccatgtgcagtagctgatccagagctcattaaataaaactagatgattatgaatgtggaaacttgatgaggtacaaaataaatctgtagttaaatgtagaatttaacttgttgacttaataagtttttgagagactggaagaaggggagaaagactgtattcaataatcaagttggaggccagacgtggtggctcacacctataatccctaccgtttgggaggccaaggcaagcagatggcttgagcccaggagttcaagaccagccttggcaacatggcaaaaccctgtctctaggggaaaaaaaaaaaatacaaaaattagccgagcatggtggcacgtgcctgtagtcccacctccttggg

SEQ ID NO: 96622 - DNA, 1909 bp, Homo sapiens
aaattagattttgttttttttgaacttttatggttttccaactaatattagtatcagagaagtctgttaaatgtggatgataggccgggcgcggtggctcacacttgtaatcccagcactttgggaggccgaggcgggcggatcacgaggtcaggagttcgagaccacggtgaaaccccgtctctactaaaaaaaaatacaaaaaattagctgggcgtggtggcgggcgcctgtagtcccagctactcagagaggctgaggcaggagaatggcgtgaacccgagaggcggagcttgcagtgagccgaggtcgagctactgtactccagcctgggtgacaaagcgagactccgtctcaaaaaaaaaaaaaaaaaaaaatgtggatgataatcttgacctataatggggtgtgaatggttacagtaaataggatttgaaattcatatagaactggttttgaatcttgtctctgctttttaatgagtatattaccttaaacaagttactttctgacttcaagtaacagtccctagatacagaattatgttacacattttgcagtgttataaagattaaataatgtattcaaatggcatcactcagtgaatattcaataattgatagtttatattattaccatcatctcacgagttttagaattgtatcaattggtaatttctagtgaaaacagccatgtaaatgatcagtgatgttaaatatattattattaacaaacagttttttccttttcagcaactcttatctaaatgcccctggaaggaatacaaatcagattctggaaagccttactattataattctcaaacaaaagaatctcgctgggccaaacctaaagaacttgaggatcttgaaggtaaaatggggaaaagtagttttcaatgtatatgttttacatatatatgccattcactttgaaacaattcctccagaataggattgttcaaacaaaggccttatttttttttttaattaaatgattagaacatttaaaatggcgtataacagttttttgggctcttattttcttgttgctttagatctcagttctgtagattttaaatagatttttatttgatttgattccactgaaactaggataccagaataccattgttgctggaagtcttattacaaaatcaaacctgcatggtgagctgctttgataattcattttctgtcatacttaacatttttattagagtatgtcactaatattcactaaccataattggataaatctgcagtgaaaaatctctaagaattcttttcattaaagggttatattataaatgagcttgtagcttttaaagtcgtactttggtttttagaaaaaagatcgtttatcattcaattgaacaaggagttcatatacaaaatttccaagtcctactatgagtggtgcatacatagaacatgtgttttaactcatttcatggtaatagatagtggagaaccttgaatctgtatccatttatattttgttagtatattgtcagactatatatttaatgctagttttgtttagcacagtgttgcaaaatagccttgatatgttctttatggaagaattaaggtaaaccaagtatcatgccttacttataaagggaaaatttttcaacattggaactaatcagaataacccttaaaaatctagaaatacttaatactaaatataaaacctaagacttaaaatagagataataagtaaggattgaaaatctagtttttatactcacttctaatagaatctagtgtcataaattatacaaaactagaagcagcagattgtaggagaatggggctaataaagtagatagtgatgtggaatgacatctggcaggaaaagagaataaaaatttcctaaaagactgtcatattaagccccttta

SEQ ID NO: 96623 - DNA, 1500 bp, Homo sapiens
tttattttttcttaagaggtttgtacaataatatgtcttagatttgagggaatattatataaatcatttttgtaacccttcaagcatagttaaatttgtcaccatctggaaaatctggtgcttgaaactaggtttactacctttgatatcatttagtaaatcattcattcatgatgccttttaaaacttttaaccaacttttatctgagggatgtctagtgttgcctggagtatcattagcaacttctagtaggttcttagtgtgttctgttgaccttaatagtggatttatattctgtagtttcattcatgtaaaattttatctcacctatcttgttttgaggcattcacatacacattttatccctgttaaatttcatcttgttgatagttaaattctgattgttgtccagaagctgtgttttgacagctgtgtctttctttatggaatatcaattagaactttgtctaagttgatacaagtattccttggactacagtagatgaatagatgatcacatagtcagttcaaatatattagcatctagttcctatattttctttatccactaggcacagatttgtattctgaaagattgtcttttgtatgtaagctataaagttactgttcttaggagagtagtcttatctttgtaattcagagagatcctgaaacttgaatttacccttgctgcttttgaagtactctaaaaaccttgtttttcagttcccttcctacttgtattgatgaattattctagattacttaaactgtcaaaatatgcccagtttttacttttgattgatttcttaatatatttattgccttggaactaatgatactgatattgtcaatggcattgttacataatttacatcttttttaatctttattctttagaaatcaatgtggactgaacataaatcacctgatggaaggacttactactacaacactgaaaccaaacagtctacctgggagaaaccagatgatcttaaaacacctgctgaggtaaaagtttgagagctggaattcagggactgtcaagtagactggggcgtattttttaggattctataagtagtcgattatcaaagagcagtactgcttaaatgtcagaagaggatctgtaaagacattcagaaaaaaagagggttagtatagtcacaccaatcgggaagaagagcaataaaactcaacagaataattttatttactgattttacccctgcttagaaaacctagtagagtgggatcaattttaaaaaggtgatttaaagaataaattggaagtggggaagactgtttctttgcctgccgctggcttttttttctgatagcaaaactgggtgattttaaatgacttctactgagttcttaaatttccagtagggttaagggtagtggagatgaaattaagttacctacaaatacttccttctcttagagtgggaagttttctctttgcaggaaatgcccttttaaaaagtgtgttttta

SEQ ID NO: 96624 - DNA, 1014 bp, Homo sapiens
gtagccactagacacatgtaattattgtgtatttgaagtgtggctggtgcagctgaggaactgaatttttaaaattttatttaatcttaatttaaattttaatttaaagggatgtctggtgtctgctcgctactgtattttacagcacaaatctggaatttagataaagttaccaggaatctaaagctatagaatcagtggttagaggtgttattgtgctttggtaatatacttagtagagaaggaggaataagaaagatagatacctattatagtagggaaaagagaaacaaaaggctaagttgaatacttatcaaactgcctccaagtgagtccaagtaagtttgtgcattgaaagttcaaactctgagcatgttttgcactatagatgtttattttgtgggaaagatagcaagcacttaggttatatgagacagtctcaaaatctttagagaggatgaggaggagtaagtactatgaatatatgaataaatattaaagctattatgaaggagagcatgatttatcatggtgtaaatattttgcctgttttttattttttaggtacagcatctggtgcagtaagtactcttttaacctttgtaatattttaattttactatactttaacctactttacagttattcttatttctgttctaaggattatctgctaaatctttacattaatccatagttttcccctttttttctatgacaaggattgaaaaattgatttattttaaaatctggttttggtgggacttaatgagagatgagaattacatgtatcaacttttaaaaggatttaaattcttcccatcacaattagaagggaagcagaacttgtaggtacacagtgcttaacctagtaattacaagttaagcattacattaggagataatcttttttttttttttttttttttttttttttttttttttgagacacagccttgctctgtcactaagactggagtgcagtgatgagatcttagctcactgcagtctccg

SEQ ID NO: 96625 - DNA, 1041 bp, Homo sapiens
ttggaaatccacgttctgagacttcagctgtggcaaattaattagaaaatctattgaacagccttaccacctctgtcgggtagtatagcaatataaattactatgaaattcaagttagtttaacttctttattctttatgtggttgtggttgtaataaacagatgtggcatactccttggggtggtaagtttgcagtgtctttcccaaaaccctaagaccagatatatttcaaaaattctttataatactggaaagtaacacattgcatataatatgtaaacatttcctgtggggtccagggcaatgctgtctaacttaataatgttaatatttttgcagctaaactaaacggatattcactctgaagtgggataaatgaagatgtggagtttcatgttcatgtagggcaggttttgccactatagtgagttttggtaccatacttgaaaaaagttggctttcagagggttttggtttccagaattgtgggtaaaggattgaggaccttgtgtacacttggtgaccatataacatttaaactactcccgtagtctcggttgctgatctcttttacaatttatagcaagctcggggaactgagaccactaaaagttttgctaagaatatgagtcagaggcttgaggattatacatagcaggtactgatttcactgtgctttatgaggaacttatataaaatacacttttaaaaagatgaataatactaatttcatttttcttcttacagccaggagtaaatagtatggatgtagcagcaggtacgtatactctgtatggtggtatgtgttagacctcatttggacagtagcagccctattatgaggagtaaaagcaggatctcttggactttatataacctcctttttcttttttctgcaataggaaattgggataggattgataattgaattctgtttttgttgttgtttttttgagacggagtctcactctgtcacccaggctggagtaagtggtgcaatctcggctcactgcagcctccgcctcccaggttcaagcgat

SEQ ID NO: 96626 - DNA, 1077 bp, Homo sapiens
tatatctgttggcgggagatgtatgggctgggagtaagcctagttgtagttctttctcatttgattgttgtattttttctccttactttgtaaattatttatctgattctcttagtctggatgatggaggcttgccagtgcttcagttttcaaattctataccttagaaaaaaatacatattatttggaccatattccaagtcagccaccacattcttatagtcacaatttttgtcaaaaagttcttgtttaatgatgtttagacagtttattggttgtttttaacccattaactcaatgctactttattttaataggtactttagcctcgtttagcttcatgggttactttcacaaggaatacaattcagtgtatgaatgttcttacatacctttaaaaggcttcaatctatatgttcctgctggccatatgcttattcttttctgttgtttctatttctcaaaatgttcatttactttgaaattgtttaataactggttaccttgttccaatacctgtgattattgtatgtaatttttgtccccttctgaatttccttagatctttttaatggtcattaaaatcaaaattggaacgtgggattatactaatatagatgaacattgggtcaaattcttgagaaacttgtgttaattttcaggatttatattcaaacttagtagaattaattcatagatttgaatggtagttattggtaaactagattgagctcccaaactaataccttcagatatttatgtatgtgccttaagttttctgtacatgagaggggataaatgacgtgtgacttaaaaagggtttttttagattattttttaagtcattgtttggatattaagcacctttgatctaggattttgaaatgtgccacattgtaaaatttattcagtgcatatattaaaaatcaaaggtgaaaaatacagaaaaaattttatcttaaattctcttgctccaaagaagtgagaaaaatatgaatgttgtgttataactaaaaggagattaatgtttttttaaattcaggctagaaataacataatagtccaaacttttaaatt

SEQ ID NO: 96627 - DNA, 1022 bp, Homo sapiens
tgtatccagagattcaagcaactgcgatggaaaatagtctttaaaaaagcaacaacaaaaaaatacaaatttttaaaaataaagtataataacttttatagcatttacattgtgtaaggtattataagtaatgtagaggtaatgtagaggaaaaaataacaaagtaggatataggccttgcagagaaatttagtgtattggtaccttagacttacctgactgatttgacaaatttatttgttgctgttccttctgaattacccttccttttgagtagctacaggatccatgccattgaattgggcattagccagtgacaaaaaagagatagaatttttgttttttaggtcatctgctcataattcttgaatctgggtaacttctgggtacatgtggatgactcaagcaagtacttttaaaaaatatcttaactcagacctaatgtctgtaaattcttgactcaatgtggttagatttttgacaaatgttaatagtgagactacaaatacgtttattttcattatctttagatagcagttcatttaaatatgagctcatctattcacaaacttagtgtggaaagatctaaggaggaccacatcagttgagaagaatgaccggcatcccctgctccccttttgaaattcacaaggcataatatttactaaagtgatgagaagtcttgcagaagccttttacaatttttacttagtatttctgtcttatttgaccatctcccccataaatctcccacataaagcatttgttttgctttgtgtagcacattgtatgaaattagcattttgtgagaaatgctgaattagggccctttattcttttagtttgctctttaggagaaaaaggcaacatcaaaataagttagtgttaacacacatatgcataaacgaaacagcttgtgtagtgcaatgaatgtattcattagatagtggatcaaaagaggaaacaagtcaatagattaacctttgatttttaaattaggcttgttgaatatcatgataaga

SEQ ID NO: 96628 - DNA, 2017 bp, Homo sapiens
tacttgccaaataattgtggtctttggaatgttaccaatatgacatgaaactgtaaaacttgtttgtaaaataatatgcagactgggtagcataatgatgtacggaagccagggttcataatttctcaaatgcatcaagctatttagcttaaagaagtggtgtgttcaaattttttttttcttaattcatgagatgacctagagtgccatctcatgcatttaggctgactcttagtagtaataaatatttgatgattatcaaattgagcttaatattctttcaggtttatttcagttttctatcttgtagattaaatttgcctcttattctatataactttataggaaagtcatacttttagagttataggatcttatagctgaaagggaccttacaggttgtttaagctttaaataatatgtgatttaagatgctttgaggatcactggttaaatgttagtaaagaaagataaagaattttccctgctggatggcagtactcaaaaatttcccattgggaggctgaggcgggtgcatcgcttgagctcaggagttggagaccagcctgggcaacatggtgaaaccccatctctacaaaaactatttaaaaataagctgggtgtggtggtgtgcgtctgtcgtcccagctacttagggggctgaggcagaaggattgcttgaacctgggaggtcgaggctgcagtgagtcaagatcacgccttgcactccatcctgggtgacaaagtgagaccctatctcaaaaaaataaagattttctgtagagatttctatcaataaaattatgtgtgaggctgtcttcttcctcagtgtccatagtaaatactgttttcatgtcttttgtgttttctacacaaaggacatgcaggtcctgccatctttatcacagatgattatgcctttgccccagagtcatgctagctggctctttttttttcctccctatttgagtctttattttcctctatcagtgagaagagtagagtaattgagttaaggtccctttcagctctaacatcctatgattcagttcagatcatttgataagagtagatatcagattttatgggatgatatggaaagaacagaaaattcctttagtaatgcctccctaattctatttattcagtgctttttttttttggtctttggtcagtaaactgataaatgaataattgctttttacaaatgagtttgattttcttgctcctatattgagtaaggctggctctaatagatcttattttatttcagttcctgctaccacatgagcccaagtcgtcactctcccatgcctaggttattcaacagtttttgagttgagttggttttcttgcttcaaggatgcccccctgcccccacaaattttagatttcaatgtgttatctccttgcccaagaatctccagtactttcagtgcctataacatagtatctaaattccacagcttaactttaaagaacctccccatagtacatgtcaaagcaggattcaaggctgcatgtctttacactccctaatttgaacttaggctggtcttttcacggtgtcttgagtgattatattagttcacaacttcaaacttaggctgttcttcttaccctcctgcccccagctcagtatcaccatgaagtttgctttgcttacctatgttgtactatttcaagtcctgccttctccaaaagtttctcaaaaatgacttttgccaacatatacctccccttcagattattaaagaaaatatttgtaatctacccataactcttaccgtttcacttattttggcacctagttattgacttgttttatggtttcttaatttgctttaattttccaacaagtaatagattgtaagctcttagagggcaggggctatgttctgtactttttaagaagcctataggtgctgagcacagttcttggcacatcatgggtgctcagtaaaatacttgttgaatgaatgaaacaaatacacaggtattctttcctgcagtataa

SEQ ID NO: 96629 - DNA, 1054 bp, Homo sapiens
ttctttccatctctaaggagcaaggagctcttcttgttttcttggtagagctgctctaactagataatgagctttaaaaatatttattctttaaatgctctggttcttatttaaaattagtttctttccacagaaagataaaataaaacaatttgctactgccagatgcttctctcttttctggggccttctgtttccattgggccaatcaaggtaagttttgcaagggattgacctgcttacccttgctgtaatggtgctattgcactaccaaaaccaagataccagctagtcatagttctagttaaaaaaaaaaatgcagattttattttttaaaagtactttcatgtatctcattgacataagctggtcacagtttgctttatggccctttctctttagctgtatcagtgaccatctttctagtaagtttacttgctactcggtacacatccattcaaataactgatttttttggtgtggttttcttctactttttcctaggctaatatatgccacgtgcctttaagtagacctaattatttagatgtttagaattcttctccctctgaaggctcctgttagtataataaataaatgttttagtaggagttatgccctgaaagtcccaaaagaatctccgctgtttttgtcagaattatataattcccttttatccccttaatatttcactaacaaatatgggtcccaaatcttggtaaaacaaattcttgttttagctttataacagactgggagagcatggataatttgaattctcaaatcagaaatcatatttgaaactctgtaaacattgctttaaaaattaaaggtgataataaataggacaattgatcctttttcctgcattatttcttctgccactcttggaagtactcaggaggaataagtggtcagaagataattgagaagaagcaggatgtctgtctgtatcattcacagtagtgacagttgggagggttctgccatgcaatttaaaaaagtcagttcacaaattctttagactttgggactgaaggttataaaaaccttc

SEQ ID NO: 96630 - DNA, 1281 bp, Homo sapiens
gcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaaggtattgaagccgacgccttgaaagtctgtccagagtaaagttgagccagggtgtggctctcgtctccacccatctccctttccctcgcgctaagccctcaggctggcagctgctttcacccagagtcctcatttgcatcttactttgctctcccgccctttgccttttctaagtggagcgtcctgatccatgatcaggagacgtatttttaaaaaggatcgtttgattaaatgggtactcttgaagaaatatcttcaagtccttgaacactggggatgaaatattgtgaagattaaacaaaatgcgaaacacccaccattaaaaggagacagtgaaaagtgcatataattaaaataggccatgttcaatggccttcatccacaaataaagatgtgctgtccaccaattcctctacacagaatcttgagggacaaagattttcatcgcatagtccaaatttcttcttttataggtaaaataattagcctctcagttt

SEQ ID NO: 96631 - DNA, 1516 bp, Homo sapiens
gaaagaagcagagttaagtttaaatttccattctcactagtttgtgacctttgccaagttactgaaaaaaaaaaaaaaaaaaaaaaaacaaaagaactttgttgtatgaaaagcacccaaaacattgtcactgaagtgttatttttgtacttcattaaatataattaaatctatttaactccagtttttatttgtcctcattgcttcccagcgtttagtgggctacagatggcatggcatctaaaaccttacaatgcttgattttcatacagaagacactttggccagttgatgtgggttttacctcttcataaaatggtaaactgaatgtgcataaaatgcaagctgtcagtcttaaatgattggctgccaatgtttcatttatcattcccctccccacttttttgcccttttttgcaattctgatagttttgtctcctaggtggtttatttctgttttgctcggagacattgcctttgtatcataaagtcacaaaaccatgataagtggaattccattgcagaagacattgaactgtgcttatttggaagaatagagaaaggaactgaactccacctagtatgccctttagtgtttaccactaccttagggaataaacagtactctcatcctatgtacggtatatagctgttggctcccttagtggtcaacacattaatttgcttgctgaaggtcacatagctggtaaattgaatcagaatttgaacccagttctttgtgactccagagcactttccacagctccacaatgccttcacagcccttgagttacttttcaaattatagtattgctttcctacctaagtccctctttgtatttgcagagttgcatgctgagaatttgaaaaatgaagatgatgtagacactggactattaggtatggacttaattgccgcttgctttggttttgagctcacgtttgtgtttctagatcatgtttgaactaactctgggataaaatacttaatgtatttctatgtgcagtcattcagtcttgtttttaatttgcatatgttggtgataaatgttattagatttcctttatatgtgtggagtatgtgtatgcatatatggtatgtttgctataattttttaatggggccaggtgcagtggctcacatctgtaatcccaacactttgggaagctgaggcagtagaatcacttgagcccaggagttccagaccagtctgggcaacatagtgagaccctgtctctacaaaaaataaacagaattagccaggcatggtttcactcatgtttgtagtcccagctacttgggaggctgatgtgggaggatcacttaagctgggaagttcaaggctgcagtgaaccgtgatagttacactgcactccagcctgggcgacagagtgagaccctgtctgaaacaataataatttttttaatgggtactggtatgtgtatgtaccacacacactagtaatacattttaaacacaactgcatgtgactcaggtccagagaaatatttaac

SEQ ID NO: 96632 - DNA, 1118 bp, Homo sapiens
ttcactgttataggaaaaatataattggaatcatgtatattttgcagccttgttaaagtgccttttggagtatattctgtattagtatacataggtctacctcattttttcatgactgcattgtatttcataatataagtataccagtttatttaaacatttcaaatgtcagaatctcttacccaggacttggaaattactagtatacagtcacgtttaatcccattgtttacttatgaagttttatgaagtgtgtgcaattgattgcctaacacttatttaataggaaacctttccctagtataggaaccatgagagttttgtttttttctggtgtattctgattatatataatatgtgtaaattggtgcctctgtgtctgacttcataaaacttcttgaaagttgcctcatccccgtaagctaaaactgttaaacaaaatgaaaatatttagagcatataacagcctcttttgctggaaggttttatagaaataaagttgccagcatatttttagaagagtaactgctccctgacaccagaatggcttattttgaaaaataagccaaaacaaatatacccttagataggtgtctataatattccagcaaagggattgggataggaaattcctacccatccctgtttttgctttggatgaaaacagtcttaagaggtttcaattgatggaaaagattagtatacatcatttcattggccagacgtggtggcgtctgactgaaatcccagaactttgagagccccaggcaggcggatcatgaggtcaagagatcaagaccagcctggccaacatggtgaaacctcgtctctactaaaagtacagaaattagctgaatgtggtggtgcacacctgtagtccagctactctggaggctgaggcaggagaactgcttgaacctgggaggcggaggttgcagtgagccgagattgcgccactgcactcagcctggcaacacagcaagattccttctcaaaaaaaaaaaaaaaaattaatatacatcactttggctgggcacagttgctcacgcctgtaatcccagaactttgggaggctgaggcgggtggaacatgaagtcaggagttcaagaccagcctag

SEQ ID NO: 96633 - DNA, 1144 bp, Homo sapiens
agtatgttaaactttgagtaaacttgtcaattattttctcccctctttagacatagtcatctaaataatagcaaataacagctatttggcagtatagcaacccctaagttgtagttgtagactaaatcttataattttttttttttaccctctatcctgatagattggtaggaaggttattctaaggttctgttcacccaattccaggttgggttgaggtgctagaggtggatactgtgccaggatattggggtgaaggtgcagactaatcctcaagacatttgctatagtgagtattgaagtatcttttattgtggtcaggatggtgtttcagatgtggcaacttccagccacatgaccatgtggtgtttctatgccaggcttagggcagaggcatctgcaggcttggctctgtacttacctaccaagatactgtacacagctatactccctgtgtggttttgcatgggcttttctagatgcttttgtcaggaagccccagtagcactactccctttccccatttacacacataagtgcaaacatgcatacaacctactttatttaaactaaggaaatctttctcacttgtcgataagcccctcactctctccctgttccacacaaacattttatctgtactccaatcaactcattgtctttgctgtgcattcaagacatattgtgtttatccacactcctatccctgattatatctgtacactggtttctgtaaatattgtgcaatgtaaagtagaaaaacaggctatttcttctttctgctttgccacatccctcttctggagaaatgaacacagagcccattagctctttaacaggtgggagatgggaggagggaactatcaggagatataatttaccacactttctattaataattcttctgagtctgtactttaacagttttttcagtctgttactgagcttcacaagatttacaaacagtccattgcatgtactttttacctgcttcttgctaaaataagactggtggataatttgtatagtcaggaaatttgataattcgtaagtcatctgctagggttctcaactcttcctgtattcttgaggcatggaacacactctcagaaacctgttttaaagacgcagtttaaaaatgagt

SEQ ID NO: 96634 - DNA, 2147 bp, Homo sapiens
tttttctttttcgaagcggggtttcactctgtctcccaggctggagtgcagtggtgcaatctaggcacactgcaacctcaaactcctggccccaaaccatcctcccacctcagtctcccaaaacactgtgattgcaggcatgagccaccttgtctggcctcaagacatcttaagagtcttgtgaaatgttttgaccatgttttctgtagttgaattttataaaactgaagatgttatgttcttgttgaatttacccttttttcccacgtattatcatttaattaaaatattcaatgatatgacttctagttgtgctttagtaatgtacacttatttctacataagttagcttgcaataagttcaaatctcttaaaatatcagatccatataatttagaagatgagaaatatacatgatctgaacatgagagtactggtttaatttaaattgttttggtgttaataatgtactttttcccctctcttttcctgttaaggattctggactctacttataatatccctaactgctggattctcctgttgcagcttttcttggacagtgacttactttgattcttttgaaccaggaatgtttcctcctactcctctttcacctgccaggttcaagtaagtattcctgtttcctgtttcttttttaaatgcatttcaactcttgaaaatactaaaatactcagaagcaagaggctgatcgtgaggtatgttgaggtttcagtctttataaagcactaataacaggacttttcagcttgtaggctcagcctttagatacatgagaataatatttaaaattctatatctagataatgcttttttttctaaaaactgaaattcaggggcttatttcacaagtaagaacctttgatggctatttgtccttttggaatagaatttgatttaaaacagtttataaaggcaaaattaataccaacaatttgaaagttttactaggttcacacatggtcagacttacaagaacataataattggattggacttttccttaggattttaactttgtgtaataattagcaaacatttatggtacccaatttatatgtctagaccagattggatgcttttcgtagtggaacagtattaaatttctttggtctatattttccatgtttcagagaattttagaaaattcagtagtgttctaacctagtttattcatgccaggaaagttccaattttaaatataaattccgaaataagaacatctaagatctctagtttattctggaaatttggggaggacatgaagacaagaaactaaattatattaaatttatgtatgttattctaatacttactattgttactaccaggtctagcctacctcatggacaggttgtagagataaaaacatttacttgagagactttataaaatcaaaattgtgctagtatagttattaataatcattggtactactggccttcattattagtaaactcccaattttttttgtctcatatcttttaaaattttggctcgacttcaaatgaaatgtgaatttgtatatatgtgtattatgtatatgtatacatttttagtgttttaatccctatgtgtatatgaaatgtaagtcatatgctttccaataaattttagttatgtgtttttgaggtggataaacaataatctaaattgactaagagttaagcctaacattacaatgccatcccgtagtttacatgggtaccactcaattagaagtttactttaataacaggtataagtctagggtaatgagactcgtttcaaaaaaatcaccaaaaaagtaatcgtattttttccttttatttatatctcacttccctgaattctagccacacatttcttgctgtttaatagaccttgctacccagatttcagaaagcattttgcacttagagtgattaaaactctgtctttgctttgaagccatcaatatccacccatttcactcaccagagcttgaaattcttattcattgtatttgtctattcaccaagtccagtccttcctgactttttaaatgtcattagaatgcttcctgtttgcattttcactgtttttgtactatttaaggctagtgtacttgacttcttggccttctgtcctctaagttctcactcttc

SEQ ID NO: 96635 - DNA, 1031 bp, Homo sapiens
tgctaaaatataatctatgagattagattgggaatttgcattatttcacagttaatatacaaatcagcgggtatctgctaccttcctcatgctatcaatctttattgtctgatcactatgaattatccatctttccatttcttcttcttccaaccacaaataacatttgataaatatccagacactcaattttagaaaacatgcttttaatttaatttttatttaatgtaacattatttatatgcatccttgtttaaaaaaattgtattgccttacaatgcaatctggaatctgcaaaataaattgtaagtgagaaagaaaagggaacaagttaattttagtttgaattaatttttggtaaattgtttttagtaactattttagagagtaacatgatctattactcttttacatgtgttacttcctatgtaaagcgttctgtatgtaattagatgctaacatttgtgtgtgagagtgtgttgttaactgtagtagggagcagcagatagtaaaatactttgacatgtgaatttcctggaacattcaggattcagtattggcatcctgtattataatgttacttttctattcaacattagtttgggtctttaaaatattgttattagggtttttctctgacgtcttcacattgagggttaggaagatagagaacaaataaaacagttgaatcataatatgcaattcaagaaaagggaacaagttgatttttgtttgaattgcttgaaatttgaaatttccagcagcactcagttttctttaatacagttagcctatcctcataactaaatacaagcactgattttccctccttggaaataagtatatgtggacatctttagcataaaataatatacgagtgttacaggttcttaacttgggcatatatataagccttggaggtcaaaaacagtgggttagttagtattcaaattagaaatttcttttccatgcagactagatttaacattgagcacagtgaattgactctactactctttgatacagatttt

SEQ ID NO: 96636 - DNA, 2265 bp, Homo sapiens
agtcaaatcaaagtaagaacagacagcatggaaacacaccgctaattaatgaaagaactgtttgtaaaataacaaaacttataccttagaattaggttatggctacacacagtgacaatgaaacacagtaaagaaataatagggatgaaactcagcattactcatcagtaatgatttgaaacaactgtaattgttaaccagtacagttttgacacaggacttaataagatctatccactatttatcctgcagatgtccaatattctttaagttttgtattcatatgtgaacatttgggaaatacactccaaggtcataagtattttcgatgaaaacttttggtgtctttgttataccacgttacatttttcttttttgatttgtgtttttctttttttctaggaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgctcctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtgtgtgtgtgtgtgtgtatctaaatatcaatcccatggcttaagtattcctaccagagtggtggttgccatcagtctattttcactccctgccttccttcctgcacgcttaaactcttcaccctttgactccaaagagccctttcattgcaaagatgtacacaagtaacagaatcaatttatcttctctccaccactctgtattcccacgcaccaccaatgtgagtaactccctccagattgtttgtgtctaatgactaggaaagttattaacagtagaccctagatagagatatgtacaccctagacagtcatgtgccatataacaacgttttggtcacaacgaactgtacttatga

SEQ ID NO: 96637 - DNA, 1103 bp, Homo sapiens
aaaccaaggtgacgggatagggataaagggttcctgtaggctgttttaggctaatagggaaggtctgaagaggggacactcaagctgagacctgactatccagaaggcccttttggtccagtctgggggaagagcgtggcagatgctgtggaacagctggtgcaagggccctgagctgggaatgagcttgatttattctgggaactaaaaaaaaggtggaggtggttgtagcagagtgagccatgtggagagtggggtgagaagtcagagaggaggaagggcctatctgcattctagatggttttattgcagcaataggaagtgttaggatttcattaaaaagcagagcctgtatttatacgaaagagtaataatttagtaatctcaaaatgtatataacaacaaaaaatccactttttacccatagtgggttgcatgtagttaatttaaaaattagtcattctgaatgtcttggaaatgcattctgagacactctgatgcctcaaaaatgcacaaaattttagacagctaccacttttgtatcaattatcttccctcttttaccctcctaccctagcacccctacccaatttctccattcacagcagtgtgccggtggtaagaatcttctcatttcatttagtttttgctcattcctattgctgtggcctcagcaggagtggtggggggagggaagtgagaaattagcttcctaattttcttgagagtttcagctttcagcccaggactcaaatgttattttccccacttttttggaagtactcctcattgatcagacacaggtttgttgccctccttgcttcaaatgagttggattttcactctcaagccttgcctcttcattaataagctttacatctttgctcatctagcaaatttcaaaacagaggttacctctcactcttgctctctttgcaacttctcccaggagagagagcactgctagaggcaaacaaagcattgcagatttggctcattagaactccatgctttcaaacttcaatctggtttctgctgctatttggcagtctttttaattgtcttttctgtactctcaggcctgctccccatgggatctattt

SEQ ID NO: 96638 - DNA, 1046 bp, Homo sapiens
ttttttttaactaccaatgaattttgcaaatataaacattaaaccccatataaggtattatagaaacatcaaattttattgtaaccttaatcatgctcacatgagaagctcttttctctccattctttttaacatattctagtttgaatctcatcatagattaaaaatgcccttccagtagatggctcttcatctaaaatatattgtcaaatcacaccctgcactaacctataattactccctatttgaagtatggtgaaataaacctaccaaaaattgaaatcacatttaaaaagtaatttagcatattttttctaaaaagaagtaagaatataattcatttagactctatgttatgattcttataatactagaagaatgccgagtacagaaggatcatttagagaagaatatgattaaatgcctctgagagtttgaggttaaggtagcctattcagatgaagtgtcatctcactagaattttaaaaagatgaatagaattttagccagcaccaagagcaaaggcttgaaggagtgatacagtatggtatgatttgggtaacattacctgcccttctatgtgagacagggtgtgagaactctgaaattctgcctatcaaaaataagaggtggagttgccgtatcatgaagctattcaaatgtattcttttggattagcaaaatcccaaacaattttgaaaactcaaatttatatggtgaaatttttatgttagaattagtagctttagttttgtatcatttttacactttgtacccaggttcctatgcccatttttctgttttgtgaataagagaatttatctagttaattcaaggaaaatttttttttctgaaatgtacaagttatgtacatatttgagttgaaatgtacaagttaagtacatatttgagttaaggcaaataacttctttgggtatcttttaaatatacataactcatgcttttttgtttataaatgtaaggatggtatctatgtattgctgtcttatatatttgttgtcatatgaaattaccttttcaaatag

SEQ ID NO: 96639 - DNA, 1070 bp, Homo sapiens
gtatcaaccacaattaagtgtgagccacctcaaaacaaaacaaaacaaacaacaaagaccctatatgtgtcctataaagaaaccagcatctgttgatggctagaatggagagcaagacaaccagcctgtgttcaacaagatagaatggagaagtgcctgtgtttcacccctctactattaattctcatgcctactgttctgtccagttttgtaagaaagagaaggaaagagggtgagggaggagatggagagagtgaaaggtcagactacacatccctattgatatagaatgaaaaaaacattgagagtgaggtttgattttatagagttttgaaccacttagtaataaaagtgagttgtaattatgggcaaagatactgttctatactgagaagttacctgaacggctgagatgttgtcagagtatttaagaatgaggactcaacagaatgaattgaacggcagaaaacagagaaaaagggagacattttttcctcccacatcaaattcagactgttcaataaacaagttccatttatgtttagtcaaaagtcaagtgatagtgacggctttagctatctagactttccactccccttgtaggcctgtgtgtgtgtgtgtgtgtgtgtgtgtgtgtgtttgagacggagtctcgctttgtcgcccaggcgggagtgcaggggcgcgatctcggctcactgcaagctccgcctcccaggttcacaccattctcctgcctcaccctcctgagtagctgggactacaggggcccgccaccatgcctggctacttttttttttttctttctttctttttttttttttgtatttttagtagagactaggttttaccgcgttagccaggatggtctggatttcctgacctcgtgatccgtccgcctcggcatcccaaagtgttgggattacaggcgtgagccacggagcccggccataggcctgtttcttattctatattcctgttaatgtaaacctcctgagattggaagacaatcagttttacagggtaagaattgttttaattatgtggcagcttttctccaaacatgaaga

SEQ ID NO: 96640 - DNA, 1043 bp, Homo sapiens
acaatccttttcttccccctgataataagaacctatgtttggttttcttcccattaatttcatacttcttttgcattccaataataacctgtagtctgcagccttaatcatgataagcagtctcaaatcactttatttcatcacagtgttggataaacacttctgatttaaatttcaataattctacattagcagtgctgataggagccttcaatgtctgatggaaattctgcacagggattacttagtaattattggtttcactgaggtttatgttagagctggagttagcttttttgccagaaatccaagccccagagagcaagctgggccaagtttgcacaatcactgctgttcacctattagatgtgtcacaaaaaatgaaattaaagtctctctaatgagtgatcaaactgtttaaaaacctcatagaattttaggattatggaaatttaaagaagagacagctctattaggttatctaatcaacctacctcccctctctttctcttaagggactgttctttaatgccatttttgattattttgtctagtcaactgaaatgatttggtccataagacttctataattcccccaggataactttccctgctctaatagatttcattgttaggaagtgcttcctaataactaaaccttcccattcatcccctttaattcatgccattctcgtattttaacctttgttttactgtccattagttcctgtaccttgtataaaacccacatcccaaataagttttgcctttatcccattgagatttaaagcatggtcaataaaaacgtgtccaacgatgtcatatttattaatcaaataagaaattttcttatttcgtgtcttgtagaaactgatataatcatttttatactattatctctctctccatgttcttatatgaaaatcatgagccacacttgatcatgcaaagctatttgcaccccctttttggtggaagaaaagttagaataaatattccctttattatgtattaacttatatatgatatatgggtatatatgg

SEQ ID NO: 96641 - DNA, 1078 bp, Homo sapiens
attcatattatatatttatatacataaaggaatgtgaagctatttattgactactgtacaccagtatttaaaataaagaatatacagctggataacatcctgattattacaaaagtattgttttccttgattttcttggcttctgctaaaccagtaacccaaatactgaaaaaaatgagcctacatgtaaggaatgagttgggtaaaggaaaacacatgcaggtcaattgtttacattatacacgtctctttacccatttatgccagcaggtcctaactgccttttctaaacttatctgattagttttccatgagccaagactgagacattccacaaatcatgatgttttaatcaatacagcacaaggattacagctttttctaaaggaaaggcttattagaggaatctttaaatatgtctatttgactaacacttgcttagccaattaaaacagcaagatttgtctagtttccttgtctaagtgaggaggttgttggtagtaataaaaaatcttccgtttagaaatttggaaaacaaagaatcacatttatatgaatataggtagaaatgtgtgttctgatgtggatgcttttaaattatccagttaattatagaatcatctatgtaatttgaaatattacgacttcaggaaaaatttcaatttaacttgaagtgatttatttcttaggttgcacagaattatggcatcccaggaccatgggcatacccatggtttttgttttgatgaaagtttaaaaataaaccaagaaagaaaaccatttacatttgtattttaagcataaacacacaaaacataaaactcagaatggttcttaggcatacgaattaaacacaagtactgattgtataatgactaaggaagtttccctcaacattaacaacgctgttctctagtgcagaggacaaaatatgccatggtatcaaatgttcttttctgataaagaaagcaactacagaaagtttcgtttatttgttgaaattaaccaatgtgattgatgcaaaaaaaaaaaaatctcctggcaaatctcccaatactactttgaaaacaaacatatc

SEQ ID NO: 96642 - DNA, 1013 bp, Homo sapiens
actggcggctttccggacaataacagttctatcccttgctcattggttgacagaataacatgcccaatgttgtgataatatgagggctaatggatcctagacttgctttcaccctactcaagtgagaatttaaacactagcagtttccaggcttactaacctgtgctttcacatccaccaagaagattcttatatggaagtaaaagtttccatcatcgcccactagtccttattagagaggctgttttccagttcttgcaaacacatctgtaggctggtgccccaacatcaggtgcccgcaggtcaaattcatttaacctaagaaacctggtcaaatatgagcaccttttgtcagcattccatatagtttttctcccagaaagaatgaccaacctgaagcagctgtgggtaattctgttagccaaaacaagctggaagcaaaagggaaaaaggtaacagtgaaaattcttaaaggaaccaagtacaatctcactaataagctacaaaacatttaaatgactagtgtctgtgtgtgcttgctagtattattataccatcagaaagtaaaaatggacatacatgttatgcattaaacccacaagagagaaaacttgaggactgattaatttaagtagtaaatgaatccaagaagtgtggatcacttgatggaaaataaccaagaaagcccattattatctctcttgctggcttggtgtatgatgaagaagagacatatattaaagggtgctgccagaagagaataaatttgtatcttaatagaaaactcaaggcaaacttgcgggggttaccaaatcaaggaacatttcttgaattcccactgactacggtgtttctgtcacattgttgattgctgcagacatttccttaactctagagtgccaaacatcaagaaaatgtgcacaaataaacaatattaagaaacactggtgtggtagactgttagaactccccccattcctgtatgtacatctctttgcaatgtgactttgctg

SEQ ID NO: 96643 - DNA, 1044 bp, Homo sapiens
tttgagctttctggagctgaaataggctgcttcaggagttaataagctccctatccctgggcagttttaagcagaggccgggtggtcccttgatggttatattgaagaggactcttataaatatggtggagttttggccagattctaattcctttaaagccttgagaatcaattagattctatgagttttatagtaaaagcctcatataacatgattggtctataaggcatatggtaatcctgttcatagacattggcattcatgtatggctttatggagtatttgatttattttaggacttctgcttgatttcctcttggtctgcctcataattttcattagctccatttggagatttttttgggggtttggctctatggcccagtacccatattcattgcagtaataaagttttaatactgaaatataaagtcatgtgttagttatcaaatttccttagctcattagctcctgaagaatagaaaccaaagttttttaggatgatcttgtagagagatcagcttgctggggttaccaaggtcattctgtgactccctgccatcctttgcataaccataatttcaagaaccttttaactcaatcactgtaattactttacatgttttgttggagagagagacatagagaaagaacagaggtgttctgtgattttgggtcatttttagccatagcttcttaatacagaatgactgcattgctgaaccaaatgaacagatttagtcttcagtttccaatccttgagatttctcctgaccctagaagccaaagtattgcttaatgataattatgtttcttcgggtttccagatcaatttggcatagaacatatctactttgttgtccagacaaggcacagagaatgaatgaataagatcatcttccagaaggtagaacctcgttaaaaataggaactgagaaatatattgccgtggaagcatttgttgttatgttattaacagggactcagatgtgtgagatgtaggtttaatttatatttaaaatatactgatgaaatatattgct

SEQ ID NO: 96644 - DNA, 1020 bp, Homo sapiens
gtctattgtttctatctttatgtccatgtgtacccattgtttagttcccactcagagtgagaaatgcagcatttgactttctatttttgcattaattcacgtagaataatggccttcagctgcatccatgttgttgcaaaggacaatactttattatttttttaatggttgtttagtattccatgatatatatgtatcacattttctttatttaatttaccattgatgggcacttggattgattccatgactttgctattgtaaatagtgctgtgataaacatatgagtgcaggcgtctttttggtaacatggaattaatcagtttttgcacaatgccttgtgactggcagtttcctggttgtatttgcctcattatattttcgtctggatgtctccttgaccagactgttaaccttaccagactgaactcttcgatgacaagaactccatcttaggcatctattttttttccctcaatgcctagcacgatttctggcatggtacaaggtaggtgttaacacatatttgttgaatcaaaaacaatgtcattggtcatccttatagaaacagattgttgtaatacctagaagtgaaaaagaaagaaagatggatcactaggaatgacatgattaaacatctgcaaggagtccatatgacaaggaatctgatagatatatgtggctgcagagccctctgtttctttaagatattttttaaagagcattatttttatttttattttcactgaagtttagaatgtatgtgacttttttatatcatctatctttttaaaaaataaattaggacacatccttgaggaatactctgaaaactccatcaagcttccaaacttgaagaaaattgccaagttatgcacatcttgagatttttctcttataaagccaagatatgtgaaatttattagcagttctcatgtacagttttacgaagaaaagaaaaatgcagacgttagtgttcctatggcaatgaggcttcagttctgattccgttcccagctt

SEQ ID NO: 96645 - DNA, 1722 bp, Homo sapiens
atatcatgtcctttcataattattgtgaaattataagacgatgcttctccttttttttttcctttgtagtggctgatttgttacctagtgctttagttcgataattttgataattattatcaaataagatcctttgtgtgtgtatataggagaaaatcttatacagaacacattaagatatacataagttatggcaatcttgtcttctggggctgttttttaaatcttttaatggctgaggttttatttctctttgtagcaccagcactcgatgtgtcttaaatgtgatcagtagtgatggtgagcttgtcaataatgactccatctccatgacttgtgaataggcggtgagtgtgtcctttaatcagtcacacagaacttgctttataaagctgttattgtcatgaacagatattgcagtcttgtcaggcccagtgattattaaagtgttccttcttcaaaagccaggccgaaagtcctgctgtgcttcatttcacaattgaagtccattagtaaataaaatcccaagccgcacgatttgctgttcctcaagttataggcttacatatatttcattaataatcttgggcccttttgtagacataagtaggtatatttttggtatatatatatggcaacaaaaataaaatatgtatcttgcagcatgacttttattttaaatgaagatttgatggatgtccattgttactctaaatgaggtggctggctgccaagggaaaccctacagtcagaaagtactagaattgttactatctacagggaatcactttctattttttgagttctcaacttcacctcctcctttcaatagtgcccctccatattgctaatctgagaattagtctgaatatgaaaacttttgaaaatatgtttgtgttgtccaagaaaaatttcaccagtgtttctggttgcctgctggttttcagcctttatcttgagtgggcatgtttattctaactgaatgaagaatgactattgaattaggtatattccccatgccaaataattttaactgtgatgtaatcctagccgctttcttatttttactcccgaataaatttaaaatatttaagattggccaggtgtctgtttttctcagggtaacatgggacagctatggataggcattaggcctctcatagaactcttcattcaagtgagtgtggctgagaggaacaaccaggaaagagtatagtgccccattgcacttgccctgttggcttttcaaatgcaaaatccacgttgttgcatttggaaacttgtttctctgttttatggtatttcatttaagaattttttttaactgccagtctgtaaatatttaaccagccaagcaggaaacagccttttattctcgactgtatacagcttttgtttttatctgggttagcatgggtgccatgtaaataccatataaaatttgactttggttgtccttactttgaagattgacaggggtttctttaattaatcttgtttcctttcatgttctgtattgagatattgaaatacagtattttatacatttataggattgtgtttgcatttatttaatttatgtttctttttttgaagcatgtagccttgaatgtttgttctaccctttttttttttttcacatcattactctggtgctgcttgatgtaacttgattagctccctccccagtcatgattggtaattaaaataggcattaaaatt

SEQ ID NO: 96646 - DNA, 1030 bp, Homo sapiens
agcaggcttcccacttgcaaccccccgccacccaaaaaaaaaaaacgaccctgcccactgagcatgcccagcttacttgttggaactcctagggctagacaagcccaaggggacctaaggaaggcaaagttggggctcaaatggaccccacttctttaacagctttgctccgaagacctctgggtgctgtactaataacctttctatcgtggtattggaaaatatccaggagatggacggaaatgcctttccaaaagaaggaagaaaattagtgtgaaccaaaaagcagtggtatttttttaaataaagtattaagtcactcatttaatgtccttaaataccgcagaattcctgtagttgacccagaggaatgcatatatttattaaatcccaaactcagtaacttcagggaaccatccatagtccacagaggagcaatgattctcacccttggacacattaaaattggggggagggggcagggaggggtggaatgccagatttccatccccaagtccaatgagtcagtctggacgtgggatctgcaagtccttgtattttaaaactggctctaaaagtgtagtcactggagcccgcagcatcagcatcacctgagaacttgacagaaactgtactccagtgacctgattcatagactctggggctggggctgagctacccagatttaacaagccctttgggtagttctgatgcacattaaagtttgagaaccacggtttaaaagctcccccagttgaatcatgagcaaccagaaaaaggaaattgtagttgagaaaagaaaaatagttcagagcatttgagcaatgtgaggtatgcaaaatttatcaggcccagagagaccttgaatatgggacataagttgcaccccccacactcatgctcagaggcgattgtttaaaggcattttgttcatgactgactacccaaccatatcttcatgttcctggaatttgtgatacgaagaacaatctatagacaattaatagtttgtttttttatgtaaattatt

SEQ ID NO: 96647 - DNA, 1056 bp, Homo sapiens
ctcgttagagactcttactagttctttgagttgtgtatttctttctatatcatatcggtgctcttatttcctatttttcagtagagaattttatgttctttcaaaaccaaatttctgatttatgcagcaaaaacatgatttctgatttatttaggtcaagcttcggttcaattagttcacaaaattagtgggaaaaattggttaatagatgtctctccttctcaagtacaaatgtattgtgacatattgtgatatagtaagaaagatacttgtccccagttctgactaaagaacttttaagacccttcgaatctctggaatgatgagtgtctttttctacactgctgagatgacaggtgactcttggtagaaccctagatagcttcaggatggagatgggagctggtgccagaggaaccaactatgtaattagagggttggaatttcagcttcactccagacctccggggagaggagaggggctggaaatccagtcagtcaccagtggacaataatttaatcaatcatgcccacatcatggagccttcataaaaaccttaaattttggaaagcttctgagttggtgaatacatggaggtgctggaaggaaggcatgcccagagaggacaccccttctcccatttcttgccctgtgtacttcttcatctggctgttgatttgtgtcttttttaataccttttgtaataaactgttatatgtaagtaggcctgttgtggtggctcacacctgtaagcccagtactttgggaggccaagacaggaggataacttgagctcaggtgtttgagatcagcctgggccacgtggagagaccctgtctctacaaaaaattaaaaaagaaaaaactagccaggtgtggtggtccatgcttgtagtcctcactaccctggaggctgaggtgagaggatctcttggggccaggaggtcaaggctgcagtgagctgcgttagtgccactacgctccagcctgagtgacagagcaagaccttgtctcaaaaaaagaaaaaagataaaaaagtaagtaaatttctgttag

SEQ ID NO: 96648 - DNA, 1029 bp, Homo sapiens
ttctggttgtttaattgggcattttctggtgcccacttagaattgtgggattggggtatggagcattctagaatgttggtgaaaagtctagtcctttaggtttcttcaaatgttggtcttcttgggccaggcgcggtggctcacatctataaccgtagcactttgggaggctgaggtgggcagatcacctgaggtcaggagtttgagaccagtctggccaatatgacgaaaccttgtctctacaaaaatacaaaaactagtcgcatgtggtggcgcacaactgtaatcccagcttctctggaggctgaggtgggagaattgcttgaacttggaaggtggaggttgcagagatcacaccactgcgctccagcctgggcaacggagtgcgactctgtctcaaaaaaaaaaaaagttggtcttcttgatcctacatgaactaattaattctgtattccaaagaattaagataatgcaaatcagatggcagcagaatgaatcaagtaagagtgggaagggcaaatgtgaaatgagggggcaggagtgagtcactcttttgtgtagatggatagggaatgctggaaaggggagggtgaaggtgggttgggggctgtgggagagtctgagcaataaggagatggcgtagcatgggtaaaggtggtttgggcgacacagtggttagcaagctctgtggttagcatgttctgcatgagtgaccaagcaaggcccattttggcacttgagatgggatcactgaccctcgttccccagttctcattgtaaggttaaacaaagatgcagtgtatgctttcatattttgagattagggtatcattctagaagggacacattcttgagaaatagcttgatttctttaaaaaaaaattgactcatagactgtttccatggcattttgattttttattagtattttttcctaaggtacttagatggtgtccagagtttgtgacagagccagaaagcaactccccaccttctctgaaataaaaataaataccaagaagtactatt

SEQ ID NO: 96649 - DNA, 1049 bp, Homo sapiens
taatcccagcactttgggaggctgaggtgggtggatcacgaggtcaggagattgagaccatcctggccaacatggtgaaacctactaaaaactactgaaaatacaaaaattagctgggcatggtggcgcatgcctgtaatcccagctatttgggagcctgatgcaggagaatcgcttgaaccagggagtcagaggttgcagttaactgagatcatgccactgcattctagcctggcgacagagcaagactccgtctcaaaaaaaaaaaaaaaaaaaaaaagaaagaaaaagggaacatatagaagatctcaatcttttacgtaaggacattgaagtccagggaagtctgatggctttgttcaggctgagactatcgtagggtagactgacatctcaggttgctgactgcccattctgtaatctctgcagagcacttggctgccacatagtataatctgaaaaactggcagctgccagacgaatgactgaaggagtaagctcaagtgcactaggtgaggtcaggcctgaaggtcattggactgatactgaacctggcgttttgacaggaatcctattagaaatgccacttagtcacttgcctcctgactgcttcatggtaggaacagaggctcaaactatggcctgaattttttggattaagtttaagttttacttaatattatcccaattttatctcagacattatctcaaaattatttcaaaatttatggttgaagagaggctgttgagtataaattgctaatgtactctgctgaattccatcagctatgtgatttgactgagaacagtacgatcctagcccactggggtctggtgaattgcatctgctcagtcagagtgttccttgagctggaattgaaatgcatggccctttagtttccagtgtgatgccaacacttcaggcaattgacttttgctcttcagtctccaatagggggaaaattatgaaataaaatggggataggccaggcatcctcaagattcaaacccataaatataaataactgtaattaatcatatgcagtctc

SEQ ID NO: 96650 - DNA, 1064 bp, Homo sapiens
tacaagcgtgtctttccttccagaataccccctgatgattttcttttttaatttagagttttgggaatacaacatagagaattatatatttttgggaaagactatagagttcttttttgaaaaaaagatcaatgacagcttcaaaaggaatattgagtcgaaccctttattttctctatttatgctatttaaattttagacctgtcacctctgtgctattagctctgtagtgttgataccaaacatcttatgcagaataactagactatagtacttgaatgcttttcatgagggtttgtgctagcccttttaaagaagaaaagaaatatctttttctttagtttggaaaggatgcgttattcaactgaggagagtaagatcttatgaccaagatcattttagccaaaatgactgagatagaaatacagctttcctcattatttttgcataggtgaaggaaaatgtagtatattttcttcactttttttggagtggggatggagcatttaggaaatacattgttttcacttactttaaatgggaattttgttagcagtatgaattacttcaatctgtttctctcatctgattcttatttccttgtgagtcagacatttttaggaagtgtaatcagtaagctaaatattctaatacatgattattttcactacagtacgtctcaggtttcctttttcatatatgcattgtatctgtactttggctctttgttgtagttccatttatacttgtggattattagatgtacagaggagtaaattttaaatgtaaatttcaacaggttacaggagaaaaaagactgcaggatggaaaaactagtcagcttttttcctagggatcttctctctgttaaggaaacagagtgactggtcttcccaccacagcgcacttcttgatctcttataactctcagtcaccacttatacattaaatatatgtgtagtgatgtttataatagagctgtattcaaattgagaactttcttttacaatgaactgaacaataactgaagttattgtgctataactaattattattaaaaattc

SEQ ID NO: 96651 - DNA, 2408 bp, Homo sapiens
tatagtatcctaaaatgagttttctataggatcatagttatcaactatattgcaattctttatttaggatagtatgataatagatacagtttattcagtatggacccaaatatttaaccgtatcataatttatgttgagatactgtttttttagtatcctaagttaaaactaccttcataataaattgttttcttgagttgtgagctatcagtagaatgtaacgtgtgttgtccagacaggccagtgctccacccctacaaggaaatagggtagtggcttccctgtttccctgcttttgtgaatgtaaagtcttaggcaggtcaaattactcaactctagaattttttttagttgatcacacaggattatctttttacgtttaacagtaaaagcggacaaaaggatttttgatggaattttcatttttatgcaatcttcttagtttctgaaagagttaaagaataatttttaagtcctcatcaaaactttagaaaattccattatcagtccagtagtggaaaacaagtgagaggaaagaaagttaagagctaagacaatgcagaacttgagaaatattcagtggagcagagtgtggggtggctcatgtttgtaatcctagcactttgggaagccaaggtaggagattgcttgagtccagtttgggcaacatagcaagaccttgtctctacagaaaaaaaaaaaagaagaagaaagaaagaaaaaaaaatagccatgcatggcggcatgcacttggtagtatcagctacttgggagaatcacttgcccaggagtttgattttatagtttgctatgattgagccactgcactctggcctgggtgacagagccagactcagtctctacaaaaagagagaaagaaaaaaatataaatacagagagcacaaatatacagtgagtgcttgatctggagggttttctcttaaaattttggtgtcatgcaactctggctagaagaaaactttttctgttaagttcccctaatgaaaggaattacagcaggttaaattggtcagtttgtgaaagtcttaaggcataatacctctgacttcttatctgtaaagtatactctttttttttgagacggagtctagctctgtcacccaggttggagtgcagtggcatgatctcggctcactgcaacctctgcctcctgggttcaggcgattctcctgcctcagcctcccgagtagctgggatcacaggcatccaccaccacggcctcccaaagtgctgggattacaagtgtgagccaccacgcccagccgactctttcaataatagaaatataacactgctggcttttggctgtagtgaaaacttcattagaaagggaaaaacttgggaagggagtcttaccacaatttgaattaaacacttgccaaagaacctgaagcaagctgatgtttattgtcttgttgagtgacccaagacttctttctgctggttctccttgaggagaggattaggtgttgagcaaatttacaagtatagcatgcagttttgttaaatacccaatgacatttcttttcacagttcttttgactttatactgtttaaatatcctcagttatctcttaatttgcttttctttctttaattcctgtcgaaccagaaagtaacttttatgtgatcaattcccttgtctagaattttttggctatttattttgagttgcagtatacacattggtttgttagtaatttccttattttatgttttcttttctagtttaacatggtttcataatctacacagtgtcttattattgggatggttatgcgataactatcccaattaacttctttttgtttcttatttttctttgtaggctaagaaatggcatttcaaaaggcagtgaaagggacgattcttgttggaggaggtgctcttgcaactgttttaggactttctcagtttgctcattacagaaggaaacaagtaagtaactgtacttgtgttgattacagtatgcaacttaaatctgctaaagagctgtctatggggaatgtgtgcactaacggttttgtttagaaattacttgtgaagtttctcagtttgatctgaaagatactaatttagaacagtgccttaatgatcctggagaactgtgtgtatctccttttttaaaaagtgaatttctttttcaggaagcattatttagcctgtgttttggctctttggtttttaaaagactgcttcatttataagtgccaggatttcttcatttagactttccttgtctaattcatcgaaatgtctggataccttctatgttcctgccaaaagtttgtcttattagaaggcaggcagctgagaaaggaaatggaaaagaaaaggcccaactgaatcctggttttatttcttcaaggtttagttacttatgaag

SEQ ID NO: 96652 - DNA, 1098 bp, Homo sapiens
tgagtcaacgactgagctatgattaacgttgacagctggtgagctgctaggctgttgctaactgagcaacattgacattcattttgatttgactttgcatttcattttcaactatctattcattttaaggcctctttaaaaactttttagggatgttgtagacggaggaaactttctataaatgctttggggagagtcctttagcttccctctccccattccccatccttcagcttaatagttaaattatgtttatgctaggaaagcatcttctaggtagttttagaaatagatgatttaaatagaagttaggcgattccaattttgctttatttgttttgtaatttgtgatttcaacaaagaatttctgtaaactaattgtacaatagtgagtaccaactagaaaaatcatatttatatttgatgaaataattcacagagaaatgatgagtatgcattataaatttggccaaaatgtatttttgaacataggttaaagtgtagctgaaggccatctagattataaagcttggaaccggctggttggctcagttgggcatcattttattcacctgagagggatggggaaagagtgagccctctttaacttctggatctacttccagatgctttagggagtttattaagaaaaagtgctggctgggtgcattggctcatgcctgtaatcccagcactttaggatgccaaggcgggcagatcacctgcggtcaggagcttgaggccagcttgaccaatgtggcaaaaccccacctctactaaaaatacaaaaattagccaggtgtggtggcggggggcgcctgtaatcccagctactggggaggctaaggcaggagaatcgcacaaacccaggaggtggaagttgtgctttggagctaaggtcatgccactgcactccagcctgggcaacatggtgagactctgtctcaaatttaaaaaaaaaaagtgctatttcatagaattctgtgtgacaacttaactgcccaatgtggttggctttaggtgaggcagatgccctaggacttctgatctcactaactgccatcaacagttctgcactgctgatgccagaaaggcagg

SEQ ID NO: 96653 - DNA, 1498 bp, Homo sapiens
tcatttaataactttatggaaaaactcattgcaatgatgttcttattaattattctttaggttgtttttgggtggttttttttttttctatttaaaacaatgctatttgtcaatcaagttctgaaccagctctgagaatagtaagactagtaagatgtggccttgatttcaaggaacaacttagcagtttattactatttattgaacaaataaactttttcttctggcagtgaagggcattctgtagtgatcaaggtattagctagtatattagcagatgattgtgggtgatgatagttgtggtggtgatgataaggatgacaattttgaatagttaagagtttccagagcctgaaagttgatcaggtttttaatttttacagttaacagtagctaagaaaacgatgtatttttaatatatcttggcatattaattgtggtcttaaaataattgcctgtcttattttatatatgtggaattatgatttataaaaaggatgggcaaactttagcttgtatttctcttattatgctggtagccctctgggagtagcatttataattaaaatttataaagagatggctgaaggtaatctatatttatccttttactacaattcctgatcatatcagtggccctctgaagtgtgaaataatcatgggcatttggttaatgaattgtgcattgttgctgttcattcatggaatttgctcttttatcatatttgatgcttcacttaacaacaaattttgctttctctgcatttgatatgtttttaccaaattattcctgattgtatccattaatctttagtcacatttgacaaaaataaattactgtgatcttttaaagttaccagtaataattagatttttcaggacatcaaagttttggggggaaccactagatgttaaaggacttgtacaaaaatgtttgcatgagctttttgataaaatactgtgcccaaatgcaattttagtaatggataaacaaagactatagaggacagacaaaaagtcatggagtcttcataatgaacatttatttgcattcttatcatctgcattttcttgggaatcaattttcatttgtttcatttgggaatattattttataaacacaatatgcagacttctcctcacgttctcctgcaggtctctaggatcaatagaaattgcttcactctttaacacctctgtgtcccgttctaggacagaagcatgtcccaaaagcccagttgtgggcactttgctcccaaaggaagctggaaaaggagaatctgttaaatatattcactcccacaggttcttcaaggtgttctctttagctttttatgttcttttatgtaactttacctgtatgtatctgggattatctagtacatttttggtttaaaatctgatgtatttgcattcttggtgggcctgtagaaaataaaataagatctgatgtataaaatttaacctttatgtcttcagttcaaattccagagaagac

SEQ ID NO: 96654 - DNA, 1050 bp, Homo sapiens
aaaccaggaggccattagtatagttttttacatcattatctttttttgcctttctatattatttggatattcttcctctctttgaacattgggtatgtttgataataccaaagtaaaaataaaacgcaacagcagcaactcccttattcctcaaaattgtgttattgcaattgttacagcctagtacagttttgtgactccataatcatgtgtgtacttaacaaacattaaagtatgttaatgatgtgttctaacaacatcatatctctattaatctgttttctaatatatctgttttctaatataaacatagaaataaataaccaactcaatatcatatatttatataaaatgctaatattcacttttggaaaataccaggccaaagcattgtatcgtgatcgtgaggattaacaagtcaggattactttgcagctttacaagaggataatattttagaggaattgatccttcccataaaatgttcagccttcgggttagtcccttttcttattaatggcaatggctgtctgaaatccaaagttaagtgcccaaagcttttctaaagaaagataaactcacctttaaaaaaaaaaactatattatttttcctacatgcagcatgtggctttaatacctgttcttatggtgctaacatacaaagcatcttaaattttttgattttttgtgctattatcttggtgtctctgatacttatttcagagtgattattctcacctttctatttagaaatatcttaatagtgacatttcttaaaatttgttctaatgatataattaaagatacaaggagtttaaatgaaaatataatcttgcagcactatctgtaatagtgaaacaatgggataatccaaatattcaaaaataagaaattgaataaattattaaaattaatagaatattatccacatgttaaaaatgaaattatagaaaaatatttattgacatgggtaagtgtttacaataaacagtgttaaatgaaaaaaattaaatcaaatataccatatgatcctatttttacaaaaatgta

SEQ ID NO: 96655 - DNA, 1392 bp, Homo sapiens
aaccaattcagctgtcaggctttcatatataaatgcaaaaagtatatgtacagagagggaaaaggggaccaaactcaagaaaatgtcctaggatcaacaatattagaaaaatgttaagggtcttaggtaaacattaaaagctagaaaattcacagtttacagtgcttccgagcatctgaacaccacaggggggccacttaactatttttttggtgcccttgattgagtctacatgttaaaggacaaccttaactgtgaatttgctttctctgcattggacccttaatgttaatccattgtagtttattgggtgattatagtaaagaggtttttggtccaggaggagtatgaaggcattctgtaaatagcgtcctgcccatcctgacatggaaatgtttgtggcctttccctcttattactaatccctcctgcacaaaccctctcacatacttactcattttctatactttgtgatctattaggcactaaccaattttatttgtaagcttgtcaatatctgaatcttttaaaaataagtattagtgggctgggtatgttggttcacacctgtaatcctagcactttaagaggccaaggcagccagatcacttgaccccagttcaagaccaacatggcgaatcctcatctctactaaaaatacaagaaattagccaggtgcggtggcatgcacttgtagtcccagctacttggggggctgaggtggctgcagtgagctgagatcccgccattacactccagcctgggcaacagcatgagaccctatttcaaaaaaaaaaaaagaagaagaagaaaagaaatattagcaaatgtcatatctgaatttgtgacatcctgttttacattggtttggtattgttgtgaattatagattcttatttggaattgttgtgaattatagattcttattgattctacatggagaagccaagggaaacctttgttacacaaggcagaagaaagattattctcttagaatcatgaggaaaaagaattctttaatctagaattgatctttatagcctgttataggttgcaaaattatgagcttagcaaaaattcctgaaaaatttaaaaagtatttaaaatattttcaaattgctctttggaaattacttgtaaaatcttaagtcttgaggcaaaggagtaaaaataagtatattctactcatttgatataaataatttgtcttttgaccttgttctgaaatggtacaggcccaactatatcatacttgaggtgaggcaaaacaagcatgtgcaacagtgtagttttgtggttttacaactatatttacatgtggggcaactcttgttttacataatatggtgtgatgatcaaattgaatatcgacatggaaacaaggtgacgagg

SEQ ID NO: 96656 - DNA, 1230 bp, Homo sapiens
aaaatattccaaagtgaagcatcagttccacaagcatccccttgtatgtttaaaatttgaagattcttctagaaaaacttgccaaacattcttaggataaaaggaaaaaatattgcacatatgaacatgcctcaggtaagtataatctttgaagtttaagaattaaaaaccataacattttaatagaacttcctctaaacattccttcctcttagacattgatttaaaacatatttgcttttaatatttctccttgttcatatgcaattttacacttctaaactaaatgaatagttttaatcttgatttcctactgtcagctttcctgttgtatttctcctcttgttttctatgagttacataaatgaaactgacatcattgctcatacagcaggcatatttttttttgcccccaaatgctgcctttttgctattcagtgtatctggataccagctaatgctaaatgaagtttgacatgtacccctaagaaacaaaacttataaattgtggcttcaaaggaaaccttgaataaataggacacactgtgtccacccaggctaacatccagcatatgttttagcttcctgatgatgagatagagcaaaatagcccccaggaaactttgcaattgtttattgctcacttgcccagcatgtattaaataccaggctttcattctcttataatttgctttttttaaaattaaaatccaccaaagtagatttgatcaggtatagcaagccgagatagtagtcatccatatttgtactctgtatataaaagcttaaagacagtgctaaaaattctccagtagtaggatgtatgtaagttgtttgaacagatagttctagtgggttcatagtaagctatttacctctcccattctgtggttcagttgacccatttaaaaaagattcaggatcaaaggcagaagctattgtatcaaaaatctttgtccactcttctcttgatttactcattcatccaaaaaatatttatggaacctctactatttgccaggcattgtacatatatgccatatattttgccaaatacatggtccctaccaccaccaatgttttacatttgtgtagcagagtgtggttttttaagctttttttttttttttgcagaaattatctttgaactaactttgtatgtatgctgggataggatattatgatctctattttacaggaaggaagaggaatcatagctaaaaatctaca

SEQ ID NO: 96657 - DNA, 1023 bp, Homo sapiens
ttaaggtatattgtatataggaaagtctggataaatgcttgattcttttcatttatttgtactcaaaaataatgagttagcttttttagtatcctccaaatgtaatgagatctttttctgaggggaagcttgtcaacataaactcatgaatttgaagtatttgatagatacatgtcaatccatcagaattattgatgttcatattgcccatctctggccctggggcacttcctgcagttggcccctgagcccttttgataccctgtcagtggtctatgatgatttctgtgctgtttgctatgacaagatactccggtttcatcttgaaactttccttccctagttttggaagcagccatttcttcagtaacacttgactccctcatgtggaaaatggtaactagggaccataatctatttgctatgaaggttcattgctactggttggtcattatttctaggcctttcaatagaaaaaattaggaaaaaaattatgtgaagaagaaaaacatgttgagtttttagatacagttccacttcaaatttagtattacatggtttttatttaacgttatcaatcagacttccaaaacagtttaattttatttttcagtttcgttgttgaatggggacatacggacaaattactgtcttttaaagtgacttaacatatttatttcctataagtgtggttatgtcaccacttaatacaacagataatttcattttgctttagatgattaggaatttatttttttaaactgtgcttctgttttataaattatgtaaataaagtgttttaaagtaaaaaatgtaaacaaagacaattcaaacaaggctagcttctttccttgttctgccctattccctccttctttaaaattaacttaaaaaatttttttaggattttggtatgttcttttaacgtatgtatgcatatgtgtttattatatgtacacttgtttttgctctgcctaccattttgtaggtggtagtagtgccatgcttttttcacctaataga

SEQ ID NO: 96658 - DNA, 1482 bp, Homo sapiens
tatcaggtcacacagacaaattgaaggatggtaaatgcggggtgtcttatttccaggtggaggtggctctcagcagatggatggggagctagaaaggggatggagtgggaatatgaacttcgcctggagtttggccgtcctgtggccgatctcctctctgaccatccacagccaaactcttcttgatgtttaaatgccctttctcttctctcctctgctgtgccactcttctgcttctttgctcttctgcttatctgttatctgctcatctgctcgaggagcctggggtttggggtttataatggtacacgatgcagggatgcagcaggccaaaaggaaatgtttgggtgcaaaaacaggaatgcctgttcccatttagggccatgggtttccaggcttgagggtggggcctttgccagggaactgccttcttctacccagtatttccttgcctcctgtccatatcaaaatgagtatcaatactctgtaagattttcttttgtttacttctgtactctattcttcaatattagatttaatgtattagtcttgggattggaatgactataaaggaagcagcattttgtatagtaagttgaaagaatctgtaggtttatagctttctaagtaagatagtattctcagttgttttttcacatgactagcatttacatttatttatgtatccagtaattatatgaataccatctataagtcagctaatgtgataggtaatggagatgaacagaataacatgaattgctttttcttaaaaaaaaaaaaactctaacagaggatacagacaaggaaaccattgatttatggttgcctgtgagaagttctgtgacaagcatatacctaatatgggtatgtgtgtgagagaatctaggaaagcttccttaagtaagtaatgctttgctaaattttaagaaagggtagtatggccaggtaaagtcagtgggggaggaagatgacagggaacactgtggccaaagcatgcagacccatggaattacaggaagcagttgtgtagagcttgagtgtagggtggtgtagggcctgaatcatggaggacaaggtatgccaggatgaggagtttagtttgaattctctaggcaatgggcatccagtgaatgcaaacagcatttgatacaggtactcagggtgcagaaaactgaatgattaataggagggcattagatgagattttatgctgatgggaaggaatcccaggtgagagagagagagagaaagagagagaaagaaagagaaaaagacctgggaaagagagagagagagaagagagagaaagaaagaaagagagagagagcgagaaagagaaaaagacctgggggggggcggggagagagagagacctaggaaagagaggggggtggggagagagagagagagagagagagaaagaaagacctgggaaagagaaggcatattacatgggccattatccatctgcttgcttta

SEQ ID NO: 96659 - DNA, 1083 bp, Homo sapiens
acttcacaatgtttcgtttatatggggccaaagaccacagatccaccccgattgctaattattgagattgcaaatagcttatttcagaacttagggtgagacaaaggaaacatgaaggaacaaaaggcccaggataatgaaaaggatattgtgaagagaaaggcctgtagaattatgatgcaggtcacatcctgtgcctgcatttaattgtacctttgtatttaataataaaaatgattacatgctcactgctaacaggtgtccctgcttcagaactgtagtatggataggtgacagcaaattactccaattcataaacttggaatattatgcttttattttgagtttcaccagtctatactagaatacattttctgccaaaatgtacatcaacccaggaagatttttaaacttagcccctgataaatatacataaaacataggtgaatattttaaagtataaatgaaagaaaaaatcaactttgccaggcacttaacacattgaggttgtattaataccatagtcacatttctagttctttatattttatataagctttgaatgtaatgtaaattagcagtgatgtaagtggtctttctgttagaacttaattgcctcctttatgaattttctctaattcttgcttaacttgaacactttctgtaactgcctgtccaaaatatagcccctgccctagggatttgttctcctctgtttttccctttattgccattattgcaataacaatgttcttattaatctgtttgattttatctgtcttcctcattagaatgaagttccataggacagagaccaaggtaatcttattctccctaaatcagtggttgcctagtaccttgaccatgcctggctcataatgtgtacccccaaaaatatttgttaaagacattcgttaatctgccacttaccgtcttaatcatataccaaaaaccctgcttgctaccttaactttatcactagcctcctccctttgcttatgttttcaccaaagattttgtggttgaagacattctatttccattgtctgttgggtagctaggtagagagataatagtccccct

SEQ ID NO: 96660 - DNA, 1066 bp, Homo sapiens
gaatactgagaaatgctctatggaagataaagctcttgattttgaatattagatagagcacatacacataaaaatactcataaaaattgttcatcaacaccagttggggtgtcaaatattctaaagttttgaattgcttcactttcatgcttacgatttgtctgtattaggaaaagcctgacatatacatatgttccaacactgagagaataattacttatttcttaactttcagataattgatgtcagctctgtaggaaagggatattttcactatttttatggtacacgaaatgcacttgctgaagcggcaggtagatgcctggctgagaatgaccgtgtattttaaattgtgccctgtcaagctgcccagccatcatgcatatcctgggtgacagggacagatgtgacatatctgttgtgacacacttttgtaccaccagtctgtggctcgaggtgactcctctccctcccctgatgctttccccgctgcaggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacaggtatgccaggtatctgggagggaggtatttcttagtatcttgcctagcttatataatgactgaattataatttttctgtcacttctctttcatttatgccacgcttcagagtcatattaattatattcgttattgtcagcaatgactggtttaacgtgaaaatttcccttgtaggacttggcaatttttcccctttgtattatagttgtaataatgataatgataataataaaatgcccaccaaattcccacagctatgaatggattcctttttctttacaaaaacatgttattaataaaattaaataaatgtgccaagtttcaaagtatcatttgggtgacacaggcattgttacacgttgttaaagtgaatctttaactttatttagattttcattattgccct

SEQ ID NO: 96661 - DNA, 1042 bp, Homo sapiens
ttcccaacattcaactgatataattctcaggctaaaaagctgaatcctaagatgtcaagcaaagtaaattaaagttcttaacacattatgaaccctttgtgactcggaatcttttcttaactcttttttatttttgactatcaactccaggagtattaaaaatggtatcaatatagataatgttttacatagtgttcctggatgaatgaaaaacttgaatgtttcagtttcagacaatacaatttcatagatgtgcttttctgcctgttataacagaaaaggtaaggcatttgccacagattatttgcatatgcctcaaatttactcgcaaagcctaattttccatcaaataactttaaaattagtcagagagcttcaagagttggaaccaaattcctgatcagtgtggctacctaaggaatttcacagacactagagggactgtggggtgaccacaatgacgttgtaagcgggtttgctaacttttatttttatctcagagggtgatgtgaactctaatggaaaatagtggtaatttcctagttaggtttttggtaacgattaaaacactttttacaacttgttttgaggttttatatgactggtaaaattgtgtaaagcaggaattaatccccattccacagaagccatccagattaaatctatttaagagaatgcacacatcagagggggcagagctagagatggaatcccagcattgagatcctgtattgtctccagttagtaagactgagaaggcttaggctttcctcgccagttaattatgttggtatttcagttacagtgtttggattatgggtttgattaaacatcctgtagaggtgatgggtatctactctttcagattatagttatgtcaagagtgtagcctttaagaatctatagtaaaatatgccagattaacttgagttgaatttatttttagcagaaacctattattcattttagatcaagatggagaaattatctgtcatccaacatagcttgttttgcttatacttggtaaggcatggttttgttt

SEQ ID NO: 96662 - DNA, 1059 bp, Homo sapiens
ttactatagcaggtatgagatactaccttgttattttcttttcttttttttttttttttgttatagggacagggtctcaccatgttgcccaggagggtcttgaactcctggactaaggtgattctcccacctcagcctcccaaagtgttgggattacaggcatgagccactacacctggccttctgtcttgtaatttggatgtgctttagatataagtttgacttaaattgtcctgccagaatctcttttaactttattgaacaagcattttttttattctgaattaagttttacacaatcccatgtttgttacaaacaacaggaaaattttgttattggtaagttgataaatggttaattataagaaaaataaggggtggcaacctgatgaattgtctatcaatttctttataggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtgagtgtgcattgccacatcatcttactctttacctaatctctcactgctgccagtgacagaactggcagcaatcaggtctccctgattgagatttccttttgctgaatacatttctgccagtctgttatggaaggaaaaaaagatgatcttgctttgctttacttgcccaacaagcaatgtacactttatgaaatgtattttattaaaaagtggagtttatttggtttgtttctagtgtatagggcatcccaaattctgtctcaggcatgaagaaggctgttcttcagaagtggtatcaggagcaaaatgaagctgaagcttcatcagtcattgatgcagtgatacatgtgtaagagagttagtgctggcctaagcattcgaagcccaagtggtttccttccacaaaatcaaaatataatactctccgagagctattagttacaggctgtaagaaaactgacaaga

SEQ ID NO: 96663 - DNA, 1153 bp, Homo sapiens
aacatttacttgttgattgaattcaggattcctatattctggttactctaagacaaaaaactatacagactaaagaggtgagatcataactttttgacactcgtccttttcctagtcagctatgtaaattaaaatccacattatgtataagcatagagaggtaagtgatgactgtggatggttaatgagaagtgatgcaatttgcatgtttatgccaggttctattcaggaaaaaggcattaactcttgtccaatttttgccattttccaaacctcctttggcaggcagatggaaaacttgtgtgatgccactatttgtctcatgcctgctggaggaccagagagtataaagaaaaatattacctttgtgaagcacacatttattttttttaagtgaagctttatttctcattttctaaagaagagtctcaactaataatttttctttaattcaaactcaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggtattatatagaagtctttaaaaccacaattcctattgtaaacgcggaatggcttaatttgttagtagaagctagcgtagtttttgatgataaccttagatttcttaccagtttttctttgtgtgtgtttaatattgttaggccttaggaaaatggaaagatattccatttaaatttagttgtttatggaaaatctcttgtagaaaatgctcataaatttgtggtcataattcctgaaaaagaaagataataatgattgtagtatggaaccttttctggttttcattgaaaacactcttggaacataatcagtgaaatgcaaactcctgctagtgtgcctttggtaagaaatgtggtttttctgcctgagcactaaatgcttatcatttgtgtcatttgagattttatatttatattccaaattttaaaagctggtgatgctcagatgcatacacacacacacgcacaacacatacatacatacatatacacgcacacaaacacacatacagggttaggctaagtagatcttt

SEQ ID NO: 96664 - DNA, 1026 bp, Homo sapiens
taaaaatattagatgtttttctcatctagggttttctacaagtaatatttttgttataatttttaaaagatttagtaacattagtgaaagcatatttataattttttttcttttttctttctttttttttttttttgagacagagtctcactctgttgcccaggatggtgtgcagtgttgcacgatctcggctcactgtaacctcctcctcctgggttcaagcggttctcctgcctcagcctccagagtagctgggactacaagtgcgcaccaccatgcccggctaatttttaaaatattttttgcagagatggggtttctccatgttggccaggctggtctcgaactcctgacctcaactaatctgcctgccttggcctcccaaagtgctgggattacaggcatgagcctccttgcccagccaaagcatatgcataatttttaatcaaactgtattattctatgcttttcttttacttagagtatcaatgtccaaatggatgaaaatacactccatgaaattctaaatgaagttgatttgaataaaaatggacaggttgaactcaatgaatttttgcaggtgagttgtggtgaaaggaaacaaggatatttgcttttatcttttgtttgtcatgatcataaatgcatgttcaagaatggatatttaagtccacacaattgtcagattattctgaagaagaagaaagctcgaagccagcagaggttgatatgtctgccctcaagtgtaaggctctactgtggtgcatattcttttcctttttttgtataagaaacattccattatgttgggcaatttagattaaatccaagttatttatcataaagggttgaatatgaagcatgctttttaaagacgtatgccatggcatatcaatgctggacctttttcttttgcttacttttctttttcttttcctgtacttcataagaggcaacacaagatttctaatcttttatgtagaaaatttttaaaaagtatggttctattcactaatgaatcatatt

SEQ ID NO: 96665 - DNA, 3437 bp, Homo sapiens
gtagacaaatataggtcatggtttgtctttgttcaatccctgagattcctttttaagattttaaatggaattaaagatccaatatttgaagttgctaaaaaaaaaaaaaaaagtgccttgagcacattaaaggacaaaaaatgatgcattaagatttgcttttagaggcagggtgatttactagatggatgtagtttttgtggcagtgttgaaatacctgcctcttcccctcttttggaaacgtttaaaaattagactcttcttatctgagctgtagtacttgttaaggtttttgatggagcacttaattacctctgtctgctgcaattctaacgattatgatgccatgaagaagagagtaagttggcctgcgttctgaatctgttgcatattttctctttaagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacagagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaaccttt

SEQ ID NO: 96666 - DNA, 1048 bp, Homo sapiens
tattatttaaatccaatttaggcatatctgattttgctttaaaagctatcttattgtttgtctaagtgatctaaacgtaatgacctcaatcaacatatcactattctttaacctgaccttaatgccctcttaaacagaggcttccctctctgctacctcctgcctccaaagattcaaagtaaatagtcacgtcttcccttttaatttcttgcttagatttttctcacctttgcttcaatatcattttttgtttttcatctccatcattaattgatttacagttcatttttctgcatacagagtttttcctatccaagttgagaagctgtaaatcttagatccattgaaatgacagtgagaaatatttcattttatcccatgaatcatttgccatccttattgcagacaaatggcaaaattatggtgtaccatgttttcataaattactctgccgcccccccacccccattcccagttcatttcattatctgtttggaaagactataagagtcagaacccagacacttgcggtaaacaattctgattttacagcaggctaatcaaaatttcataacattaaaattaattcctctggtactgtgaagaatttaattcatgtacaaaatatatcatctattttataagtcaaaaatagcttgatattaaagtacattctgtgatttgctagtatagcaaaggggaagagtgccaaattctttaaataatgtatataattttcataggatttcatatgtcaaagtagtcatttatggcctgaaaagtatgtgcttcgcactatgtgtttgaacactattaaaaaatcatggcttcttccaaaaaggacaaatcttaggttttcatttcacatgtgacctagaatgaaataacttatatggggaccaccctgaacccccattaggaatacccccaaaagtaaaaacctgaaaatatttctaaagctaaatatttttaaaaagcaataaatgaaatcagtttttataatgttataatgttactaaagagatttggctattttccttaatctctg

SEQ ID NO: 96667 - DNA, 1040 bp, Homo sapiens
tctttgtattttgcaaatatgtcaagatttttccatcctccagggctttggcttgccgttctgtctaccagcttcattgtttcccttgctttcttcatgactggctttctctcatcattcaggacacagatcaaatgtcacatcttcagagaggctttctctgaccaccccatctacaatgggtcctccccatgtagcacttaccactagcttaagaatattttgtgcatttatgtttaaattgcttgtcgctttctctttcctaatcctagaaattatgatctgtgagaacaggaccttttcttgttcacctgtgtatcttctgtgcccataatagcatttgacactcagaaagcactcaatacatatttaatgaataattttgttaggcccaggcttgtggtcatggcactcacggaagacctaactttcccacttttctgtaaacacacttgacacaatgagaaactggaatctgagtgtgctaactttgctcagctagcccaggcttaaatgcctttgttaaacttgtatagcaggaaggcaaattaggtctagaatctagagctcatatccgtttataacagtcaaataacagcattgtgaaggtgaaactatttgggggatttgactgaaaaacatgaaagtttttttgtttttaatcattttaagcataattgggtactttttcagaattcttttggttgttttcattgaagtatacggtattaagcaatagagaagtatatgcagtataccgtatatgcaatacggagttattgcatacggtaaaatcacaaagtctacaggtcagtaaatttgtatagacaaataatgccctatgtagccattgtagatcaagagatagaacattcccatcatcctttcctcattcctcttctatgtcaatacccacctcccagaggtagttgctattctgatttctgtcactgcagattacattgtcctgttcttgagcttcctataagtagaatcataagtacctactgtttgagtctgtcttctttcacttaacccaa

SEQ ID NO: 96668 - DNA, 1015 bp, Homo sapiens
ctggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtcaaacagtgaaattgtttttcaaaatataaaaaagatctgtgtaacattatgcattttcttatgggagcaatagaagcacaaaactaatttgtaaattgaatttgctttttaaatctactcatgaacttatgtaagacatcataaggatgtcttacagcttgaatttggtataagaaaatttgtttcttcctttggctgtgatttttttgtttttttgtgtttttttttcagtcagtttctccagctgtaaggtgagggtaacaaatctctctgacctgcctttctcacaggggggtgttgtgagtgtaaacgggaaggaggatgttaaagcattttgttgagtgaaaggttccacgtgagtgtaaagtggtcttatgcatccgcccttgctgcttgggagagtccgttctcggttttttcactgcttgtacacaagatta

SEQ ID NO: 96669 - DNA, 1087 bp, Homo sapiens
taattgaatgatggttaaaatgtctgggccattggccaggcattaggaagtgttttagttttaatacttcgtgagttgtgagactgtgtggtcaggatcaggagctacttgttaggatattggttatgctaataataagtaagcagtgatccttacaactaattcccccttttccctccaactccaggaaaatccttccctggaacacagaatttccacttggaggttggcctcattattctctctgtagtgttcgcagtatgtcttttagcctgcctgctgggagttgctctccgaaaatttaaaaggcgcaaccaagaacgcctcaatccccgagacgtggagtatggcactatcgaagggctcatcaccaccaatgttggagacagcactttagcagtaagtcatgaccccacaggaaatcccaagcataaggaaggtgtctggagacacgttcttatttcgagcatgaaacgctaaccagtaatgagtgactgaacagtgtacacacatgctgttggttacttatgtcctaaacaagcacatgctggcacctgtgtagtcttcccatatcagaacagccattttagatagacatttaaataagggatgggatttattttagtagtgttggtagttagttacttttctctgaggggtaaagcaaaagagacagagaatggttgcctacagttttggagggttggaatttgtggtcttcagttactctatttttagccataaaagtgctcctttaaaaaggcaccttttgctgaatattaaatattaatttcctttctagattatttcagcatcctgtaatttaaggcttaaaaacttgacatccaaaaaagcagcttttaaattttgtatgctcctgtggtgccctcttgtggagtgcagtcatttggttaaaccggtgttgtccaatagaaacatgtgcatcacatgtaatttaaaattttcaagtagccaccttaaaaacaaacacatgaaaaaacccaaaaagtttcgtaaaagtagatttaattttaacagatattcaaccaaatacataccatctttgtcatttcaacgtataatcgat

SEQ ID NO: 96670 - DNA, 1146 bp, Homo sapiens
gaagagattaacaacaatagcaaagtaaaatagaacaattataacaataggctggcatcaccactcttgtgctttggggcagttattaagtaaaggaagggttccttgaacgcacctgcaataccatggcagtggatctggtaaccaagacatctgctcagtgactagcaggatggtagcatctacagtgtgggtacgctggacaaatggatgattcatgtcctgggcaggatggagctggacaacgtgagattccatcatgctactcaaacagcatataacttagaacttaggaaatgttcatttctggaattttttgcttaatatttttggactgtggttgatggtaggtaaccgaaatagtggaaagtgaaacggtgcataaggggggataagtggggactactgtagtctggaagttactttgttcactctgtgcttttctgtggggcaggataggttgtggagctagggaaggggagtttaactaagtcaggacattttcacctttagctgtgggtgtcacagtgcctaaaggctgcatttcaagacttgttaaacaaattggagccctgcttaacttttgaagggtttgtctctgtagtttgaaagcttccagaaaggctgtaggggtgtggtggaggctcgctgatggtaaccacagctaagattggcaaccttggaggaggcccagtccatgaatcccagagagagaggtagagtaggaggcaagaagagaaattgaagtggagagctaagcacaaaagccacctgctggctttttctccactgttctatctcatctagagcccattgttaaatgtttcctgtaaaaccaaaattctcagtgtagagcccaggtaggaaacccttactgaaatgccatacactctctggttagcccgaggaggtgggggaaacaacgaaaagtgattcctcagaatcaaccattcttcctgtggcgcgaacagagcttccagcctgagacattcaatcgatggaaccacattcctggctctctcctaagactaaacaaggaatgacttctgaagtgtttacaattcactgggactttcttccctgttcctccagattattctactctctgttactctccctataactagagctccacttagacatggc

SEQ ID NO: 96671 - DNA, 1032 bp, Homo sapiens
gactacatgccgagtgcccggcacacagtgagccctagagcgtgagaggccagaatgtggaggtattcattgttttatccctagtgtctaagacattacctggtgtgcagttggtgctcaataaatatttgacaaatgaataaataatgttggctagaataataattatggtattagagaaaagataataagagacagtgggactgatctgggctgatcacatgcactctttcaaataatttattatgagtttgggaaaagtgaatcagttataagacaaacttatgttcttttagtcaatttaaacaggagtaccagttgacaacactggtaggcattggtgacgtaaacataagcaagaagtggttcctgcttcaagaagtcatagtccagttggatacagcaaaggtcacagcatagcatgaggcgtatggacaggaaaggcctgcattccacatggagctgggtttggggctggtgatgcagggaagctaagttttgaaggataagtagccattagaccagccgaggagggactaagaaggacattgcaggcaggggaagggtgaagtccagagacgtgagatcatgagatcatgagcggtcaccatgtcatgagacggaattaaggttgagagttgagccctgcaggcatggcagagccttatgctaaggtgtttgtcttctatcctgaaggcaatggagaactgtggagagattaagtaggtgcagtttgtgttttgaaagagtggtgtgtggtgaaagtggatcatagagtgtggcaagatgagaagtaaagggatgggaaaaactaatcctcctgcagtttagggacaggcaggcacacatactccattttcaaaggcatcccaactgtagcaactaaatggtggcaaacaaaacaaaaacaaagccttagtgcgaacgtagaactgttacaggtggctcacaaatgatattaacagtgacaaaacaacaataatctaataataatgctattgctagttttattatgaaagcagaagccagagc

SEQ ID NO: 96672 - DNA, 1022 bp, Homo sapiens
gggaatattgctcctttggaaatatttcaaagctgagacgacccacattttattaaatttgtaagccacagttagattttattatagccaggaaggccagacttatgcagaattttttcgcaagagatttcggcctgttctagagaagactgctaggtactaaattattttctgagttatcttgattttagtatttacaaagccatcactactcagactttccagccccactacccaatgatggaaggaaggagataacttcaatggactttttgttagggttacaaaggtgcccctctttgctgctggggggaagaatagaataagcctttctttgattttctcattattagggattcaggaagttcttgaaggggtgaatgaatggaagagaaatgtcttagtattacatttgtttcttcttcttcttagtattacatttgtatctcttgttcagaataaaatctttttctttggcatatcatcaaacggaagatgtttttagggaaagggatgacatactaaggcatttgctactactgggacctagaatgtaaatatctgatgaagcatcatacttttaagacactgcttctttattatcaagttttcttattttacaaaatgatcctatactagttgatgcaaggtgagctgtgacaaagcatccttttagcctttccttcctgggaagtgtttgtttcagccatgagtagttaaactagtgccacattcttttctttcttgttttttttttagtggacagtataagaggggtatggatagcagtagggtgtgggaggatgctaaaaattcattcaaagaaagtcaaatattgaacagatgagaaaacaaattcaacacctaagctcatgaaatgatttccttgtggtcaacagtgtgcagtgcagtcacttctaagtgttctcttttataaagacaggtctccagagtgagaggatgaatgccatctcctctttatggaaaaacttgtaaagcagaaggtttgtaggcatgtcata

SEQ ID NO: 96673 - DNA, 1392 bp, Homo sapiens
ctgggactacaggcccacaccaacacgcttggccaattttctttattttttgtagagatggggtctcactgtgttgcccatgctggtcttgagatcctgggctcaagtgatcctcctgcctcagcctcccaaagtgctgggattacaagcatgaaccactgtgcctgactgcattttatttttaataacagatcaaattcataattttctactctatcggctttctacctttgtgttcttgggcgcatcacctatttttaagatttcattctttctccctacttcatagagtgcatttatttttacttttaacattgttttcttatttaggtcagtgagtgtttctggtcgagtgggtggttttttggttatatccgttctccagtctctctccacccggtatccatccagaacctctccctgcctcctctccctgtctcctccttgttttctgttgtggttacttggatgctaacccattcaacttgtgcactgaccctggtacatggctcgttttctttctcatgatcatatttatacttttgatggatatatttaaatgaacagctgtgtgtttgttgagtcataccacaattatctgattctgctttagctgcttgactggcaaaagcatatttcaagctaaattgtgagagaattccattaatcacattctattcgggggaggggagaggagacagaccactaagagaattcttttccaaggttaatgttaattagtgattccattatttagagtaggttgatctggttgctatttaatgtgtgacttggagaaactttacaaagtttaaataactgtaaaaataactatgaaaggtttaatgataacagccgtgtaggcaaaattccttggaataaattgatgtgcagataaagttagttgctgctgctggtctatttaaatagataaggggtctttcaagagttcctttttgtaaagaccagggttcttgcctcacattgctgtaattcattggctaagtattttgtttgaagcctcctgaaaagataacatctaattcagaaatgttactactttctgtttttttttttttttttaaatgtattactgactgttacctctggtcaagtctttggcttccatcagccggatctatttttctcctgacacttccttggggttctctctgaaggttattaataggcatggaagcatggctttccaaatagcgtcaataaatgttagaagccttcaggggagataatatgtcaatttctgacttgtaggagatgtatattcaagagacagacgctgtctcagaggtcattagggatggctctgggcctatcagctggtgtctgcaactagagatccaagcaatcccttccaactgggatattgtccac

SEQ ID NO: 96674 - DNA, 1052 bp, Homo sapiens
caatttttcttttacacacatggtaacagtatccacggttttatacgttttcttattgaaataatatttcttggaagttcttccatagtagcgctgcattctttttatttatttatttttttgagacggagtcttgctctgttgcccaggctggagtgcagtggcgccatcttggctcactgcaagctctgcctcctgggttcacgacattctcctgcctcagcctcccaattagctgggactacctacaggtgcccgccaccacgccctgctaattttttgtattttcagtagagacagggtttcaccgtgttagccaggatggtcacgatctcctgacctcaggtggtccacccacctcggcctcccaaagtgctgggattacaggtgtgacccaccgtgtcgggcgcattcatttttagtaaatacctggtattccattgtagagatgtgctgtcatttacttaacaatattgatgggtatatagatcatttccagtttttattatcgtgaacaaagctatagggaataactttgaatatacatcatttcaaacgtgtgagtgtatctatgggatccatttctagtagaattgctgggtcaaaggttatacacattataattttggtagaaatttattgccaagttgctctgtttatagaccttgacagattttagatttaacaacgatgggtgagaacagttttctcatgcccttgcctgtcaagtatgactcccaagtgattattttatttatttgccaaagcaataggtaaaaaatggcagtttaatgtgctttaatttgcatttttcttagtttgattgagattgagcatcttttcataagtttaaaagccacttttatttctagttatctttctatgcttgtgttcgttgtctattttgctgtttggttatgatttttattatcaaaatatgacatcaaaattattggtcccccctttttatccttgtgatatgtgctatttatatttttctccgttggccatttgtatagaaataattattactttgttgtgcaggttattac

SEQ ID NO: 96675 - DNA, 1032 bp, Homo sapiens
gtattcttgatagatgcttgtctgcgtccatattgatgaagaacagtagagtatattaaattaaagggttgttggctggttgtttggcagtgacttgctttctgttttctgttcactagaggatgcttggaggatgtaatctgcatactggttatcaatgtgaaggtttccctttgttctgtcagtaaaccctactggttaacagatccttgttttcaaccactggttttcagccctactgtggggcagagctacactgcagtgcattgtgagtattgctaagtaatttattattcattattgaggtaaagaaattttgacatacgttggagctgattcagcacaatactctcccatgtgttccattatgtctttcagagtgagaaaaaaatggaactcaaagacaagtcaaagaactgtatgttttagttagtaaaatatactattaagaaaaagaaaaagtgttaaggaaagaaatgagtatcacaaaagtcagcattatggttataagagcatcaataatattaataacttaccctttaatggtgcttatatcatgttctgttgtgagtgctttacatatattaactcatttaattcttaggataattctgtgaggcaggtataatttttaattgaaatttttcagatgaagggaatgaggcacattaagttagctcctgaggccttaaagatagcgcatggcaggaccgcagttctaactggctcagttctgggttttaaccacagtgtaggggaggaagggggcatagtggttgaggacacatgggatgtggtgggatgtggagtgctggcagtttcctaaaaaggaaacatcaggacccttactaaaggttttagttgcatttttagtctatatggattgttttagtccatttgggctactgtgacaaaattccagaggctgtgtagcttataaagacccgacgtttattttacacagttctggaggctgggcagctcaagatcaaagcactggcagattcagtgtctggcgagggcttcttaggt

SEQ ID NO: 96676 - DNA, 1002 bp, Homo sapiens
tttgtatttttaatagagacagggttttgccatgttgaccaggctagtctcaaactccagacttcaagtgatctgcccacctcagcctcctaaagtgctgggattacaggcatgagccaccgcacccggccttctcattttaatttttctgaagcatctagtgattacttgttcctttctgacttcattctttgctgacctcttttctccaagttttggaattttctgaggttgcttttcttctctttttcaatcgcatcttttaagattctctatgcttgcattgtccagtaaggtagctactagccacagtcaacatagaaatgttactggtttaaagaatctgctgatttcaagttgaaagccagaacaggaaacactgacacctgggtaggaggttaaggttgactattccaggaatggagagaggagcaggaaagtggccacaatttaactagttacacttgcttgttggctgttgccaggttatccgtgtatgttcctggcccctgtctcctgctaacaatgagtcattattgcaaataaagtaaatattaataaatctatgtgtagaatatttttaataaaagcctatgtgtagtgtgccaaaagataatgaggtttggaagcaaagtaagttcttaaattgacagtttcgatgcgtgattctgtgtagtactgctaaacttgctagcttattcaaatactatacaataatgtttgtaggcatttcctagtgtttggatattttctgtaagctacagttttgatatatactactatacttcacattttttattaaacagtttaaaaagtttataatagtgaatgaacactattggaagtatttaaaaaataatttataatttcagaaattccaattttttccctgcaaattttgaagattgatattgatagagagtttgaaacaatagtacatagtgcttgtccaacgaactgtttgtttcttttgataatgtgataggtacagaaattaagata

SEQ ID NO: 96677 - DNA, 1052 bp, Homo sapiens
tgtgtggaagataggtatgaaatgttaggaagaaaaaaatgcttcttttttttttttttttttactcctttagggtctgattgattcatgcttttttatttgttgaaattttttgaatactaactatgtgctaggctctgtgttgattatgtgttggtgacactgagaccaaaggtgctattcctggcttcaagagaattcatggcttagtaaaaggaacacgtaaatcagtgattacagtacagcttggcaaatgcgggtgtgcacaatgtacagcagtgacccagagggggaaacttaacctgcgttagggagaaggatgtagggaagcttctgaccctggaagatattaagtgaggacttgaagaataagtagaagttagcctggtaatgtagaggaagggcattttagcatagggaaacttcattgtaaagatagaaggcataagaagagcatagtaccagctgggaatgcaggtagtttagttgaactgtagcttagggtgcctgtgggaattgatgtgacataaggctggagaggtgggtaatggctatgtcatgaagactacttattgcttcctaaacaattcaggtcttatcctgaaatatgctagctattggattttagggaggaaaaggatcagattagatttggattttggaacggttatgagcagcagctttaagaaggttctttttcaatggtgtctattcatctgagctttagactgaattttgtccttcccaattgatgtgctgaaaccctgaccctcagtgtgatgctatttggagatgaggtctttgggaggtaattagctttaggtgaggtcatgaaggcgggaccttcctgatgggattagtcagcttgtaagaagagatatcagagaacttgctatctctttccacatgaggacacagcaagaaggctgcccctgttagccaggaagaggaccctcactagaacctgacactaggcatcctgatcttggacttctagcctctagaactgtgggaaagtaaatttctgtttaagccacccaatctatgatgtt

SEQ ID NO: 96678 - DNA, 1049 bp, Homo sapiens
aaaagatagttgcagattttttttttttttttgagatggagtctcgcactgtcacctgggctggagtgccgtggcgcgatctcggctcactgcaacttccaccttgggttgaagcgattctcctgcctcagcctcccgagtagctgggattacaggcactcaccaccatgcccagctatttttttttttcatttttagtagagatggggtttcaccatgttggccaggctggtcttgaagtcctgacctcgtgattcacccacctcggcctcccagagtgctgggattacaggcgctagccaccgtgcctggcagttgcacatatttttaatcactagtctcagactatgtgtcctgggatgcagcttctcagggtggcatgcgagaccttagacaaccgaaaggaacagcacattcacagttaaaagtgctttgtgatgtgacttgactctgtagagcacatcaagatgagcaccataggagcaagcttagaaagggagatttagaggcacattatggcttactttgaatgacaggctggaagttaaggcatgaaagcaggccttggtctggcccctttcattatctcatttaatgctcactcacactccatgaagtacctgctctaatgcccattttatagaaggagaaactgaggcatagagaggtgatatgaatgtctaaggttacacatctgaactttaactcaggctgtaaattcccacatcaccatcagtgcaccagagcagaggttgaaaactggtggtctctgagctcagtatacctcagagttctgtcctgtttgatactgtatttaaaacattaaaaaaaaaaaaacatggttgctaacatgtaaaaatgggggacattttcataaaaaaaaaatcgaaatgtccagctgctcctgcaacactgaaaactctggcagccccagggccatattccttcctgcaagaaactgccagatcttttgaccatgtctgtctgagggagatgtgtgtgctgtggctgctactgtctcagttcatcctgttttctcccagacactg

SEQ ID NO: 96679 - DNA, 1017 bp, Homo sapiens
gaggtgggttgctggccaggggcccaggcttgggcagccagcagacactagacttgtgctgacctcagacatcggcctcgccatgcagcttcatagtgtgcagactgcttaagtttgaaatatgggcctcatccatttcactgatggggacataggggtcaggaggttatcttatgcctggatgggacctcgatcacttattttatgattcacttgtttttattttctgtcttggaattttaaaaaatggaattcttttgaagctgaaatctaggccttaagttgatgtaactgggtgttggataatagcatttctgctattaccccttatgcaggtactcacaggtggtgaatgatggatagataaattctggataggtgacaaagactaaggattgggatgattatagattgggttcatgccctccttttccagctgtgttgttgagttttacttgaaatggagagggtggttttaaataaaacttgatttagatagtagtcttacaacttttgtaccttggaagagagtgatcatttgaattctagcaagtttgttgttatctgtgaggaatttaaaggaatattaaggattcagagtaaagatgccatattcaggaatgtaatgtattaatttcagaagtgaggaacttaatttgattaatagatttgtaacgaatttttttcaaagtagtgatttgccagttttcttcatgtgtccaaggaaggtataacagagattgagtcaggagatagaggttatgcctctatcttgccctagattggactgaactagtcccatgattgtcatgataggcttctaggtaattctcaggcttggattgagtagtccagtcttctgagggaggggggacaggacagaaatggatttgaaaaatgattctgctcttcaaggtcatgaggtgaagatggaatcaatgctggggctgggagctgtagtctgtggcttgttctgctcttggatctctgcatcttgatttatttttatgtgaagcg

SEQ ID NO: 96680 - DNA, 1057 bp, Homo sapiens
tctgcccgccctcctccccttcctcctcctcttcaccccgcctccccgccctcccccggctctttcccccgggtggctgccgctgccgccgctgccgctgccagcctgctcctcggccagccgcgccggccccagggccgggaagctcccggccccacgcaccgctccgctgcagccaccgcagccgccgccgctctgggccggccctcggcccccggctcccggccccgcagagttccgggctccctcgccggctgcaccgccccgccccgccccgcgccgccccgcgccgcgccgacctgcagcgcccggctgcctcgcactccgcctcccccggctcagcccccggccgcggcgggacccgaggtgagcgcaggtcgccggccgcgcctgctggagccgggaggactgagggaggaggtagcctagcgggagaagaggcagggatcgggggtggcagggtgggcgtctgcggtgcctccccctcgctttcattcctttctcccccaagcttgatcccctctccgtgggggaagcagccgcggaacaaaactgtcttgctttgggcctgaactgctggtgggatatggggggtgggggggcagaggcgtggagcgggggtctcaggtttgtattggggtgtgtgtgagtgcgtgtgtgtgtgtgtgtgtgttgtgaactccttcagggtgtgcgactctgacttgtaaatcgatctggccgcggggccacggggcttaccttcctagctgagcttgtagagagtaaggagatagataggcgaatttcccccaccctcaaaatatccatctcttccaagaggaattttctgctggagagacagccaataaactctgctcaactccctccctccctcggttcttcctagctgcagtttcaaaaagcttcaaagccaggaatgtgggattcatcttccgatccccagaaggcaaatgtggttacagatgttgcacggtactttgccaagtttaaaacccttccttcaacactgtaaccaaaacagtgaggctagaacctcgggcgcactaagaagaga

SEQ ID NO: 96681 - DNA, 1061 bp, Homo sapiens
ggaagagaaggaaataaaaaatcactttcaaacaaaaataagttggtaaacaacttctgataaatatggaaaaaattacaataattttagaaattttatgattaagaattgttttggctacaataacaaatcatctctacctttaaaaaatattttactaaattaaagggcatatcccacatgctctgcacaagacaaaggcaaaattttgctaaaaataatgaatagccccctcccattcttttctcagtccctgcctgtgaagttgcacctcagattgcaaacattaaatgaactgtaaggcctttctgtctgaagacattaaagacacatgcttctatacaatgtagattttttttaatggaggcttttcataacagcacaaagtaagatttattgaaacacattaaataatcactgtaagacatggtaaaaaaaaaaaaagaatcaatggttaaacaaatctgatatttgctagcatgaatgtgggagatgaaaacatggagtgagcaggcaaatcactatgtaggccctactttcaatgtttgaaatgattgaaggaataaactacataaggtctagagtgttcatagttcctgggattttagttctgtatggtactaaaaatacacaagtattgtgccgggtggcacctaatcttcctaattttcttatatattgataagattctggcaagcaaatagatttaaacaagacataactcaatactgcatgatttcgggaaaggtcagttggtacaaacgacaggcacattttaaatgctaacagcaagaatcttttgccaagtgtccaaataggttgactgtaacccaaacacagaggttgccaaatctgtctagcttgtggcctggtaaaactgcctttcagtactcctatggaagtttcattagacttactcaaagccaacatgttggctaataagtataacaaatcaggtcctatctcaagttccacttccaaggcaatagcatcagggaccccagttttattaactgcaacagttgtatctatgaccactggagtctttgaagtgcagccac

SEQ ID NO: 96682 - DNA, 1054 bp, Homo sapiens
ctcgatctcctgacttcgtgatttgcccatctcggcctcccaaatgcagtgtttttgtttacagcttggcttccaggaaactcagagctcaatctaagtgtttaaattaagtattgtactcctgggtggcctctttaatactgagaacttctagccagacacagtggctcatgcctgtaattccagcattttgggagggtgaggcacgaggattgcttgaaccctaggagttcaagacagcctgagcaacaaagtgagacctcgactttgcaaaaacaacaacaaccacaacaataaaaacccatacacacacaaattcgtggttgtatgaacctgtggtcccagctactctggaggctgaggtgggaagatggctttagcccaagaggtggaggctgcagtgagctgtggtcataccactgtgttccaatctgagttacagacagagaccttgtctcaaaaaaaaaacaaacaaaaaaaaaccttcctatctatttccttaaataaatgcctcctatttttttttttacctctgtttaaattatattattatgcattcctctttcattgaaagctgccacaaatgcttttttaaatagaggcagtacaggtcatctttcgatagatgaatatattacttttttgcaccttatggaatagtggagagagtggtgatcaggagacaggagatgtctattctaattcatctctgttttagtctgtttcctcaggcaggtcaattacactctctagacctcatttcatcctctgagcaaggagcaggttagatctcaaaggcttcttgcaagtccacatcctcagcttacatgcctcacatgatttggttcgttcaaaaacctgctgtcttctccaggaggtccagatgtaatctcgaggacttgagcttctgccagatgtgggaccgttaaccagagatgctacaggataggtagacgatggagccttgtgtacttactggaggtgggggtgagaggctcaccaggggaatccagatagcctccctggggtcatagcaggggagaggagggccaca

SEQ ID NO: 96683 - DNA, 1076 bp, Homo sapiens
agaacagataatttctccaatgtaggtccatatgtaggcattgatggctagaagctggggtagggagggtctcagatggacccaggaccagcatggagtgaattgatcccagcgagacaagcagagactgtagcacatgcagaactatcaaagtgagctcaggagtaaccagcaggttatgggacatgcacaattatcaggggcttgtggcaggaaccaaaaaagtgtggatgagcagatgggggatgggatgctggaaagagaataacataatagtcagaggagttcaagcacatgggaccattcaaaataaaaaatcaagtgaactgtggaccaggcatttcaatatattacctgcacagggcagaaataacaaagcataaagcaatatccaaggggctggtcactataacaattttctatctcgttgttgctgggttttctatagttcccatgcaatggacaccattcccaggaaggtagtggtttccaaactttagagagcaaaaatatcacctgatgggtaatatgaaaatgcaaattccagaaccctacctccagagagcctagggcaggcccaggaatcctcattttaaaaataggcatccttgattccagtgcagttggtctactcaccgctttctgagaaatacaacagtataattaatccagggcccctgctggtgagacaggtctagaaacaccctgttaaagaggcacagagtttcagtagttccatctggtgagcaaatgctgacgcctgtgaaaggcaaattcatggcccaactgtgacaattaacttgttacaattgcttggaaatatctactccttttacttggttttgtcttgtctttgatttttaatgttgttgttttacctgtgtttaatactaaatatcagttcaaatcttgcttggaaacaggagggtagaaatttttattaaattttaaaaaaattgccaacacccttcctcatttaatcagaaatggagaaagtgaatgatgctgtttaaatgttagttgagtaataacttatttttatactaaatgtcttgataatgtatcagagaataccc

SEQ ID NO: 96684 - DNA, 1020 bp, Homo sapiens
agaaattgaaaaccctgttcagatgtatggatcacacacacacacacacacacacgacacacacacacacgattggctgtgcagatagttttgcctgcttcaggtaaaggtaacctttcagttagaaatgctttctatttgttacagatattcaaagagtggaagtttttcaactagtgatcctacacaattgaaaataaccgaaattgtattttgaccaaagtgcattccctccccaccccctactattatgtaaggagagggtgctgcatctggtgtcttatgtattatactgaagagtctaagttgggaaagctaaatatccaattattttaatttttacctgtattgtttttggagggagataagggagcagagtattgatggaaaacaagggaagaagaaactaggggcagctagtattcagccagaaagtaaaattatatacattattgcagcagtaatgcatttataagctgaataaatcaaatctaattttgtgactagttctgacatgatatgaatttaaagaaactactaccaaattcagtttaataaaaattttagcatttctatgaccttgagtatttggattaggtttaaattagaatcgcagttttcttccttttcttgtaaataggcaaagtaaatttaatgtaaaaatttgaaactcgctttaatttttgaaaatgcaattattggcaatttttgaccttagtaatttccatgctgttacccagggatcaatttaaataatattcataccctggatgatgccaaccatcaggtaagtctagtctcttacctgactcttttgaaatattaaggtattttgagaatgctctgtaatctaatgtgtttttctttctgtttcaattgagcagtaattccctaccttgcttaattctaaaatggacatcatatcttcattcttaaatggaaggtaaaatagaggttactatagggttattttagggcataaatgcctatggtattgtatgtcagtttgggaagtttgcc

SEQ ID NO: 96685 - DNA, 1655 bp, Homo sapiens
tgtaagtcatgtgattgcaaagcatttttcctgaatggaataatgcctggtgactgggtgggtgccaatccaggtagctagatatagaataatacagtcttcacaaaatccagaactcacaatatagggtagggagggagggggccaggggaagcacctttctttgacatctgaggcatgtttgacttctatagtttcctctccactaaatataaattgggtgagttgcaaatatttaatggtgttagtactgctcttccttcatctgtgcccctacactgcccccaccaccctgccacaacacacacacactatgccatcaccacatctgtgagcttggcaaggcagaggaagctccttatggcctgagaccatgtacataaaatgtagacattggtgtcctgtattccaggttgaatttaaaacaggtatggggtttgacacaaaaatgatactgtatatgaaggttaggtaaaatatgtatttgaagtgaggctatcagggtactatgcaggcttttggggcctggcccgaaacttggaatgcagtttttcatagaaacccacaatcagtttacaaatagacttttgaaacactggctaggtggtatctgaagttttggcccattgcaagctgtgtctgaattgcaagcatgagggaagtaaaaagcatcccaaatcagaaattaggagatctgccattaaaccttattaccttgacaaaccatttaatgtttggatgatagcttcctccttttaaaaatacaatttggattatattgatctaagttatattttagctcaagattcctgaagttcacagtggtttttaaaaatttttcttaagaaaaaaaaaagaacaaaaaacttttccaagcttgaatatacataatcagccctgtttccccttgtacctcaaatcatggcaacaaggaagttgaatttctcttttgagacttttgaaccttcttcacattcatttttaattgttttgttttaaaacaatatcattttgggaagtgaggggaagggatgaagcacatgttttcaaagtcttgctgtctgcctctaccctagtctgagattacatatggtagttttggccagggaaagtgcttgggatttcaccttcatactcagtgaggctcatgaagtgtcattaaggtagtgaggtgtcatgattagcagccttactgtcagggtccaattctggcactgcaacttgctggctgtgtaacctggcagattgtataatctctgtggtcctcgttttgctcatctgtaggatggagtgataaaagtacccacttcatatggttgttggggagattaaatgaattaatacatgtaaagtgcttacaacaggagctggttcagagccagcgcttaatacattgaaataattatttttacattgtggtgcttttatgatggtttctgcagcatttaccaaatgccagggaaattattggcttgctttctgtgtgggttttgtcaaaatgattatggatttcaacaggatatttcagagaagaaataaactgctgaacagaaaccattgtgagcttgatagtttgcaggacattgtagaaaagagaatccagcacagtaattaagggcctttttaagtagggaagttgtagcttcttgcggtag

SEQ ID NO: 96686 - DNA, 2270 bp, Homo sapiens
aagaaaggctagaaaagaggaagggggtttggaatatacatgatataaatcaacagacagtggttaaatagatatcaagaggctctagttctagtcctggctttgccactatgcaggtgtgtgtcccatgagcacatcatgtaactctcgtgggctttagttttcttgtctataaaatgagggagttggtctagatgctctctagagtccctctagtacttacatttcgcaactcttagaacatcaagccattacattttttcctcagcaagaatatgctgtcttcccaaggatttatgacaatttaccctctgggataaggagggaaaattgaagttgtatacttgaaattctcagctcctgaaaatatgtgtcgcagccagacaaacctgtgacccctctgtggctgagtcagtggctccgtgtcttgtgcggtagtggtgaagtgctccaggagtgaggatccctggggcccctcggggcaggagctgagcagtgagcctttatggagctgcacatctgcagtttgtcacagccctgacttctgggacttacttgtctacaaccagtcccctgtgcacattggaggcttcacctctgattgagactacatttttcagaagttggatagaaacaagaaaggggatttagcatggtggttagaagggactagtcttgttacagtgagaaagatccacttcttacttgctcagatggtttgatttgtcctcagagaagttaaacaactgacagagttgctcctctgaaaacattttgtatgaatactttaggttcatagggaactcgtcaatccatatctcatagaatagagggacttttcattcaagtctaatttttacatatagacaatctaccagtgttcagaaattgtggcagatttcatgaggagaattttttacttggatttgtgctcttctataaaaagtaatttaaaaattcagtgatgaaagtttctcctagaccctgttctcttcctttgtggagaaaaaaaatccgtatagaactctagtatgtatttatctataaaacaattgtttaaaaatattgaggttagctcttcccctttgctaatgcaataagcacattatttgcaaagggaagcattaattatactactattgtatgcagtattaaatgaattgtcaatgtcacgatcaaaataaacccttgaagaactggctgttgttcccataccttcatgagaattgtaaacactcatgtaaaatagaaaccattatttaccactttgcagtgaaatggatcatgtgttctgacacctgtaccctgagttgagtgggaaacagggactgtttgatgaattaaaggtaactttattcctgtataccactaggggtgcaagtgaggggactgtagacaattagtactttagatatttgttggagtcctgctgtgtgtgcagtattgtgtttcattttgcatacttatttaaaacgatactacttatttgaaatgattcattttagttcattttaaccaacattttttagtcccctactccatatcagactgataggccttatggccaaaaagatgacttcctccagggatacttactgtctgtgttagattcagtaatgggagtctcggtctttaaggaatccatgatacatttttcagtctggttgggaaagataagacacatgaggtagagaagattgtcctagaaatgttggtatataaataagcatgtaacattgtttcataagtattaaggatgagctataaaataactaggttgtagctcatacttctacttgcttaattgtgtattacatgataaattacccgattctagagatatgcactaaccactctcattagctttctttgggaaaagtctgcaccaaagataaatagtgatttcaaaataagttttaatcatgaacttgattattttggctgtatctcttgaaacactttaccatatagcctatgtgaaataattaatcataatgacaatacatgatttatgagaaaccataatttatgctgtaagacctgccattttattacattcttatttttatttttcatgcagcagtattttcgtttattgtgttttgtgcttttcttttattctctatgtaatttgtgtgcctttataagcccaaacttgctgttgaaaatattccctcccattgttatgaataaacagaatgtttcaaaatctctcgtgatgtatgctagaataaatggtctcattgaatcttactttgaatctcagaatg

SEQ ID NO: 96687 - DNA, 2587 bp, Homo sapiens
accatttatcctgcatgtttcaaaggaaaaaactatttagactttaaaaaaatgcttttctaatacaacttgctagataaataattcattataccaaattccttagtaaagaaattaacggctgggtgcagtggctcacacctgtaatcccagcactttgggaggctgaggcaggtggatcacttgagattaggagttcaagaccagcctggacaacatggtgaaaccccatctctactaaaaatacaaaaaaaaaaaaattagccaggcgtggtggcgggcgcctgtagtcccagctacttgggaggctgaggtgagagaatcacgtgaacccgtgaggcagaggttgcagtgggcagagattgcaccactgcactccagcctgggtgacagagcgaaactccatttcaaaaagaaattaattagaagattttaaacagattggttcatattcattttaaacttaattgcctggattataaccatagtgagatgagttttcataatgctctttatcatactactaataggcaccaatcaagcaccaagactaagctaagctttgaaagtgtgatattgagcaaactttctgtatctgtaccttttgtgaatcagtaatatctttgtatactcagttgaagagttaagacagaagtagatataatttaaagcacatgaagtttttcaaaggggaaatgttacaaaaatgctaagggttattggtactataaaattacataaatgttaagagtaatgaaacaaaatttcatagcttgttttgacctagttggtatagtaagtaaacctttgtttggtcttaatatagtagatagaaatattcttatacattttggttgtccctttcccaacctcacataatcactgtaataaaatttacagaaggaaagatcctgtgtaccctttatattgttttccccagtggtaacatcttgaaaactatattacaatgtcacaaccaggatattaacattgatgtaatcaagatacacaacatttccatcaccacaacgctcatctctcctactctcatcgcctcctaaatctctggcaaccattcatttttcattacaactatagttttgtcattttaagaatgctagtggcctacacctgtagttacagctactgaggaagctgaggtgggaggatgacttgagcctgggagggcaagactgcagtgagccatgatctcaccactgcactctatcctgggtgagagagtgagaccttgtcaaaaaaaaaaaaaaatgtgggcacggtggctcgctcctgtaatctaagcactgtcagaggctaagatatgaagattacttgaggccaagagttcaagaccagcctgagcaacatagccagacgctgtctctaaaaaaaattttaaaaattagctgcgtgcgatggcatgtgcctgtagtctcaggtaattgggaagctgaggtagaaggattgcttgagcccaggaggttgaggctacagtgagttatgatagtgccactgcactccaacctgggcaatagagtgaaactctatctccaaaaataaaaaaataaaaaaagaatattatataaatagatttataaagtatgtgatttgggatattttttcccattttgcataattctttggagattattccaggttgctgcgtgtatcgatagtctgttctgttttatagccaagtaatattccataatatggatgtaccatagtttgcttaaccattcacctgttgtttccaacttatagctattacaaatagagttgctatgaatatgtatgtacagtttagcataagtatacttttctctgggggaaatgcccaggaatacaattgctgcattgaatcataatttttaaaactttctttctacattatgcactgaattatctgagacctcagtaatccagccatctttatcaatgtgttggtgaattaaaataaagaattttgtaaggtagatttatagctttggtaaattacaaaaacttgtctataaaatcaagtcttttatcttttgttactgttttacaaatagtacttcccataagtttaccttattttttaggaaaaccccattgattttaagtagaattcatgaagttgctttgtagcttggcttcaggatttgtttggttttgttatatttttttctttagatagcaggcacatttaattttctataacaatattatattttaaaatgtaatcatgaatgttggctctttcagaatttcacttatatatgatcataggtaatattcttgcaaaaaaatgttgatagtgcaccatgttaacaggcaaggtgaggatgtaagatgaagacagtattttcctatgtgattggaattaatccagtcgttaggttgaagccagtaagcatacctgatactttaaaaggtgaggattgtttcattcctagaagaaaagaaattagacattttcttttcttcttcttctttttttttttttttttttgagacagggtctcactctgtcacccaggctggagtgcagtggcggtactattataactcactgcagcctcaaattcctgagctcaagggaccc

SEQ ID NO: 96688 - DNA, 1043 bp, Homo sapiens
ctaaatgaagtcttcgtgattgatactttggttagtttttattaatgtcttttctaccttgaaggtcaaatctttattttcatagtttaaaataccatcagattacttaacaagctttatactttgttcagtattacttttatgttcattctaatatttttattatcaatacttcagtcttccagaatcctagctgagaaggtaagtgttgactgtacaatcagtcctaaaatatagctatacagtaacattcatttttaatatggtgcttttaaggatttgatccattttctgtatttgaatgatataacctcagcactatttactttcacagaaatatgatcctcccaataagttgtgtatttcctgaaggtttttctgtgattacctgttatgtccttctctgcctggtgagcccttgtttttcttcttcagggtctaactcaatgacccctctttaatgaagccttccctggcccttcgctctgcccaactccagatttcaaccttcccacctgtgcttgtcatcactttgcacataactctgctttgaacacttgtcacattgtgaatagtttctgtgtctgtttcctggctatttgagctctcagcaggttagaactgtgtcatagccatcactgtaattctctcatgtagcagtattcctaacatatagtaagcaacgatgctttctttgagtgaatgaatacttaaatactttgtttacaaccttagttatccccttctcttctaaccttcagtggctctccattgtttaccctgctggatcatattcacattccccagcgacctaccatataaggcccgttacagtcaaaccttaattactctccttcctgaaccctccacatcagcaagtctagtttctactcattgttctctgtctccctccactctaggttcacatcttcaaagtccttcaagacctagttcaaatagatactgtaatagtatctaacttttttgtggtagaaagaaagaaagcgcagagatcctactctgatgacaacaagaacaaaaaa

SEQ ID NO: 96689 - DNA, 3181 bp, Homo sapiens
ttttttaaattcttacttttatgataggctataattaaactagttgtttcctatgtgaatatatgtggatatgatataaggagaaaattgtattatattgtatgaggtatagagacaatattaattgtatcttgcaaagtagaattgttttcctttgagattgttactagagtaataaatcatgttgaagtgaagaaatttacacagcatatgactgaatattttccactgtatcaaatttaatgggttttgggaaaacgtatagtttggtagcagtatagaactgagtttttggtaaaactgagtatttaaaggacgaaactttgaaggactttgagacccataagacctacagatattattcagctttctgagcagtattctagtttactaagaatgtggaaggtaatgtgtggtggtgaggcaaggggtgttgagaacacagtgacctacattccaaatacaactcttctaaactataaggcagagaatagactaagtaaggcataataagttaggacctgccacatggcaaactgattttgggaagcagtctagaaagatgcttgaaaaatgtactgatgtgtaatgccagcagcaggccattgtcatggtatggaataatggtgactgaaagtcattctcccttgcttgggatgatctgtcttaagcatgagcagcttgaggctgaattgtagacaataaaacgtgagtccaatgacagtctttgtaggttgagtaagagtatttgtgtactagccattttagttgtaatgcattcacagaatgattacagtcagaattacagtaacattttaaatacaaaggagactatcttccatgtcagcttcatagttctgtacctattcccagccctgtgatatattccatatgaaacgttacatcagcatccttatataaagcatacctataaactggggtgggacagagaagtagtggccagagaatggagtttgtcacgctatgattcagcccgtgggagtgattttcacactgcctgtcagcttcgtgcgatagttaaaaacaatttgcaagtgacatagtagagccttaaggccataaataggaatttttaactggcacaaagcctttttttaaaaaaaagcacatttgtataaaccagtgtttctatatagtttctcatttactggttgtcttcaccataatctttggaagtgcataatcttataatcattatgtgtgttttacacatgagaaaacagtaaaagaaatccatgatttgccctaggatcctgcaacttgtgagtaattcagtcagaatccaaactttaattttctgatgtataaagaaaaggcctctggttggatcatactgttgctatgagttaatatgggaggtgtcatatgcataaagtacccatgagtttaaagttttggtttgttcaagtaaaatgtttatataattattcaagttaaatttaaataaacacatgctgaaagaacttgaaggtaaaaatagtttctgcaaatactattccacactttttctttataccactttgaatgctgagtaaggacattgtactggaccattgcccagcatagttctggcttatagagacttgatggtgaaagaaagactgagagagagagagagagagaagagagagaagggggagggagggaggaaggaagggaggaaggaaaaagatttgacaagggaatgtgttttttaagagaagctctttggggaataaatatagtcttgaaatacaccatgtaaaataagtttagtagaaaactatggagatatgcctaaatcataaatgaaaatattgattcgtttcttcagttgtggaattattcatttctgatttctttgcacaggatcaagctatattctaggtagaccctttatgtttttcaatctgttccacctatatccacaaatttattactgccacctactaaattgtttataaccattgtatgatctgatttttgtatacatgtgttgctaagtaagtttcacattgtcatgaaaccaaattataaaaaaaattggaggcaaggggtgaaagatctaggtagtgtatgaaagtttaaccagtatttgttgagcctactatgtgctggggcatcctctttaacacttcctaggcgccataccctgactaaagttccttcagcttctcatcaacacttttccgcatttccttctgagatgactcttcatctgtttttattctgactgttgaagcttttccagaaatggtgccttgctaaattcccatatataccatgtgctctttttttatgtttattatgccccttgtattgtcccactacctctaaataatgtggggaagcagtcacagagaagagagatcattgccaaccctgttttgattctgtttgacactcactgtctcacttacatgcagatatcctttcaccagtaggtttatggtaggcagctttaagatagcctccagtgatcccacctcctggaatccatgccttagtgtaatctctgtcccttgagcatgcctgaatttattattcatttctaatgaatagactatttatttgggtgattgtatatcacttccaataatagcagtgttaacaatatctcagtgttaccaaggattatcagtgattgttgatagtgttcaggaaaaagagcttagaattcactcctgagtcagggaaagaatgaagtctatgggtgtttaaaagagagctgtccaaggagtggctggaatcagataggaacaggtgtgcaaggcagtgtgtcttcaaaagatgtgtcttcatttgcatcaactattttaacaaccttggggaaggcattacatctttcagagccgttatttcgtcatctgtacaatggagttgaacttgatgatgattgttttgataaatcttttcaattcacattctctacatccagaaatccaatattttacattttgataagattttatttaaaacaaagttcatccacatacagtagagtcatttttttttccttcagaaatcattattgtaggtgtgaaatttatataacatctaaaatcttttgatattatttctctgggtgttagcatatctgggcttctcttttttgaactgctatttatagtaactttctagggttttgctttttatagttatggagttttaatgtggccac

SEQ ID NO: 96690 - DNA, 1077 bp, Homo sapiens
tctactcacttgctgcatttaaaccttatgttattcatgtcatttacaaaatgttctttccttttggaatcatttgcaaatcaatttaagctgtgttaagcaagacaaaagtatacattttaaaaaacataattatgtccagcgaaactctcacagtctatagtaggaaaaccttaaggtgagaggagtctggattcctcaagtgtggccctagtgctaatgagcttcaaaacccaggcacagccagttacttcacccccttcccccgtgagcaaaacaacaaaacaactaacagtgtgaatcatttttcttcagctcttggtcattattaagacaacaattaggggaagtgttattctcagattgtctttttaaaatagacacattaatgatactatataaaaccgtgagatttatttaaaatattttcaatttaaggggtgtgcaaatcattaacaccagatggcatctacctaggattttttaaaaggtggatttgggatacttgtagccaaaatgtagaaatttagcttataaacagttactgtgccaacagattggtcagtgcaaattgaacgtgtcgatgcaagaggatttagagcttttgttgtccatctttcctgctaagctctggtacctccctgataacagacctggtcaccaaattgatttaaaaaaaaaaaaaaaagacggcaaacaaatgtgatatttacaagaaaaaaaatactagaatattttagggggttaaaagatgcataagtaaagtcgatgaatttttcttagattttcaaaaagcttgtaacaaatttccacttgttatttttaaaagaatgctgttgagttgtaaatggtaagaatagctaatttgtcatagaggattgaagtttagaaaggggaaatagcaagttgggataagcaggcatttttctggaggaagaagtacaaataggattcctcaggagtcaatgtggacaataattttaaacattgatttaatctgtcttaaggagggcatgagtctctgtaggtttacagtagcaaatcccctggaagactgatctgaccacctcctgttta

SEQ ID NO: 96691 - DNA, 1088 bp, Homo sapiens
tttattttaaagatatgtgtccctgggtggtgtctgtgttagcttgttgattctgactgcagttgagtatttcatgatatatatccatccagttttatctctcccctccttctgtgatggttatttagattgcattcacctcctcaccatcgtaaaaaggggtgcgtgatcccttgggacctgtgtgacagtttctgtgggaaatatgcctagcaccagaattgctgcatcatagactatcagtactcttactttgcctgagctgtgcggtgctgatactctctagaatggctgcatccatctatatgtctccacaacccaacacttagcgtggttcagtctgccaggtgtaaatcaactcattttcagtttgtatttctctgactacttatgaacttgataatgtcttcatctgcttgttatctttttttgggtatcctcttctgtaaattttttgtccataccttttgcccagttttctactgggggttctaatcttatgttgatttgagggacatcattatattctggatatatatcccttattatggcgttacaaaagtctttaatatcccacttgtctgtaaactttattgaacagaaatcattaaatgtgctatcaaaatcatcgtttgttctcccttcaccccccaccccagccatatagcttgaaggttttgttcaaatccttctctagccctagttctcaaggtattcttcgtgctttcttttttatttttaatttttatttttgagacaggttctcactctgtcacccaggctggagtacagtgaagcaagtatggctcactgcagcttcgacctcccaggctcaagcagcccctcatgtcagccaccctagtagctagaggtgaagtagatggagcacaggtgcgcatcaccatgctggagtaatttttaaatgttttgtagagatgatgtctcgctatcttggcagggctggtctcaaacctctaggctgaaatagtcctcctatcacagtctcccaaagtgctgggattacaggcttgacccactgcaccgggcccctttttttaactttatagttttactttatacaatttggc

SEQ ID NO: 96692 - DNA, 1959 bp, Homo sapiens
tttaagaaaaggggattatgcttcataggcatagtctttatacataacctttatttcctccctacctaataatatttattttctaaactgtttatttttaatgtttgttttagttttttattttaaattaaaatattgaaagccttataacaaattataacagtcctttgacccccttgtctcattctttttgccagaagtatatactttcagttactttgtctatttcttctgatactcatctccttatttctaaataacatattattttttaaatcattaattttagatattatctattattgttaatacatagatgagaatctctgccttatacccctttgctgtcttcccgttttcctaataatgacagatcataattttttattaaattactatttattgtttccattattttgactatatatatcattcaccagtgagccaaatagtttctcatcgttttttaaatccaagtgttttttccaccagtggaaatacctgcctcatttttccatttccttaacttcgttttgatctacagccaaatcttctcacaccctcctttagcctcttagtgccattttccatgtggttaccctagcagctcatcagtgaatcccatttaaccctcacatttgggaccagccacctgtcctccttttccaggctggactggttgctctctaggcctgctgcacagtgtcattaatgcctgagtagccctcttccaaaactgaagtcggtgacacagtgacgttagcaaattgagagatttgagaaggtctcaagaggcttctagtccctgtaggtgtctagcactgctgcatgagggcattgagcagcatttggcctgggcttctgttttgtgagtgctgctcacttggcaacatgctttcctccttgaggtttcaggactggtgagcttttcctgctaatctaggtcttactgttgcctttctctcctcttccctcactctccccctttccccacccttgtggaccccttttttcagtcttctttcattctccagtgtgattattgattgcactactaatatttcttggtctttggggaagaaatgaatggagtccaggggtgcaaaattcatttaaaatgaagctgacattttcatttcagtcttatcaggagggaggcagattcttgccatgataaaagttggatcttttttaatacagtttaggaactttaaaaggtaaacactgatgagaagggaaaagctatttgtacttagcatactgcttattcgacttcaactaagaagctcatccattacaccaatttaggcatctcactatgtttctactactctaggacagcagagtatatatttatattatgtacttttttttttttacttatggaggggaaaatgggttctgtataaaacaagaaacagccctaaaaaatgtgacctttatatagtcttacttgaagttagttgaaatatcaattgtgccaaataatatacttgtaaactacagcgttatttgcaatgatatgaataaataaaatgtgttagttatttgaaagtagatgagcgaattatgaacctgatatgtctgaagtgatgattaataccattaaggatgatttgttttgtaataacatatttaaactaggtaatcatggatagtaaagcactttaaaatatggtagtagattactttcattattcagttatttaggtttttaatatgaaattttctagaccagttgcaaagactttttcaaagtactaaatatccccattataaataaagtgcacttaatggttcttttaatttgtaagcaaacagcaaatgattttttataaccaaatagagattttagttttgctatttgcttgctctttaactttgggcagatatttaaactgttttgagcctatgtcctaatcagtgaagtgagaatcgtgcctacctctagaggttttg

SEQ ID NO: 96693 - DNA, 1713 bp, Homo sapiens
tatttgcatttgtatttgcattttgagtggcctgccttttcctcttggttctttgcctggtttttatcttcaaggtaccttccctctttcctgctttttctctttagttcacttgcttctgcttgcccaatgctagataagaatcacacagagaaaatagatactgatttaggagttatattctcttaaattgttttcttttaattctctaaaatctggctttaaaaaacagtctgtcagttattctggaaactcacagagtggtggtgaacagcttaggaatcaggtagacccaggcttgaatttaaactgtgtcactagctgattaaccttaggcaagttatttcacttctctggctctgtgtactcagttgtgaaacagcgataatgtgtaactcagttttgccttaaagattaaatgatataatgttttaaagtgcttagcactgtatgagtcatagtattcaataggtggttgctgatgttgctattatagcattaacttttcagagatgaaggtagaggccagacatcttatttcaaatatcattgtaactttaaaaatcccagtaaatgttgcctgttcggtatacagtcaaaatctcccaaaacaaatccacaaaacagaagtgtagggtgggacacaggtgcatctggtgtttcgtaagtatgagcttagatatggagtgtggtagaaaaagaatgaagagaggataatggaggaagggaaaaactcaagtcttgtttctgactaaatttttttagaaaaaggagattggatgcctgcactgaggcaatgtgaggatgggcagattttaaattgtgcagcttttgacacatttttattttttgttatttttatttttatttttttgagatggggtcttactatgttgcccaggctttgaattcctgagctcaagggatcctcccacctcagcctgccaagtagctgggaatacaggcatgtgctaccaggcccagcttttccacacattttttagtcaatgtaaatatcaaattacaattgttaggtgactgagaatggggaaaatcaaaacctatccagataaaaagcattttatagtccactacattctcatgatggattctgtactttgcttcagattttttgttgtgagatgctttaaaaatgttaacattttatcatgttatcagttttacatagttttccaaaaaggttaactgtgttgtgaaatgtaattttgtttcttgggcttcagttttctcttcagcattccttttgtagtagtgatgactgggaatctcatgcactctgctgatgttggccttatagccatcttccccaggatatttcttctaaatgtctgtggatgctgcagtgttaaacagtggagataggttgatagggcaaacagtcttggcctgttctagaaccttgactcctctgtgctctgctctgataaactcctgctcagtttgttcatataatactgttgacccagtgcctgcattaggtgggttgtgagtgttttttttttttttttttccttcaggggtgagagatttttggtgatcattcaattctgcctctgctaaccaggcacagctttctgcagcacagctgatggtggtgacagcacagcctgtggccacagaagagaacagaactcctgtgctcacctaaggattaagcccacggggctggtgcattagctcagtgctcctgga

SEQ ID NO: 96694 - DNA, 1083 bp, Homo sapiens
tttcttccaattcagagcccgtgccttccttcagccacagagcgcacaacagcatggatgagattgagtcagccctcttacattgttggcctacagctatggagctacctttgcagagttgtccactttggggtttgagcatgggaagtaaattcagagatgcaagtatctgggagagggcatgaactcgtgagaaagtcctcatattctgagctcctatgacagttttgcctttagaagctatctcgtctcttagcagctttgttttgggcagaatgaatagcagaggggcaggaaagacccagaatcttgatgcccagcctccctgcttttactctgctgcttgatactgcctctaatgaaggagccgttcttatagagcagttactttgaggcctgagaaacccagaaaaatttatcatgactgctagacctgggcacaggtggattttagattagacttggcagggacaacaggcatcttggaaactccctaaggaagggtccagatcaacaacactgcaaacaccatattcccttcaggcaggcatccctattttgctgtaccaggccttaatactctctgggttgtagcctccagtggtccatttgacttctgagatgtattaacaagaagactaatattaccaatggtaaccgctcacttaacaaaaacaaaacaatataccccaacatttattgttgccttgcaactctgcctttttggcctctctggatatccactgacatcatttaaaatgaaccattttatttctaattgctacatgccaggttggtttatatgtgtctgtttctcagcattccacagatgccacattactcaaagctgtgcttttgtgcatcttcacagatttctctctccctaccctgcacagcctccctacctgagtttctcatctagcagctgcctgcatgccctgctgacatccatccacagcacatgcccagccagctgagctcaactgcagtgaatgtggctgtagtgccagtgaactggctgtgctccaggactttgcctcccctgccatgccatctgatgttaagtgttttgttgaagaggga

SEQ ID NO: 96695 - DNA, 1101 bp, Homo sapiens
ttaagttttcaggatcatgtgtaagacctcagcagctttcctgaatgtgtgcctcaggagcatggtggttggcatcaggcagtgtctgaacagtatttataaagtgtgtttgatgatgcttacaacattattgaaggttttctgagggctggaagctcttatctaagtaaaatagagtattatgaaatccagttaattgactttgctttattgcattcatgctgaagagtagatcatccacttggatttttaaaaaatcatgaaatgattttttttcatgatcatgaaatcccaagatgttagtgagaacaaatgagccaatcatattttaggaactgttcttgatgatggttcctggaaataaagcactggacacagaagtgacctctagttccatttgcagcttagggtccataagaattctggttctggtctttctgagattgaagtcttcctagtcgcagtaggggagggatccccaaaaagtttccaaagaagttagagccctcattcccaaattagtgccctgggctggaaattttagcttaaattgtctctcaaatccatttgagctttgaatttcagtgacagaaggcctcaccttgagttctctaacacatacttgtctccaagtgaagtgtcttctcatcacccctcaccttcttcccggtccccttccatgtggatcgctgcagtcacttctagttgaaatctctgctaccacctgacttctttccagtcctgtagcacaactagtctgtaaaacataaattttccaagtcacctttagggaactgcccaattgcaattggtgcagatggacacaaaaggtggttcaaaagttgggttaacccgcatgctgataggagttaatggtgatgcagaatatttgtttacatttagtacaacttttacagtgtgttagagatggtttttgtaagaatagaagtatacattcataaaagcaaagaatagtaagttctctctgttttaaaataaactttggacacaaatcctcgagactttctgctctgtggtcgtctatttatatattaagaatgctgtgggaattcttgctaagaagtgttaaagactttaggc

SEQ ID NO: 96696 - DNA, 2814 bp, Homo sapiens
cctgaggatggttgtctcactggcaatttagcccttctattaggaagagaggagacaagttaaacataaaactaagttttcacttttctcttgttagtagtacttaattatttactagaataggtagtattaacttaaaagttctttgagggttgattcaggttcatttattcaagctggccttatgatcttctaaatatccttaaaaaaaaaaccaactttattacctaatctggaatataaatgtatcgcaaatcagatactacttttatatccttcttgcaaattcacaggaatttccaatactctgttactgcattctaacaaagtttattatgagagttctgaagatactgaatatgttgaaatctctttagtgcttcattttccaactatttcagtgcaatttcagtgatgttttgtctgtttttgatggctgtcctgtgcttagataatggataagagttacggtagattgccaagccatctgtttgtatcagtcttcacaaagatgcttcttccaaaggagaaaatggacagaagagcttaatagtgttttcaggtggaaattaagagttcttttcctgttctggcactgatagcatgctatagaataattctgttctgctcctgcttacttcatgaggatgttgtaagagttgatttaataactattttgagtggcttaaggcactgataggaaaggtactttgttagccatacaggtataggaagagtatgagttctgccataggcatgctgaatatctgggaggaaaccctgttgatgactgggagacatgaaatcaaaactgagctcagggacccagaataaaatttttagtgggtagcctagaagtgatcaccagagtattaagattctacccacctgccaaatgtatgcctatcaggaaagccaaagacaaccactaaggagctcttggagcttaggggaaatcgggagattgaaccctagtcatttgtccagggcttctccgaggcccaggtttttcctcctgtactgtgctgcctgctgacagctgttgcagttgataaaccagtgaacaaagtctcttctgtactcatgtagctttctccttgagattggggtagggaggattagtaatgtattagggggtggtgataagcattaaggtgagaaaagaagcagggtgggtgataggagaagtgagggttttggagtggcagggaagggggttcatcaggatcagagtcaggtcaagaaaggcttcttaggtgacgtgactcagcagaatgaaggaagagacaaagctgggagagggcatgccagggcctggaactgcaagtgtagaggtagttgcagggagggatagagtgctgctgtccctggaagtaccggtgtggaggaggtggggtctgaaatgtgcccacctttccaccagcagatctggtgaagaagaccataagtacacaggaggcgcatccctcaactgtgagcttcaacagccctgttttgaaaccttaagtaaaagatttgtaaaataataagcctgaactttttccctccaagctatactgtgaaatgtgaattttaaaaagaatggttgtgtaaatatgaagaaagtactttcaaattagatgatcagactgcgtttccttcagaattgtgttgctttgcttgaacatggcaattgaaagatcccagaagcaagactgtggacaagttatgccctggctttgagcctccagtcaccttgctctgcagtgcagtccttgatgttaagtggccttcctccaagctttaggaagcctcagtgcaggttgtggttgaggagatgaagaaggcctaagaggagcagctcctgtttttataattttttgtatcagtgctccctcccaagggtatttaagtaaaggtattaacaaaattaagaatttggcagacagctcagttagacgatcaccaaggtccttctcatttctaaagttatttgaagctgctgttttcattagtccttaagtatatgttgctaccatataatttggccacaaaaatgtttagatatgtgtcaaagtcctcagggcttcctgacagaagtgcttcttgactgattgtgtatttggtacaagggcttctttggtgatagtttctactctctttaaatactgttctgttatttttgaaatctgatcaagaattgacacaataaatctctttgatatttatacttatgcctacttttaaccttttaggaaaactttatgaattggaatattctaaaatcctgaaataatttggaatattctaaaattctgaagagaatatgaacggattgttggaatggaacttttacccgattccctcagactagagtgttcatacgacattttgccaagaagttcctatagaggcaatatcacttttaggatggatgggtctaaaaggatcatatttagtttctggttattcatggttgcactcactttagaggatgtgttcctattaggttgctgctactatttgtctctcctaaataacagtatggaattatagaaagaaaggttgggagaatagtcgtgtgattctcctggtcagcataaagcctgttccatccagccactgactattttgttctttcttttgctttgaaggccaagatgacatttccattacttcgatgtttttatgttctatacctctctcttgctccatatattttgcagtggtgcagatatattgatccataaatgactggtattacatactgaatcaaggtacatgcattcaactctagagagaattgtttctgggtgtttttcactatgtgactca

SEQ ID NO: 96697 - DNA, 2053 bp, Homo sapiens
taaggtatgttcagtttcccccactcaaagaccatttcatcccttagacattctacccaggacattgaaaatagaaacaaggccaggcacagtggctcacgcctgtaatctcagcactttgggaggccaagatgggcggatcacctgaggtcaggagttcaagaccagcctggccaacatggtgaaaccccgtctctattaaaaaaaaaaaatacaaaaaattagctgggcatggtggcaggcacctgtaatcccagttacttgggaggctgaggcaggagaattgcttgaacctggaggggcagaggatgcagtgagccaagatcacgccattgcactccagcctgggcaacaagagcaaaactccgtctcaaaaaaaaaaaaaaaaaaaaaagaagaagaagatgccagtgaaggaaagttagaaaccactgcgtgtcctaagcagttcctaactcccatggacaattctagcatgagttttgtaatagtttataattgacatataggtagaaaattgataccaagaaacccagctgttcctagagtactagtagtaactcagaaagagtagagaattgtactgtaaaatgagcagattgccttttcactttctttttctactccatcaaagtgccagcttgctccatctttgctaaacgttagattaaatgtcttatttatcatgatacctctgatgttcaaaattacatatgttgctgtaattcttatgaattgtgagcatacattcttctgcgtaaacagatggtactgttgacacaggctttataatcctagtaggctggacatcaaaattttatatttctaccattaccttaattgtagagaggttctggggtgactgtggaaagtcatctaacatgtgttctctttctttgcactgctgggtttctaaatatttattaatcattatttatactctgtaatgccatactttattggtgaatgtaccatctttgggaggtcattagatattctttagtatctaagagaaatatctacctatcagtgaatttcaaattatagtttatggtcttcagattaatgaaaagcaagttcccacccccaccaaaaattaaaatgacacaaaaatgcatcttgggaacatcacaatattttaaactgagaatactaattttttgagatttgattatatcacatatgacttagattctgatagattatgaatttgtaatcagttcaattttgtatactgaaattatctttgcactctgaataaatgaagtatcaagcaaaattttaagagtaacaatattttaagagatataaacacagttaaaatctttgaggtattttaccactcacttttagaattatcaaatgctgctttgatcttttcatcaaatcagaacagatatctatatttttattggcaacaataaaaacagtctgtgaggaaatgaaacaatccagtctttcattttcttgctcatttaatctgaacaggtgatgtttcagtatattgagacataagacaatcaagactttttgagacataagacaatcaagactttgttaacagctttctagattattggtggaattatagctctgatttatagggtcacattaaaagtactcctttgtgtacactaggtctggaggtgatgatatagaaatactagtgtgggccgggcgcggtggctcacgcctgtaatcccagcactttgggaggctgaggcgagtggatcacctgaggtcgggagtttgagaccagcctgaccaacatggagaaaccctgtctctactaaaaatacaaaattagccaggcgtggtggcacatgcctgtaatcccagctactcgggaggctgagggaggagaatcgcttgaacccaggacgtggaggttgcggtgagccgagatcacaccactgcactccagcctgggcaacaagagcaaaactccatctcaaaaaaaaaaaaaaagaaataccagtgtgaccacattgtaacataggttgtgttatttcctgctaatggaatgtagcttccttgacttgtggttatttcc

SEQ ID NO: 96698 - DNA, 1129 bp, Homo sapiens
tcgatttaatgattgtatcccccagggatttggcacatgagggagagaagaatcattcttttcttttgcagatgttggagatttcttctttttgatgtctttaaagtcttcttttcctcacggttgcttcctagctcctcaccgggctttccagacatttccccagtactcctaagttgacaccatctaacttttactctcctgactccaggtcacattaccaccttcactgggaccagtgacacctcattcagtttgactctttgcctcaactttcaccgtcatcttaggcaaatttaaaggctgtggagacaatccatgtctttatttgcacttactattgttccttcgtcttctcatctccagagttttctttctctttttctcccccaccccgcttccaccccaattttagactgttggcattctctgaacacagcacgctgtggtgttttatgcctctctgtctttgtagtaagtctcatcttccctgacgaccccgctctcccatgcgaagttgagctcccctcacttctgtggtggtagattttatgcttgtttactcttgcatttatcacactatttttactcctttgttcctgctagacagctctttcagcatcataatggccacaaaacctaacaccatctggtgtataaatgtgttttcattgaaaacacagatatgttgtcatatcttccctcagtttgtttcatgctcccattgaacaaacacttttgaatacctactgtgtttcaggcactttctggatctgctgagaatgcagtggcaatccagatgaaaagagtccctgccattactgaaccaagagcgtatggttagattgcagaaaagtaaataagttatcatccagtccattgcgttctccatctgtgatcaacagaactctagaaactttatagtggttgttattttttcttgtactttcttcaaaaagctgtttggagatgttaagtgtgaaaatttgtctccttgaaaacgaaatatagtattaagcacacagattctaaatggaataaaggagactgagagataaccatcattcctctatcctgctgaagaccagacagaaagaaaggatgttatcacaactgagaatctatggta

SEQ ID NO: 96699 - DNA, 1055 bp, Homo sapiens
gaggtggcaggatcgtgtgacctaggagttcaaggctgtagtgagctatgattgtgccactgtactccagcctgggtgacagagtgagaatccatctttttttttttttttttatacacatgagggtctctggttaataaatgttgagatgtagggttaggtgagattaaacaggttctttttttcatgatttctcggagtctttatgatgctccacaccagtgcttctcaaagctgactgtgtatacaaaacactggggatctgacccacatgtaaagtctgatttctttggtctggggcaggcctgaaattctgcatttcttacaagttccaaagtgcagcctgcacaactggcacacagattacactttaagtaacaagattcttagggattttttaagaggaaccatgttctgccacatttcccagacttgctaaccataggaacctcattttgagatgctggaagttgtccgtggagcacactttgagaattttaaattgaatctttaaaattacacatgaattaatgtataatttaaatagaaatctcatgcagatcttctaggttatgattggccgaacagccccgtgtaaatcccaagacactgaaaaaatcatttagctagttcatgtagaaagaaaaaccagtatgggctaaaaagacaaccactaggtaagatagcaagtacactggattatatacttttcttttttttttttttttttaagacagagttccgctcttgttgcccaggctagagtgcagtggcacagtcttggctcaccacaacctctgccttccgggttcaagcgattctcctgcctcagcctcccgagcagctgggggattacaggcacttgccaccatgcctggctaattttttgtatttttaatagagacgggatttcactgtgttggccaggctggtctcgaacttctgacctcatgatccgcctgcctcagcctcccaaagtgctgagagtacaggcatgagccactgtgcccggcctacttttcttattttttaatagaccttataaatattgttaa

SEQ ID NO: 96700 - DNA, 1018 bp, Homo sapiens
cttgaacatatttctgtaactctccagatgcctatgtacaagagtgtctctacttaatcaggaatggaattacaggactacagagtgtacatgtcatcagctgcactagataatgccaaaatggattccaaggagtggttcccatttacactgtcatcagcagcatgggatagttaccattattccaggtcctcaccaaaatttgatactgttttgccattctggtgcttgtgtattgactactcattgcagtattaatgttcatttttctaattactaataaggttgagaacttcattattggtcatctagattttctcctcttcgtacaaaccttttgcttaattttttttaccagattatcttgcagtgatatttctagtgaaaaataaattcataatcaaaaacatttaactactatgcatagattattctcttgaactactatgctgtttggcacagagctctcttctaaacaaattcttgccaagaaatttgaattattttatgaaccgcctgattagaaggttagtatgcaactacctctaatcctcctaaagagttgcagcttttggttatgtttctatttctaggatattttaaaaatataactgcaaaaagtttatctgatactccttttagaattctagactcgataccatatgctcctgaagatgtttaacttttcaggcaaattcttaatttcctagtacttcattcttctgcaatatctgttccagtttcattataagtaaaacaaagaggaacttatgtttgctatatgatgatactcctagcaattttttctacttattattgttaaaatattttgttcatctaatgcttattttctacacttttatctgacattagtatctttacattttgaatcaaatttaaatattcacgctttctttaacctttattttttattaatttgttcttaggcatcattattttgtcatatcagttttgaaattgtgtttctcatcaacatttttctgagtgttcataatga

SEQ ID NO: 96701 - DNA, 2295 bp, Homo sapiens
agctgtgtcattcacatcctccctgtccccttacctggaaataatgactggatccctttaacaccccactcatcatctcttgaatggatacagtgtgtgcattcctgttaatgtgctgcccttatctggaagtagttatgtcccaaggagcctgaaggaaaattgtaagctcacttaaacgcccttcctatcatcctagtgacttacatcaacacagcataagatcacttaggtttgggcagtcttgtttcacttatgattcactcattttgctcttgaacctgaaatgcctacatttctttcccaatatgctgctgagctaacctaaatacaggaccttgtatttattcccgttgtttttagtctcattagaggcagctcattactgcagtgtagcagtatattttttgtattttaattttatctccctctgccaaattccatattcttagtcattgaagaacttgtatatgacttgtattgatatcatggctaaaacatttggtagggttgggtcaaggtcagacctctggcattatgttagaaacctctataggttgatgtatttcattcagctgtttacagattgttgaagtcagcagttgcccttattccagccacatttctatgttaatgacaatgtgatggaggacttctaatatcatacacgccccactagagtttgggcaacactgcatttccatggttacgctgccacagacattaggccagcttaacatgacttttctgtggtgccccattttagttctcacaaatcacctcttggataaaatcctttaaagaatctcacccaagatctgtgtctagctctgtagtttgtaatgtgaagagtctaccttccctttttccaaaaacagccatggcattttcctccttccagttttctggcatgccttcattctctgtagaaccctcaaaaatggttcagcaacctatctgtaagctttcccaggtctcctgaatgtgatcagtcaaatcaagcaaattgaggtcactgagggaagcgtgaggcctaatttctcacagtctctttacgatagaagtactctttctttcttttttttttttttttttttttttgctagtggaatggagcaatatcattattctgtgactccagtcttagcttgatactttctaattcattaaatggtcttacaattatgaaaactacaagaaaatggataggaaaccttcataggtttataacttgtcagcacagtggtatccctcccctgccccatgttggttgtggcatattgagactgcttcagagataaggggtagggaagtgtctcacccttagtaacgacaggtaccattggctttgctcctcatctaatgactgttcatggttgcctgtggtgtgtcctaacctttgaggaatcagaatagatatcatccatgtctatgaaaatttcctctcctgccaagcttctcagcattatattagtttcttttacacagttataagctctctgaccctcctcctcttgactttagcattactcctttgcatttacatcttgccgtactctgccttgatcctatgttgctgcatcagctaggtgatgagccccctaatggtcaatgtccctgggagagtggtactcagaaagtgctcctctgggttcattggtcctgggaagcagggtcagcaagataaatactgtgaaattaagtatgatatcctcacagtgatgtaatacaattaccataatataattctatgtctttttaacagtaaggctccttctatattaataaataattacttccccagtgacatttctgtttctccttttctcaaattatctttgttcactgaatttttccttctttttcttcttacacattggttgtttcatattatactcttgacatttaaaatttttggttcttggcattatttgtttcactgttgcatagtaacatttttgttctttgcaaccatctgcttattttaaggtgtgtaatttttcaatggctggaatacttttatatctttacttgccttaaatgctaatctaggatctttgtgtagcatttttttcctttatagaccttagatcttctctttaatgagcacttgatacagaaagaagaaattttatttagttgataatattttgttttacatctcaataagcattccacatacactaaaaaatatagattgccataaaattattacattgtataaagaactagccatttttatcagtgaggaagtgaggctcagcaaggtagaaactccccccagggcacttaggt

SEQ ID NO: 96702 - DNA, 2715 bp, Homo sapiens
acacactgctctcactatgtgttgtcttaggaaaggcattccatctgctgccaagaacctattctatcataagctatgggcctaaaaaatagattttcttttcaacaccacattcctagttattgttatctttgaataatcagattcttctaaagaaaccaagctagctataggactccaccaagggtgaccttgttgctagttattaatatgttatatttcttttaaataagcagacttttatttttaagccttctttaggttttaaactctttttttcttttctgttgcaaaaacctcttctgcaattggtaaaacattcttctcatgtcagttaacatttgtagatgtctttttgtgtgcatattactttgaaaacagacccctatagcaatctagaatgtttattatttagtttcttgataagttagtcatatttacttattggttacctgtttagaaaatttagcaatttcacaagtttttgatcatggtgtgtagactgtagtctactgtagttgctaggaaccatctgtaaagccttggttcctgcaagggagcccagaagaaagtgttaaccctttgcctgcttgattgcaggaggaatgccagctcctgagcaggcctcattggtggaggaggggcaaccacagacccgccaggaagctgcctccactggcccaggcatggaacccgagaccacagccaccactattctagcatccgtgaaggagcaggtacatcctcgtattgaaagttgcagtgaattatttctttaatgcctttaaaaaattaatctttggatatgttttaaatttgtgtaacgtccttgacgccttcacgttttctaattataaggtgtttacatccctgagtacattgggatgactggcatgtagagccgctccaggtgccagtcagaatcggaacatgcaggatacttgtgcgtctgcaagtaaggacaatctcgatggtgatcggtgtctctgtctctcccacattgcagagtgtgtgcatgcacgcaaagctgtgtaaagcatagttctcagtgctgacttttctatcaggactctggcaacctgaggcctgtaatagcgttaggtattttgaacattttaacataggtagtatataggattgtctctgtgatttttggataaaggctatatttgtgtgtttgtctaaatttaagtatattcattttgtgagctaatgttctaaaacttgtcgaactgtgccagtttgcttcaatgtcatgtttatgttgatttttttaaggcattaatactctttatccttcaaactcaagtaacctcctatattaggtcttatcagttgtgcttagagaaattggaattctgcaattttaatttcttaagatttcaaagcttaataaggtaaatgtaaatttaaagctccagggatggtttttttgtttttttttccctgcttcttctctccaaaacaacattatgtgtcccctgtgagggttattttgttgaaataatctaagattaagtttttttaaaacatcttataattaagccactagatgtttttttctcaagataggtaatgttgtatttgctgggatattcctttgaaagtcagtatcagtaactcaaatgatgaatgatgacgaagattgaggaaacatttattaccttattgttgtactatttttcgtaacttggaatgtggcatgaaagattgctctataaccgtgacacatgtctgacgttagaactgtgttttcaagaaaaattatttcagtttattctagtaacaagatgtcaacatttttttttattcctcaatgaaatttgaagtttttaaactttccacaaagagtttgagaagatgcaagatatagtcagtacaattttcatcttccaccaaactataaaatgtctaagcttctgttatctttaggagagaaaaaaggactcttcgatagcacttcatagttgtcaagatttgacccacggagctgttaagatgagaagcctcagatttatttggggctcttagtatatactgtgttttggtgaaacgtggtaaatttatcaaaatgtttagaaatgacttaaaactattaactgcgtgcagtaaacatagcaatgggaatgtctgtttgtaccttgagaccatataccctacatgtaagaaaataaggaaacttgttaagattttgacactagaattccttgatggcctcaaatgacttcaaaattttatcttctggcagtaaatagtgttctgaataagtattttgtgggaagtgctaagaagagttcagcttctcaaggcagccaaaaatgtattcatcttattcattaaaacagttattatatataattgtttagtttagtgggatgctatactctagtctttggttctgttcctatcctgagaaattggagttcattaatatatatttgccgtttcatacataatttcttttaaaaattgtaagtacttagcatttcagttgtttaacccaggataccacatctgtgtctttttccaagatactctcctggttttaaatagctcccctgcaatttttgtggcaccaggcaaaatatagttggaataaaaatttcttaagactctcctgaaatatgtcacttcctatcatctacccaatgggatagagcacagaaaagttagatccaagtaagaaaactaattaccattcaccttatatgtttg

SEQ ID NO: 96703 - DNA, 1631 bp, Homo sapiens
tatctttcacaagtatctttgcaagttgatttctggttttgtagaattgcacatgtaatattcattagagttgttcatcttctgtcataaagttgcttgaataattgagatctctatttgaacttggtcatacttttcaggctctctaaccactttttttttttttttttttttttgagacagactctcgctctgtcatccaggctggagtgcagtggtgcgatcttggctcactgcaacctccgccttctgggttcaagcaactcttctgcctcagcctcccaagagtagctgagattacaggtgtctgccactacacccagttaatttttgtatttttagtagagacgaggtttctccatgttggccagactggtctcaaactcctgacctcaggtgatctgcccaccttggcctcccaaagtgctgggattacaggtgtgagccaccacacctggcccacaaaccgcattcttatatttttggttaatgatttcagaagcttagaatctagatttaaggttgaggccaatccagatagcatgaactggtaagcaaagaatagatttggtaaaatatgctaattttatatgcactctttttactctggtgaggtctcaagttagatagtgtatgcttcttttgttatctttgatgagtgaaaattgcaatgttcctcatctgtgtggctcttaaagagaataccactttcaatatattttctggcttttgtgaaaataaccattctatcttcagtatgtccttattaacttaagtgatatttaaatatcaaagagtgaaatgagagccagagatccttaattttttgaagataaaataagaaaatctgaagcccaactgtgtcctattgatgttacttcatttttacatagatatcttagcttcagtaattacacacccttcctgtatggcaaaatgcccagaagtgaacaaattccagtacaattatttactttattcctctggaactgaaacaactcagctgttacacacctgcctttgtaacttccttttgtttggcccctatgcttattttcaatgaaatagtcctctctgacacacctcagccacatgcagaagagagaatttttatttcagctgtaaacaagcatagtttgtcacttaactagaagtcttgtgctgtaagtacaatgcctgaaacttctgatttttccaattggcaacttagttatttttccaattggtaactgaattatcctggcagttattgttaccgtgtaacccacagtgaagttttcagtgcctgaactgcagcatctaacccaagataagattggatctcagtggtttttgagggatcatcaaattttacagctttatctccataatattataaaaatgaggttcaaaatgaggacaaatggcagagccttgtgacactgtttggcttgtattcaagaattctgaactctaaaatggctctcaggagatcagtcctcttaagttgcatgtaccatggtcagaatttaacatttcccttcattttgttaacgatgcagggtgtcctccacctcaagcgtccctgtgattaaagaatactacagagtatggccaacaggtttattcagtatttgagtactgcccactcc

SEQ ID NO: 96704 - DNA, 1945 bp, Homo sapiens
aagaggtagctaacaacaagcatatgcatttggctacctgcctacattttccgatagtctgatgaatgatcagatggaactgctagcaaagcttccagtcttatatgtcctcaactatatattcagaataacttagtatttgttctctttgatttcatcggaagcatcattttaggttgtattgacactgaggggtttgtttgaaagactgttctatgaacttgaacagactccatgtggctgttcacacataactggatcacacattcaaacatggaaaacatagtaggtgcccaaaatatttattagttaatgaactaaaaatgtaaacatgtttacagtgcctccatacttagattaagcttgcttttaattaattaaaaaatgtttatttaaagactactctgagcaaagcactttgtcaaggaatgggttgagggggataagtagacatataaagttgacctatttcatatagtttctactctcagaagaatgcagaggcacaaaccgtatttatacttcaatatagagtaattgacacattatgaatattcattaattgatgcataagagacaagaatgtgtgtacttttgcccccttttagtttaaacaggctatcagtatgtattatgtcagttttatgtaagtttgttaacttaggcatttttaggtttaatttttaccactgaattaccattagcttttatttacatttgaaagtaatagaatatttttgtttaatttttaccattgaattagcattgtttcgtttacatttgaaaatgatagaatatttttctttgttaacacttaaagccaaccatgactttatacctttaaaattataatttccttttcagttgaataatccagtttacaattcttttcagagttaaattatgaatatatggaataatttccccctgtatatgcaaactttatgctgttaaatttgaaatgagtgactgctgagttgatgagattaaatggatgagaggattattcagcattgaattctctgctttgcatgatcgtttttctttttagaatcacttctggagagaaaaatatttcggaaacatgtttttcccttcaggtataaccctaaagttattccgtagctattgcaaaacatagcctatccagtgcctatcttcatgtttaagggctcccaatttctaaattgccatttttgttactttgcaaaaatgtgtccatatggtctcacttcatctgtttatattttatgaatgtattgttcccaaagtgatcagatctgcttgtacctcagcaaagtaatttggtttatggctattttatttcaggcattcctaagaaagatcatttaaaatgtaaagttattttcagtagttcaaagacaaatctatttcttagcttatagaatcttaagagtttttatgtacccaaaccttaataatgtaggagttacacaaagtagaagcagtctgcaagcaaattgaaataacacattattgaaacttgaagacaaataacatcctatgcaattatattctatataattatatttcaaatatgaaaatagctataataaattaaaagtatacttagaatttcaatctctgtggctcttgaaagaaaatttaatttttcctttaaaaattggagttcaaagcatttcaatttatagactgtttagtgttttaacttgtagtctttttcttatgaaaattcctataaagcaacgcggcatcagtgaagtgttcatcgtgagttatcatctaccctaataggcatatatctcatttaaaaattttccccaaatcattctaagagcctaaaccaagattaaggtcttaaccactgcctatggccttctaataaactattctggcagaattaataactcttactatttcatccatatgtagtatttctgtattctggtattccttcagaaat

SEQ ID NO: 96705 - DNA, 1079 bp, Homo sapiens
ccctgtagtggacagtgcaagtgggggtgccagttgctagactgtgaagcgattcccaaggtaattgatcatattgacagaaacttagctgcctgttgctctactaaaaccatctcagttagcattcccccttctggtattcaatcaccctcgcccttcctcaacctaaagactgaaacataaccaagagttaaaagagataacagccatttatttactctaactcctaagggaaaatagtattttcctaaagagtaatttctaaaataaaggcatatctgtttctaaaatatttttactttatgcagaagtattttttaaatctttgcaactatttatatttgctaatttaccagtacttattctacttagctgtaccatcaacctcatttttaaaattatgtttaaaagttaattatacttattcgtaagtgaaaaaatcaaaataagtatctcacatttacatattagcttcagaaaagtaattttgcagcttttgcaatattaagtagtaattttgaaacaactataacttttttatagacaggatagtcttattataaattaatatgctgtctctctaaactgattgtgggaggcagaataatgctctcctccccagagatttattatcccaacgcttggagcctataaacgttatcttatttcaaaactttatgggtgtaaataagttaaaaaatcatgagatggggagattatcctggattatccaggtgagttctaaatgccatcacaagtatctgtctatgagagaggcagagagagacacacgagaaggctctgtgaaggtggaggcagggattggagtgatgtggctgcaagccagggaatgccagctgtccccagagcctgtaaggggcaaagaagaggtttttccctacagcctctggaatgagtacgtcccagcttacaccttgatttcggcccagtgaaaatgatttctgatttctggtttctagaactgtgagaataaatttttgttgttctattccaccaggtttgtggtgattcgttatagcagccataggatgctactacagagtttggcatcaggaagg

SEQ ID NO: 96706 - DNA, 1048 bp, Homo sapiens
ctttaaacaaaacgttggtagaaatgtgggtattaaaggtggttctggtgagagctcagaaggaaatgaggaatacgtaattggaaactagaggaaagaaaggtgattcttaatatttacaggcataccttggtgatactggttcagtactagaccaccgcaataaagctaatattccaataaagtgagacataaatttttttggtttcccagtgcacataaaagttatgtttacactatactgtagtctattaccttatgtctaaaaaccaatgtacatgcgttatgtctaaaaaccaatgtacatgccttaatttaaaactgtattgctaaaaatgctagtgaaataagcacatattgttggaaaaaaatgtgccagtagacttgctcaactcagggtttccacagaccttcaatttgtaaaagatgcgatagccacagagagtaatgaagcgaagtgcagtgaaacaagatatgccaatactggtagaaaacttagctgaattgtctctcccagtcctgtagaaagcatgtaaatgatggacttggatatttaggtaaagagatttccaagcagagcgtagaaggtacagcctggtttcttcttgctgctaataacaaaatgtgagaggaaaaacaaatcaaggggaaacctctcaagcaaaaatgaatcacagtttgataatttggaaaattctcagcctatccaggttgcaaaaaatggtaaaattaggagattcacttttaggaaagtgctctagagagaacgccaaggatgtagataacctttgactagtgctgaagatatcaggcatgtgactccgcagaaatcaggagtggagatgaaattttccagggaagatctgtggatgacccacttgtttaatggcacaaatacacaggaaacccacaagttttttgaaaatgttgtatcagcaaaaatgctgccagcttgaactgaaaaggacagagacaggttgaaatataggaaagctgttagacttcccaaactgtacaggcttgtcaaaacagtgctcagttgcaaata

SEQ ID NO: 96707 - DNA, 1952 bp, Homo sapiens
agccaggatggtctcgatctcctgacctcgtgatccgcctgcgtcagcctcccaaagtgctgggattgcaggcgtgagccactgcgccctgccagaaatgattcttcatcaaaaattgctatccattggtcttgccactttctctatacctcaagcaaccctactcttaatataccaaactcttacggcccaagaatagggaaggtagtttctttagataaaaatcaaaatgccacacctagaagaaaggtacaaagatgttaggtagcaagaacagcaggggtccactacataatacttgcacagtgcatgtttctgttatgattatttgctatttacttgtttaaataatcctgaatattctaatatgaatagcttccaaagaatatatctcttcttaaaagccatgtttaaacattagtacatgttttatttagtgaaatgatattttctaattgttctccaggtagttgaggaagcttcccaggctcctaagaaggcaacatgcaacatcagcaaaaatgatctgtaccaatccctagtgacctgtaccagtcttatgtaaattatgagtgcttataaagtaattaaggtttgagttgttcagtccgttctttttctctgaagcctgtctgtggtgtctttgtaattgtgagccagctattctcctgcctagcaggctttagggacaccacctttcccatacatgtgtatattaaagaaatgttagctcatcttaataataaagcaaaatgtaattagatctgctacagaaacatcatactctgcactacaaatataagtgtaaataatttggagtagacacacaccactggatagctctattagcatcaataactaagaattggttgtataaaaatagccttacataaatgcttctctgttctttgatttaaatatttctgaaatgttttactgcctgcaacacaatttatacccaagtgtgggaaatgtttgttaaatgtcttgtatttggatgtgaagatggatggtaatagtacttcacactcatctggatttgcctttggttgattttctgattgtcatgggttttgtccatgccacctgtatcctcacctggtctcacttttgatcatgatataattcgtagggtggctgacagtttgagttgtacaacccacagacataaactggttttttcttctgtggcctatttttttgtttgttctcaaaataccatcccagctgagttaataggccaagtccaagtataatctactctgagactgagcttggttttttccatagcttgcttattttggtcactgctgatctaactcaagatactttaaaactcttgatcaaattctaaggacagggcatttatattctgtcataattaacagtgaacgattaaagacatttatgaattagagccaagattcaatatttactagtgataaagggcaatgtcttatttatcacattattacactgtgacattggcaagttttgaaatagcttaaagatgtctgccttattttctaaataagagggaaatgggctacaaacaaacacatctcagtgtgattgtatgtgtgaaaaatatcttcatatcgggtagtttagtttttaaagttcattcagtacactaatggcttacaatttagtttaacagctcggtgtgttgtaatcaagagtgtgaagaggcaatcaaatacttctctgagattctgctccccaaagaattcctggcaagcctgttgctatggtgcagtctcacctgggacttgtttggtatctttctcaattagatatattgacaaaaatgagcttaaaaacagaactcatagaaaatccagaatggagaaatacggatagataaatgaagcattgtggctctttctctctttttttttttttttaacttgtacttaccaattcttgtttctgatcccaggagtcttaag

SEQ ID NO: 96708 - DNA, 1482 bp, Homo sapiens
gatgctggatgtcatagaaggcactgtttatcagatgagaaactgtgaagatgatcatctctaaaaccctgcaaactagattttctgcacccacagctgcttccctggaactttggcagctgtgataattgttgcagaccatccctgtttggtactgccattgtatttagataatgtcaaagaaaggcttatgagtcagttattaaattgaaggagatgatcacgtcagagtaaagccaggtagtgagacctctgttggattacttaggcttatattatttttaagagattattatcttgccccctccaccttgaaatcaatttcatttccacaccctgaagatcatggcatggggctgaaagacagagtgataaagagcatcaactctggagtcacaccttctaactgcatatccctgccatgtcatctacttggtgtagccttagacattcatgatctacacctctaaaatgagattaatagtaatatattcctcgtggggttattgtagaatttaaataaaagatgcctctcccatagaaattattcactgggtgttggctatattcacacttttgatatgcatagaaagccttagtatatactatgtggctcattgtatgcacttaatgaataatagccagtaatactattatcatgataccttacatgagtctgtgtcagatgtagacttactgaaaacacaggaggaaatgtaagggaatggctaaaatttgactttatcataaattgtagttgtatgaatgaatgagctggggtagtgaaccagaaaacatcaagtcattctatatactgtcctgaattatatacatgcaaggtttctgggactaaagtcatcctagcagcctttgcagtgaaaatgttgctgttcttaaatccagctaagtacatgctattttaaaacacagtgtttttcaagtgaacttaatgtgtgctgctgagaaaatgccaagttttgccagatcctgtatttttacctgttgtttgatatttatgtcattcataacataatactattaaaatgctttgtttttattgtaatgctttagttcattttaaaagataagtgtcacagatgtatagtaaagtgataacttaggtttagatccaaggagaatgagagatggaacaggacctgtttacgtttgtgtgtggaaggtgatggagctatctaagaggatgcttgggtttgaagaaggcagctggttacagattgctagaatttgtgagagtaaactgatgttctgcatgtgtgtaccttgaggtgattgtggatcatccccaagaagagacccattagatagctggacacatggacttggaccttggtcaggaagatctaggtcaaagttgtcgatatgagatccacaaccacatagttgttacttgaagccatgggagcagcagaggcatgaagaacacaggccctagggtgatcctcagggaatctagtccccatt

SEQ ID NO: 96709 - DNA, 1044 bp, Homo sapiens
ctacaggacaggtggcctaccggctgaatctggccctcgcctgttttttatagcctgcaagctaagaatgttttatacaatttttaatggttaaaaaataatcaaaggcagaatatttgatgacgcctgaaaattagatgaaatcaaatttcagtttccatatatattataaaatcttactggaacacaggcacactcgtcatttatgtttatggctgcttttgcactcccaggtcaaaggtgagtagttgtgacacagacctgtgctatggtccacaaagcctaaaatatttactgtgtatctggccttttctagaaaaagtttgccaactgctgctctaggatattagaacaaaaatctgtgataagaagttttgtatggggcccgaaagcttgttaaagctctcacacaccttaggtcttttgatcatttcagcagccagcaatgcagatggtgttgccttgttgaaccaatggggaatggatgccaagccctgtggtctcatcagcaccatgcagtttgtttatgttcactgactttctaggtgcctacttttatttggcatcttaaaacagggatttgttttgacccttcagcttgaatgttttaatccaattccctgacttccttgaagagaaacttcatatctaatttagaccacctctgctctgtggccccaggccgacttcccaggttacatgagtgctcgtcgcactttgttatgattgtggagcgcaggcactggtgttgcctctgcttttccctctttctctctacccatcgcagtgtttaaacaaatgaatgtataatcaagtcagtctttttttttttttaatttaagttctagggtacatgtgcacaacatgctggtttgttacataggtatacatgtgacatgttggtttgctgcatccatcaacattaggtatttctcccaatgccatccctccccccagccccccaccccccgacaggccccggtgtgtgatgctccccgccctgtgtccaagtgttctcataatcaagtcagtcgtttaaattac

SEQ ID NO: 96710 - DNA, 1641 bp, Homo sapiens
ttctttgataggtcagaattggaacatttaactattagtaaaaattgggattgtagtgtggttttacgtaagcaaacaactcttactctattttatttacaaaaattaataacaaaaataaatgcccaaggtagagggaattaaatactcagaagtataaaatgaaaagtaagccaccctacaggcatccagtcccatttcccaaaggttaaaacttcctctaaagttaagttttttgagtatacatcaagaaaaaatttatttctgcatattctagcatagatgtctttttaaaaacaactgcctggctttattttcctgcataatctttcttaaacatattctgtatcagcacatttggatttacttcaatcctttctagcaattgcatggaatcctattatgtagatgtatatatatatttagctattcccattttgatgattattgggttgtttccagttttatttgattggttggttttgtgtacttttccaagtatatcacaacctcagcattggaactaatgggacaacaggtaggtatgtaatatttacctttttttttggtattgttaaattgccccaccaagagtttgtactagtgtacattcctgctacaccatttcttcatagcatcaccaatgctgtgtactttcgaatctgatgtgttgtttccaattgttagaataggccataataggttattggaatattattgaacactgttagcatactttaatggcttcagaaaagcaaaaatatcagttgtccactcaatcagaataccacgttcgaggaattgacagtttcctcagcaggtttgtcctggtacatgcaaataatacttcgtgtcttttcttttctttctgcttaattttctgaattcaattttaattacagaaattgtgttgtaacaagtgatacaattaaaagagataatataaaagtgtaaataattgtaaatataaaataatataataatgtaatataaaagtataaatagattggtcacccttctgaggtgaccaatcatactgatctgctgtgtctcattcacagttgtgtctgtgttcaaacaaacctatgtaggctttgggtttttaaattttgttgtgttttactcagttcttcagttgactttttaacataatcatatataacggtccttctgaagcaacagataagagtccaactcattcttttgaataaggatatagtatgctgtagaatggagatgccatcgtttgttacaatattactatgtggatggacattcaaattgtttcaaatgatgctgcaattactgtttaatatataccattgcttttatttctgtagactagatttccaagtggggatggcagggcatgaggaatatggctttttaattttaataggtattaccagattgtttcctcaaagtgttatagcagatcccactcccatgaacagtacgtgtaagtgcccatttccccccagttcctcaccagccctggctgttaaccgcttttttaaatgtttgccagtatgatgaaaaatgacatctcattgttatttgattttctttttccttactaatgaaagtgagcaatgtgtgcatgtgtgtgtatagtttgaggtggtaatctagctttgtttt

SEQ ID NO: 96711 - DNA, 1068 bp, Homo sapiens
gcttggggaatattttgggattcctgagtagtcttttcctggcccagcttgatacaaccaggcagtcttgtgggaaaagatgcatataatgacaagtgagtaaatgaagtgaacaaatagaagtctataacaaaaaaaacaaaatgatgctgtttaagagcaaagaaagagtaagtgtgaggtaagcataatagtattttcaaattggttatcttagcctggtactgaatgctgaacaatttatgtctatctagtcttttgttactgaacatttattaagagcctaggaattgttaggcagaggcaggcattgtcccacttaccgattatgatcatattgtacagcattattgagccagctattattcatctaggccctgtccaatactgccacaccagttgggatcattaggaaaggattctcagtatcagaagatggtaaggagtttagggactgtttcttaaaaattattccaagaatagcttgtggaatttgcagagccagtactgtcaagcaattacatgtttgcctgatttcacagggagttcatatacttttcaattaaaatttttaatggcaaacgaatgtatacatataatcataaataatattttaggttgttttatttctgaatagtttctagatttaatactcatatgtctggtattttgaactagcagtcatcaaattaaactacttacagttcagcatttgctttgaatagacttgtgaggagacagtatggcacaggggagcttgagatgctatttgtagcttaaaacctttggaatgtacttgatctttagatattttataacatgacatgttttctacttactaaaatcccatcaagctaacaatgagagaaatacaaataaagttaaaacattctctcctttcatagaacttgtttgccttcactttgcagcatagattcaagaatataatttctgtagactatcttccagcttttgaatatattttaaattctatgttatggcttagtctttttcacttcttgtgttccttctctcctttgcacagtggcacatgattgcttttggaca

SEQ ID NO: 96712 - DNA, 1125 bp, Homo sapiens
ggtatgtttgaacttaacatcactgcactaagccatgtcctttaaaggaccccatgattagcaaaccccaggcttctatcatatgtgggtttggagcccaaatgtaactatccacattgctcaggagtccccagtgagaaaatggcaccactaaagatgagctcacagtgagatagtataaaacacaaatttatgaatgacatcagcaagatgacagaataggacttgtcagtgcccatcctctcacagaaacttcaatttgaacaaccattcacacacacaaataccttcactagagctaaggaatccagacgagagattacagcacctgaatgtagcacagaaataagaaaagatgtattgaagagggtaggaaggacagtttcacactgtgctttgttcgtcatgtatttccaaattagttctgattttgtaaaaaaaaaaaaaaagcattgaattacatatcataaaaaaacttgaccatgagtgagagaatcagtgagcaaaagagtagggtttcacagtccaagaactggataccattggaggaagtctgacaggtgtgcacagtaaaacagatacaaagcatgctcattgcagcaccatttgcaaaagtaaaaaattacaaagaacatacttattccttagaatggaaatggaaaataaactgttaataggtacactctaaagcagttaaaatgaaactctagagcagttaaaatgaaataactagatctacatgtatcaacatggacatgtttgcaaaacagacttgaaaagctgtaagttgcagaagaatagctgtaggaggatataatctatgagcaatttaaaatatatatatatagctatatatatattgctatatatatagcaatactgcataataattaaatagtacttggtattgtttgtcagtgtgtgcatgtggagtaaaattataaaatattttggaatgacaccaatttaagatagtggaacctctagaaaggaagaaaggaggacgatactaggaattaggcttttgcagaatctgtagcattttattcaagagccatctggagcaaatataacaaaatgttaacaactgttaaatgagggagtggttgatatatgcatggctat

SEQ ID NO: 96713 - DNA, 1032 bp, Homo sapiens
gtgcagtgtgtaaaacagaataaagaggccaggcagccagataggaatctattatgaaattttaagggttatgagtaaggtgggtttcttcattcagtgatctctgagctgtggttggaatggtaattgatctacttggattgccctactttcttctcatgttgaattcccatgtattcttgatgtcccaactaaatgcttacccttctttacaacctttctcaagtttctcaggaaaagtcacctccctcatctgaattcccatcactgtttccctgtgcatgttagctgctcaacaggtagtaaggctcattccacccccatggccctggcacagagcctggcgctcagcaagtgggcacccagccaaatgatcattgaatggataatgaaccttaagtccaggatgcttcgggcacatcatgtaaaggtgctttgccattaggggagctaaagttttttattgtgtcacttgagagatcccccttgcatctccagtgtgtttcaattgtcagtcttggaaccagaatctaagtgatacagagaagaacagaaattagctcttagacccaggccccctttccggtatgccatttccgatttgctaaaaaataacaattaaaagtggaattgttgctttgggccatcaagcttctgtttgattcagttcgttcttgcatgaaatgagtttaatcagcaaactgggggatttgatcaccagttacctttcatactgtttgatttggatcctgtggcagagttggtaaggtgatctgtaagattttcttacttttcctggtccaaagatgacactaatgactcaaaggaaaacgaaaagcatttgtttttatttaccttttcacccatccaaagtttttgtcattattggcctcaccctgtgaagaaggacgtggcagtggcatgaggttctgtttaatacctgtttaatgacgcttatgctgtgataaacaaactgtggaatcctcttccccgaatgggtggctctaatagtgagtagttcggttccctcac

SEQ ID NO: 96714 - DNA, 1126 bp, Homo sapiens
agtataactgagtcttgcctaggacatgtgaccccaaggtatttcaaccagtattgcagtaagctaacgtattttaagctaaaaatgtcaccatgaagaattttaaacaatatatcttttatgagtaatagaatcttttttgaacctagaatgttttaatcacagcaaataagtattccaaaataaattacctgtctcttagactgagcattttaaatgttaaatggataatgcagttaggaagaaccacaaaaaagatcaggttaatagcataaatgtttcagattattttaagactattttaatatatgtggttaaaatggaggcacctcagctgtattaatttttctaatacttttaaaaattcagaggcccatacatctaaaatatgtatatcatgccattatttaatcatcttttaaagaacaattttagttaaaacagtatttcattttctgtaatttttcatagtttgctttctgtaattatattattaaattatttaacagtattgaattattgaatcaaaataagaattataatattagcccttacccttcatcattagagtttttgaaattatgtgtacatattgataaagtactttaataggttatacaggatatttcaagatgcttgaacagatttgccttcgctgctttataggagttagtaattacatttaccatctcataaaagcaacaatgctcttaaatcctgtattttcttattactattattattttccccttatctgggttttaaaatcttctttattttgagaaatgttaaaaattgtaaatgcagagaataaaatggaaatgttaagtactcacatcctgtaattaaaaattattaaaaattcattttttataaaaaatattgaacataaaattcaagtcccctttgccacattttctcttccccatagctaaccactagtatgtaatgtttcaattgactttgtatacttttatgtcaatacatatacagtacttatatattatatacatatatattaacacctgtgtaaccaatattttgtgttgctttttttttttacatcaaagattgtaggtgtagtttatgtgccattgtacaccttgattttttccatttgagatcc

SEQ ID NO: 96715 - DNA, 1016 bp, Homo sapiens
tacagagagaaacctttctttttcaaaaagcaaggcagaaatttaacaagtgtattatgctctctcttttcacacttacaattaaatttattaatgaaatttttactgtttataaaaattaaaaatctttactctggataattagtagacagaaagtgaatatcattctttagacacacaccagatttaatagtacctttacatgagtagcaaagaattctctgtgtaaatgattgggggaataaatgtttaattacaaatttaggcttaaaattccttttaagtaaatttttacatagtcttttcaaagcacttaaaatatgaaataatgtacgaaattaaattgtatgcatcaaataaaactatttgtaattataaatttcaaggatttggtatcccagcgtgtctcttactgtagactgctacagcttagtcccatgttaatgctgtgcccagtctcacatagaacaaatagaaaaacagggcccttttcttgttccttaccagcatctgctttatttacaagtataacatatagatgcttttatgcagttctagcagaaaatagtatgtttatatgccctttcttattttaaatttttttaaatttcctttctatttcttcacctttggaaggttttagaagaatagaaatgaggaaggcaacagcattttgtagaccatggacacaaatagttcccagtagcccctctgtttcaaggccaaatctttgcccaaataggatcctaggtttgtggcaggatatttaggaagagagtctgttgttgtgtttagccattttactcttttcatctcagttgctttcattctttcaaatgtcacttgaaatattagaaaaccttccttttctgatttctactttgactagttggaacacctgttgtgggatgggcataaacagaagtcatgtttcctgtataatttatagggataccagagggaactgtttgtctcatttttgtctagtactacgtcctttttgatcttccctttcc

SEQ ID NO: 96716 - DNA, 1082 bp, Homo sapiens
ttggtcacaccagtggttgggtttggagtggagatggattgacgcagagcctcactggtggaaggcaactcaagcctcatgtcctgttgctgatgggtcaggaacagctatagcctacatgaagggtgtcatttttaattcaagtgctcttgcttttctgtaacctcgatatcaccctcagatcatataaataattatgaaaagaagccctttgccctgtctcatttgttatgccttgcttagttcaaactataggcatgtaccattttcaggggcaaggtcataacacataaaaataactaaactacagttaggcacctgttgtcacattttcacttttcctggctgctgagatcttgggaatagccttaggaagagaggggactaacggccattctgatgaaaagccaggaagaattaattagtggccctttcttgggaagaaagaaatcagtctccatccaacagagaattgcccaggatctgacagcatggtaaagagacacttggtcagtgaaaaaccaggaatttggaggaagaggttttgttttgtttttgttttcattgagattgattgtgaatggacactaagtaaatttggaaggggtttcaaaaaatatagttaaatactaaggaggattgctttcagaatatttttgctaagaaatcattactgcctggatttgtgatttttcaaactagggtcctgagagcccctccgaggtggtagtgaatgtggtggtggagatatttgtttgccttccaactccctcgtccttcagctgggcaaagcagttcactttcactgtcttcacgtgttgaccttcctgtcttcaccttactgaactagcttagtgcaatgatgaagagctatccaaacttgttttgggaagaataatcatgacatattgtttaatttgtgtaactgctctatttgttctgacgttaagacagagagcataagtctctagtgtaaagaatttatttcccgggcaatccttacctgactaagagcaacagataaaggccctgtttcccaaacaggaaaaacggaactggttgtaacctaacagttacctatt

SEQ ID NO: 96717 - DNA, 1036 bp, Homo sapiens
tttgcatctgaatgaaaaaaattaatttcaggagtatgtagaattttatagtgatctacaacatattttcatgtaatattatgatgaaggcacattgtcttcctgtaaacaaaactgatttttcgtattaaaatgaactgttttgttaatttggtaataaatttgcttttgattgatgttcaccatctgactggacagccccaaggttattagtggatttcattctaaatgattaagttattaacgtattaaattatgaatatatcttcccattgaaacaaagttatcatgggtgactcagttcctgtgtgtattttaaaatgtgtttcacattccagtggaagctcctagaacgcaagctgcttggcatcttcagaagagaagtgaaagggaaccgggatggagtcatttgtgggcacagtgcctacagacacattgtagccattcaataaaagttgaggaagtgtttctaggaatagatggttggagggagagaaggaggaaataagcctatgtttctaacatgaagctgcctgtgattgttgtaataaacatgggtttattagaacaattgcctttggtggtttaaaacagcatttcaaaattccatctgttttgttgtccaatccctgagtcccaaagtagtgaacaatttgagagtcatttgaagtgagtaattcaaaaagaaaataggctgttatgaataacatgtaatgaccagttatttctcagaattatagaagtttctgtgaaagtagttgggctgaatagatgatcttcagagtataccatggaactatttatttatttttaatttcattattagcttgtttttctaatgatttatatatggtaccttaaatggaggagggaatattattgaggcttcccattgccttcacctaggaatacctattatattttggtaaccaaaggtcctttcagcagcaaaaatgctgtttgcttgattgttacacaacgaggttgctggagcttcctacctagactcggggagaataagttgacctgcttatac

SEQ ID NO: 96718 - DNA, 1039 bp, Homo sapiens
aataaactgtttaacagcctttttggttctttttcatatatatgatacgtatgtggttttcatattatcacgaaaaaactgtagtacatcatgtaagtactgtgaatatcatacagttgtgctgttttgtcttcttcaagtagaattttatgtcattttataatttgccttaatttccaaatagaaacaatttttgtcccaattttaaatactatctaaaaattaacttagataagtttaaattttatttaaggtttttgtgctcttgtataatttaatgtggaaattaaatgttaatatgcaaaacaggtcctaagctaaattttatgacaaaataaataaatgttccatttttttctttctttttctttagctcaactgagaagtcatttccttggagatcaacaggtatgttttttattatataaaagttatgtttgataaacacaaattacatagcctactctcttaacttactatctcttggtgaaataagccaagcaaagcctttaatagtgacaatattgcgctacattgctttggaatagtacttaatatgcttaagtttttagtataattgagtaaatttgtgtatgtcaactgtaatgaaaaagcattgaacagcagcatttttaatattaaccccatatctgaaagtttccatttccatcataagaaaacacagggctgacttcaaaaaaagttattacgtaatcaagaaagctgctaattatacaagttgggtatttcactgtgtttatcatactcagagaaaagtcgcttgaagttttcatttttttaatgtatccacatgtagaatatctagtagcttctaacatagtgtggtagctttccatgtagtctctctatcttttctttttaacctaaattcaccacataggaaggatgaattacattaaggagactgtctgtcacttacataaatcgttgatgtcttcatactcagccttcactcaataaatgtttattgagtattcacataatgtaccgggtgctgtgcacattgctgggcagagtg

SEQ ID NO: 96719 - DNA, 1063 bp, Homo sapiens
tagcaaattgaaaatttatgaataaaatagtaaaatcttattttcttttctttctttttttttttttttttttttttgagacggagtcttgctctgttgccatagccgaagttcggtggcgccattttggctcactgcaacagccacctcctgggttcaagagattctcctgtctctgcctcctgagtagctgggattataagcgtgcaccaccatgcccagctaatttttgttttttttaaattacagacagggttttgacatattggccaggctggtctcgaactcctaacctcaggtgatccgcccaactctgcctcccaaagtgctgggattacaggcatgagccactgcactggcccatatttccttttctagtaactgtagatgctatttataactttgagtatatattaataattgggataaaacagcagtgttgctgctgctttttctataaattttgacaattgttttttttctttgctgctttgactgcaaagatactgaagataatatgaaaatcatctatcttagaattaggcagtcctactcagaataaatgaggagtggcttaaatttgaaaaatatttaaaagaccatcagtccacttagtctttggctgggtcttgacaaaagcaacctctttattcgttttttggtttcctatacaaaatttcacaaaaggatttaggattgaaggtcctcatttatcctcatttatttttatactttgcatgtttactttcagacactttctctaccttttttcttaagttttacaaatttgacttgaaaagcttagctctttaaaagcctttcagcaataggtggattgttagagatgcaatggtttgatcactgcttaggagcgatccctgcttactcaggtgttttcaggatgttatattctgttgaaatgtggtaaactggaaccagcctttgaattggatttttaaatagctaacctactgcagcatcattttctaaggaagagcttaggatgccctaggcagaagagattttcatttcactctcatttcattagattcaggagactcta

SEQ ID NO: 96720 - DNA, 1560 bp, Homo sapiens
ccccagtcacattccatgaagtgaattttgctgcaagtcacaatatcacagtttttctgtttgcgagaaaaaaaaattactagagtttaggtggttgccaacttgagtagatctgtgtaaaatgcaggggaggagaatcggcctcagaatccagcctccctccgccccagctcttcctagcacattagaccaggagcagtccgtcttacagggctggaatgtgctgctctgtccccaccagccagccagccaagctcattctttttaacactgctgtgttcctagaaaaagaaagtgttcgagaaattgatggatgttacgtaggtgataaagaattggtgctcatgggtaagaaattagaggccaaaaaagattggaatctctaccaaaacaacaagtgagagaaattttctggttgactcagaaggcactgaggggttaatagatttggatgaacaggagagaaaatagtaacaattctgtgcagttaggagttttgatgtttgacagtaaatatggaagggaagaaaaaagaccatagtaaaataggaagtttaaaactgattctataacttcacagtgctgcattcatttattgtataacaggtattgaagtggtatgattttaacatactattcatttaaatcattactgtgtgaaatactggcattagttaatgtttactactaaatttaagactgtaggagctaggctgtgcattttgtttatgtatttaaattttgtttctaaaatgtatagatacaagtttcttccactgggatgagctttaaaaaataaaaataaaaaaacatcaataccgaagataaatgacaaatgagaaagtagtcctaagtcaatttatcttttcttttttcctccatctggtgcaagtaatttacaacacaaaaattcatcagcacatcatgagataagaagttgacttaaattgaaacactttatgcctcagtagaaatgtactgaatttataaaggagatacagtaggaagtgagtgttgtattgtacatgttcataaacaaaatattagatcagcaatcatgtataaaggactattattgaggattttggatgccgtcatttattatagccataaactttacaaatgacaaaactttatcatatatttcttcctgtttctcttctaaatataaggatgataagaatttcttttaaaatcagctgtagagtacaagtttctctcccttattttctacaggcccatttagccacacagtcttgactgcctttttaccaactgcagtgctatagcttcctgattgccactataaaagctcttcttaacttactgttttaagatgaaaataagatatgcttctttaaaaaaaaaaaaacagcctggaagaatctgagtaaaaggtagaaatttccttcattccaacatgttcccataccatgaccaacacacctacacaactgcacacacacacacacacataatgtataggaaaaaatctggaataatgaaacaccccagactgttaactgtgtttgtatgtatgtctaagtatccacacacatt

SEQ ID NO: 96721 - DNA, 1096 bp, Homo sapiens
aaagttgtaatgtgaaaggtgtgatgtacatggcaccattcataaagtatgctacccacaaaggcttgacctgaaagcttttagctataaccttctgcttaaagaaatagtgtatttagaggaataagtaaatgacatgagaaaaccatcagataaattcaggatgtggaacaacttaaaagtgtattgctgcagtttcctcagttcatcaaaaacatgaaaatgaaggaatgggtgcccctttctaaattgagggacttaaatcagttgtactcaaatgcaatcaggaaaccttatttcagcttgacgagtacaagccaactgaagaaacacatttccaagacatctgaaaaatttgaatttgaacacactatatggcattatggaataattatggttttatgaagtccttattttatagagatacaaatggaagtatttagagttgaaatgatccgacgtgagagatttgttttgaacttctacaacaaaggaaaaagataatggaaaaaagtatgcataaagtagaacttttatatatgtttaaaacttcaattacaaaaaaattaaatacaaatgctttaaacaaaagttttgaaatatcaaggcaaaaatggtgtgctggagtgacatggtaaagccagcaaaattttgaccatattctgaaggtcagccctgacataaatgatatgaagaaaccaactatgaaatggatgcatgagtttcccagccagtggatattacttaatttgtagtttccacatatttgggattttattaaatgaatttttatcgaacaaattacctatattatacagaagatcagcctttcaagtttagaacgatagatgtctcaatatgtttatcgtgggccaccaccaaataagaatattagattttgccctagcaaacataacatctaaatattccaaagccacttatgcatgatatatgaacagattcccaaaagcacattatatgaaaatcaagaatccagttttagcctttaatattttatgtttgatataaacatgccaaatatttaaactttctcatgcttttagtgatatgtgaagaaatgtgctactatctaaaa

SEQ ID NO: 96722 - DNA, 1877 bp, Homo sapiens
atggatgctacttagatgttacttcctttaggaagattttcctaagctccattcccccagacacacacacacacgcacacacacaccccttaccttctctcataactgcatagggcctggcatgtaatagggcccagagggagacagggagggaggaaaggaggtagacatttaaatccttaggattgtatgttaaactcagaatgtgataagaacttaattatctttgaagtgagagtgaagtagcatttctgaaagaaagtttgttaataatataagggttaaatgcaaggaaggaatggcttgtattgaagtccatcagaaaatgggaaaatacattttgaagatattagagaaagaaggacatacgggaatcgaattgggaaaaggaagcatgatctacaccacctaagtttacggcataaaaaacagaagtttgaatggggtttgtttttttcaagttcaggatggcaaatggtactgttaaattaaagcagataatggaagagatgagtttggctggaagaaacaatggttaggttagacttgcctatattcctttaaaaaaggctaaaggaataaaataagcaggtgaacaagaaaattttcattgcttgcaattctaaaactttgtatagagttcctttgactgtaagtgacatgaaatataacataaaatgtgctctaccttcagaggcttcatcaccaagctcaataatatgaacgttgtgtaagttttcatttttaattgtttggaagatggaggacccttcttgaaatacttggtctccattctcagtcttttaatcccttggaggaaggtgtctgagaggtcagttttccaagaggaacaggatcagttttcagattttgatttaatattgagacttacaatcacaacaaacaacattcatgaaattcagcaaaatatattaatgaagtataagtatatggaacacattcatatagttaagagtcagatgtgctgtgtaagctgaaaataatagccttgtattagcatatagattctaagatgctgttgacaaacatctgaaccttttttagcaagtttttatgtaatgttattatatttagctgattaaacttttcttgttacagacgtgccaaatactggtgtaagcaaacctagagtttctgacgctgtccagcccaacaactatctcatcaggacagagccagaacaaggaaccctctattcaccagaacagacatctctccatgaaagtgagggtctgttgtgttatcttttaagtactggatttgcttttaagattttattcttgaaagcgagtgtcagaagtgtgtataataaagatatttcttggtttcattcttacaggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcaggtaagccaaacgcatcaagatctctgcaaagaaataccttccggccgggcacagtggctcatgcctgtaatcccagcattttgggaggccgaggcgggtggatcacctgaggtcaggagttcaagaccagcctgcctaacatggcgaaaccccgtctctactaaaaatacaaaaattagccgggcgtggtggcgggcgcctgtaatctcagcaactcgggaggctgaggcaggagaatcacttgagcccaggaggcagagcttgcagtgagccgagatcgcaccactgcactccagcctgggcgacagagcgagactccgtctcaa

SEQ ID NO: 96723 - DNA, 1066 bp, Homo sapiens
tgttattaaccaggtcctttgaaaacaatttgtgacatttaggagaagacagtctttataagaaattctatctaataagcaaaaagtgtttggcaaatcatagacgtttcctccttctgattttatttggccctgtagacagcatttttattaagataatatgagtcatttaatacttgattgattttgaaaaactgaccttgtccttaaagccatttaaaatattcaggaaataaagatattttgaaactaaaagaattttcatttctgaaagagtgaaattgttgctaaattttaagcgctttagtgttattttaaggcatgtatgcaagatttcattcactcttcgcccacaaatagttgcttcactggaaaattgttataattatcaattcatttttagcagcctaccaacttgttttaatgaatgtgaattaaaatgatgagtgaggttttggtcattaaaacaaaatgactaaagataccttaaagttgagtgggaaatccactgcttcactaaaaccgcttcacttattcacttctattcctgaaattctttaagctatataaatgcatttggttctgctactcctggtttgccacctttttgtcatttttaaggagtttcaaaaataacttgtctaataacacctacagcttgtcagagatactcttactgattttgttttttcaaatcctcaaaatgacaaagacctaaggcacccaaatagatgcagaaattcccaaaagagttttgaattgtaggtaatttagaccatcccttggctggacctgaagagaaaataatagctacctagaaaggcagtgaaatgtgatgagaactttgagtttaatatgtgtccctgaagacttcagttttgacctctaatgtgagttgattctctataaacaaggacttcatgtatgataatatacctcagctattcatagtgtgataatttcatagtctaatgcataaaactgatggctgtctttgattatgtgaaactttactgataatgcatttcgtaaggtgaataagtgattatttggtaggtgcatttat

SEQ ID NO: 96724 - DNA, 1033 bp, Homo sapiens
taattcactacaagttttattcacttgtaagcctttattattaatgctacattacagttggcctgaaaaattctctttaagactgaggaagttattgatctttactgtataaaaggaaatctgtgagtttttttatagttgtctacttggaaaccatatttattaataacatcaatgatgcttctgaaaggagtaacgtaaaagacttcctgtgtattcacgtttccatctcaactcatttccctttggcctaaagaacttcctttagcctttcttgtcttgcatttctgcttgtaacaaattctctcagctttagtttatctgaaaatatttcacttgtttttttaaaggattttttttttgctagatatataattcaggatttacaggtgtgcatttttttctttctgtattttaaaagatgtcattcattgtcttcagatctccgttgtttctgttgataaggcagacatcatgtgcattcttctcattatgtaatgtgtcttttctttggctgcttttcagatttttctctagctttcagctgttttattctggtgagcctaagtataattttctttgcatttaacctgcttagggttcactgagattcttggaatgtaggttgatgtttttgtcaaaattgggaaattttcagccattaattctttaagtttttttttctgccccaaactctcttttctccttctaggacttgaattaaacacataggatcactttattattttgcagattactgaatctgtcttcattttttaaatcttttttccctgtattcttgtaatcagaaatttttattaatgccttcaaatttagtgttctttgtcctatagactacaatctattgtgaagcccttgcaaatttgtttttatttccaatccttgaatttggttccttttatatattccatgttcctatgagattctccatctcttcactccttatatacatctttttctttaagtctttgacacatttatcataaccatttaaaatatttcctctgataag

SEQ ID NO: 96725 - DNA, 1060 bp, Homo sapiens
gggtgctgagttttgttgtggcagagaactaaattactggcagatcctttcaatcccatcaagattggttttgttcattgttaggtctagttcatatttcttttaagccttagaacatgatccttacccctaaaacttggcctttgtggagtcttgactaaattcccaaggtgttcagtgaggtctgcactctgactaggctgggagtccacatcacgtggtacctgttcagccttgagccgtgcagcagccactttccaccagacctgtgcatgtgccctacagctcagggtacaactaaggacttcggatagtccacacgcaaacccggagaatcacctctgcttagctcccttgtctccagtactctgccttgcacattctaaccactttggcacccacaaattccactcgctccctgcctcagctcactaaatccctcacatactacttggcctcagcttcctgtgtcttggtccagaaagtgccctcaggcagaaagccaagtaaacatgggactcgtggatgtttccctcctctcaaggattatattcttgtgttgcctgttttcgagggtctaaaaacagttttctcctacatttagctaaattcacttttataattgtttatggtgggagggcgaaatccagtacgagttactctatcatggctggaaacagaagtctgggcttaggttatactgaagcaaatcctggcaggcattgatgccatccagccagcctacaaattgatagcagtttttcgagggtaaatttctactgaattttcatcgaggttggagttgaagccaagcaagcctaattgcccagctctggcaggagcccaccctcggggctgtctggccctcatggcaccggggatgtcaggaaatcttgaccctcagtgtcccatttaaagaggacaaaaatgtgtatttgtaatgattgtgagtcatcaaagaaagagtaaatcacactccttgcactctgttaattacaacagagatttacataataggctttagacagattttctgagaaacgattgataacagtttcaa

SEQ ID NO: 96726 - DNA, 1983 bp, Homo sapiens
actaaaaacacaaaaattagctggacatggtggtgcatggcctgtaatccccgctactcagaaggctgaggcgggagaatcacttgaacctgggagaaggaggttgcagtgagccgagatcaagccactgcactacagcctaggagcgagactctgtctcaaaaaaaaaaaaaattattaggttaaaaattatagtattcattgaactagtgagccaatgtgttttatgggattctagtcagattggtgccaactataaataagttatagaggattataaccatcactaaggctgaacatacatgaatattttatttcagggtttttttggtatttatagaaacatagcaagttactggttattggctataattctatataacatatagattctttctttaacgtttcaagccttcttctgacccactgtgttatataaaactgaagtgtttttcatcattttaatgtgcataacagtataccagttccagacctaaaagtgaatgtagtacataaagcccagaaatactcaaataatgtactaatgaattgacaaatggaagaaaatttaaggagagtagcctagagaactcattctagaaactaaataacttaagtcaaaaattatttcctatattgcctcaagccctgcagatagctttgctatgtttgtgtatttgcacattgcactgctggagtgaaagcacaattcttgatgtgtgttctgaggcttggaggaggactgtgctgcctgccgatggacattaaaccacttaaatctcctatctttttttgaagccatgaacccaggaaaagtatcatctacaagagtgtccttagaattctgtttttttggtggggggtggggggcacagagtctcactctgttgcccaggctggagtgcagtggtgcaatcttggctcactgcaacctccacctcccaggttccagcgattcttgtgcctcagccttccaagtagttgggattacaggcgtgtgcctcaacacccagctaagttttctctatttttagtagagacggggtttcatcatgttggccaggctggtcttgaactcctgacctcaagtgatccgcccatcttggcctcccaatgtgctgagattacaggcatgagccaccgcacctggcctctccttagaatgtataaaagttgtcttatttggaataaaaagtaacctttgaaatggtctagagatatccacatcctgtgatctctccataacggacttctgtatgatcactgattaattgcatgttacttaggcctggtacctaatatttttcattctaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggtaggtatagaatgtgatctcgtcctagaggaaatgttgaaaacagtctggactgtgcccttgtatagtggcactatggaagagttggaggttccaggtaatagataatgagatatatatagtgctcacaactgtgaaggctgagaattatttagtctaatgagtcagaaaccgtttagaatgcagtcatctctattagtataagttattgtacttattaatttgtaaatatcagctaacagatgtctttttcatggaggactaaatatgacattttttacatgtatttcatagtaaatctagttgtattaaatagactatcctatattatgaaaataaaatatacttaatggattggcagtcttttacgttagctcagctggtgtctgagtgcctgtttgtattcccacgtactttactaggccccagggatagaaagatgaataaaactcagt

SEQ ID NO: 96727 - DNA, 1037 bp, Homo sapiens
aaattttagctgttttttataaagatgccttgcctttgctttaaacacaataactgcccagggcctatatttttggccacatctttattttcagagggaaaaaaggacttttcttcaaatgtattttcccaagacaatatggctgtcattgttaattaaaatggttctctagtatgtaacatgattcttgtgttttcctcattgtgttgaacattttccagttgaaacctaatgagcttttcttttagtaagtgctgatatatgtgagtgcttagggtaatttttcttttattccaaaagtattttttgctgttgttgtacttaaacttgaaagctggatgaagtatggttgttccccagtttggttataaaatgaatgtctgctaggccacaaagtatggaggacagatgggaacatcttgtcactaaaaaagatatgttgaactcatttgttcaaaataattaaatagtgtttctaagctaggaaacatgagtttcaagttattgagcctcctgaaaacatcattttttaaaactatagacattgaagatattgcacaaatctggaggcctgctttttaatgtacgtaccagatgtccccaactgtcacacttctattaccctcttaaataccaaaaagtagcctttgttcttcggtaataatagactttgttcatatgactgctacatgtacatttcttccaatttagtaagtgattattcatccatatagctaagtaaaatatttccactgtttattgtgaaatgtttggatgccagcaatggattccagacactgcagaacatgaaatgaagtgtattgttttcctgatcattagctccatatttttaattcgatgataaattaataagaaaataatagttgtaactaaggaagggtagatgggccaggctaaggtttaacaaagggcagaacagtctggcaagaattagtcttatatactataaaaagcaggagcttagtggacatgccttttggacgattacttgccgttacaggatgaaaacagtttac

SEQ ID NO: 96728 - DNA, 1066 bp, Homo sapiens
gaaggcaaatcactcgaggtcaggagttcaagaccagccaggccaacatggtgaaaccccatctctactaaaaatacaaaaattagccaggtgtggtggcacatgcctgtaatccagctactagagagtctgaggcaggaaaatcgcttgagcctgaaaggcggatgttgcagcgagtcgacatcgcgccactgcactccagcctgggcgacagagactctgtctcaaaaaaataaatgaaacaatcacaacagaaacattcccttattcactgaacatttcaaaccctgaaaatgtgtaatgagaaatgacaaatttttaaaagtttaattactaagaagacaaaaaatgtctattatgaatagaccaattctcaattggtagagaactttgaactggaaagaaccctaaagaaatctcctgtctacccctgttattacagattagaaaccgaagtccaggaaggttgagcaggcaagtctccaggctgagttcctgatgtccaggctggaggtgtttcttccctgacccttcccctgcctaccctggccactgagaagggctgaacaggagctaaatctggagggtacaaatgttatttcccttgttctttaagattaccaccaaaaagggaaaagaaaaaaagccccacaataaactactctctgaattttacccaggaccatagagaaatatccctgaatttcaccactagcactataatatcaaactagtgatcaagtataatcataaagcttcagtttgcttaggaagtctatgaaacgtgattttaggtcttgcgtctatttcaagatttatagttttgagtatgaaaagattcaaccctctaagtggaatatgaccctgtattttgagtgtaggcttccgagtgccaagcacaaggaggcagtcaagtagggagtctcagaaggtcacttataagacttgggtattcaaacatcagtcagagtggaacttctcagcaaaagagaggccctgtaataacatgctccctcagttgactagacgtcctacaaatgcaagaaaggtgggaatatggagaccc

SEQ ID NO: 96729 - DNA, 1072 bp, Homo sapiens
atccagagaaaggtatttttctataactgaggatagtagttttatccctgtctcgtaattgttttcccactatttcagtttcacttagatttcgtaatttgttgacagccttcagccctgttagaaagcttgggcaattgattagcccagcagacagttttatggcactgattctccccaccacccccttgacttcctcatttctgttaacagtgccatattttcacacgtattcaaactcctggcttacctgtgacaccaccctcagtttgcatctggctccaaattctcactacaggcacttcccttcccttttggcctcctccctcctccatcctgtcctgtgaaataggctctgcccctcctagcccattggcctcaccccctccctgggataacacctgtgcctgcagttcaggttttcccacctgcctgtccaaatcagtagcttctgtgacctcctgccagccagctccagcatgtgccgtcacctcttctgcttctttcccaggctatatatagttggcctgaagagctctgcaccccaaacctgcttctttctggcctctgtccttgacactgcaactcaaatgtggtctcccatcctcctgtcaaacacaagttcacacactttgaaaaacatccaaggagaagcggcatggtctcgagtgagtgtgagctttggagccaggttgacttgtttccttccagctctgtggctccagacacatcaccactgtcaaaccccagtgtccccggcaatgacacattacctgctgcttggtgtttttgtgatgatgtgtgttgagctcctggcacacaggatattcaagccatacctgttgctcttcctgccctttgtcacaactgcctggtggtgtaactgtttgtggtaaggcccccctgagaacagatggctcccctgtgtgtctccctcggagtctggcatgaagcaagcaagcatctctgccagcgctgttcaataggagaataatatgagctgcatattttctacattttctagcagccatgggaaatctattttagtaatgtattttatttggcctaatag

SEQ ID NO: 96730 - DNA, 1001 bp, Homo sapiens
agaataactgtaaacatttttttttggaagttgcagaaatgaaagcctgaatttctatagtaggctagtgttatgatcaataagtcattttagttgactaaaagatagcatagtcaacttgtctactgaagggtaacatattttttaacaactttatattttataatttggcagcactgttcctttctattttgcactttgagggatggggattctggcatgttggtgtgacttttccgattctgggagatagaatggcaactggattctcctatccccgtaactaagatggtggtttcagcaaccatctgttttggtctcaatgtgaaaggcaggcaaaactatgctgacaaattttgttagagatcctctcccccagttgcaaacttaaaggacactcctgaatactcagttttacaaaaaggcacaaaggggaggtaataataataatacttataagccaagtctgataggtaggaaataaaagagaaatctaaaaacaaatacaggatataaaaatagatccatcacaaatatttttgaccacctactatgtgtcctgcatatgtgtcacacaacatatatataaaaggatggataatgatagggtatttcttcctcattatataatacttgcctaatgaaattaaaatttaatttcagcatataaatgttcatctttttttaaaaaaaaatcaacatgtagaatttcaaacctataaaaatatttaaaagggaaagttaattaattttgtacaacttggctttttaaggtattatatgtaaagcacacaatgcctggcacagagtaaagccacagtaaatggtgatgctaccattgtttacattgatttatgaatgtttatgctatgtccaatcccaagtatatatactggctaatactaagctgtagaatgacatacaactccatcagtcattctgaatgcctgggaagaaaaagacagagcaggacaaaattctaccaccagcatgaaaatcag

SEQ ID NO: 96731 - DNA, 1048 bp, Homo sapiens
atccacagtcaccttgcctaatagatacagagggtgtataatattcaccctctaaaatccaagagggtgaatattaagaatttgtaatatgttgtcggaggctcataccttcactcaaaactcattagaggtctattcccaccctggttgcaaatataggccatagattaggtttggaacagactgacttcatattaattagagctaatacgtttattttatttctaaagccacaggatctctatttgtttgattttttaaatctccttttttaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggtaaattctttatttcttctttccagttaattctgtgattaaatatgtgtcataggtaaattgattttaggaggacttactttattaacatctatctaagtttccagtttttatttcaaaatttaggccactggactttgttattctgggagaaaaacatcgtgagcacagacttgtggccttaaagaagttatcttgtaaatgactcttctgtgacttactcagaaaggccctttcagtctaagattactgccaaaattccagtgttttccactttaacagcatttttctggtaatcgcattctgattgctaatgtgtttgcagcctgctgtttgtttaaattcaaaatgtgatggttaaaaccattttgcttttaaagaggtgtgtgatttaaacaatcagtttcaagttgtataaataagtgaaaatgagcccaaatacttttttagtcattatcttttacagttaaaatctatatataaagcctctttcgagtgtgcacagtagagttcattatttgcccttaacactcatcagctccattttgaccctatttcccagccttacagtaccctgggaactggaagc

SEQ ID NO: 96732 - DNA, 1109 bp, Homo sapiens
tgtgatgcagtcttttagggaacaaaagaccatgtacagaaggcaaatgtcagcagggaaagacaccgctgaacatggctcaaaaggagggtggagttgggagattgagaaggaggcagacatgggacttggggatatagttgtccccagggagggagttggggcatctgttgtcacgccaaggatctgcagtagtgagaagtgaggctcaagcatcatgggtgcagtctgcacggcagcagccctgaagagaaacactgggccggagcctcaagcatttcggtcggcatgaagtcaaatcctcagcaggactgagaagggctctgcatcctgtcatctgggtattccacaaacactctagaatcataattctctcttcagattgtttcaagttctcataaataaaaagtagttctttcatatttcccatttatttcctgtctgtagtgttcagtacagaagtgttttgctctaatgtgccgagttgtttttaattatacgccatgctgggtttcagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaagttagcattttattttatatgagactctcaagtttaatttttctgggagtgaggaatcacatatttggcaagaaaataaattttctgcatagctatagctgagtcccgcaaaggtgaatgttttcaagtattggagatcatgttcattctgcctccatttaacgtgtgctgtttgtctttcagtgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaaggtaggatgacttccacttatctacacttctttccatctttgca

SEQ ID NO: 96733 - DNA, 1063 bp, Homo sapiens
ttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacaggcaagtctgcggcaaggaggtgcaagcagtgctcttattcctgagattgtcctgtgatgaggcctttgttgaggatacctttcctattggaaaggatttatttttgcatttcttacatgccgataagctaagcagtctccagcacttacaacctgctatgctgggagaagtgttttctgttatggggcctatttttggttttcactttattgtaacaccctcactcctacattggtatttgtctctgtcttagtctgtttgttctgctgtaacaaaatgttgtgaactgggtggcttataaacaacagaaatttatttctcacagttctagaggccgggaaatccaagatcagggcaccaacagatttggtgtctggtgagggccccgattctggttcatagatggtgcctttcagctgtccttgcacggtagaaggagggagaggtctcaggcctgtttttataagggtgctaatgccattcatgagggctctaccctcatgatctaatcacctctcaaaggctccacctcctaataccatcaccttgggggttggaatttcaacatatgaactttggaagggacacagaccttcagaccatagcagtccctaaagccacaactggtcatgccaactcctggaagaattggaaatgccaggatgagaaaaatctagggggcaccatttcccttgtgcccttgtctctctgctccaggcctgagtgcctgttctgcaggaacgtcttcttgaatccccagttctggaattgagtttt

SEQ ID NO: 96734 - DNA, 1039 bp, Homo sapiens
tattacacctgtgtcgacattggagcgagaccgattcaaatcacatccttccttgtctaccaccaaccaacagatgtcacccatcattcagtcaggtcagtgggaaaatgccactccttggcgagaacctttgtgtgacagaacattgttccccagccagagaagatcaaacataagctggttaagcctgtcatctccaacactacccatgcagcagagaaccttctgtaggaatcacacaccattataaaccacaagcccactttcttcctttttaaaagtgtatacaattttacatcagcaacagcgccccaggccctgccctcaagtctgcctcactaagtgtgagaaggggccctgaaacctgcagttgacagactggacaggggatcggggtgcctgagagtggagggccacacttcgagacgcactgggttatgcctgaaagtggctgccctgtatgccagctggccataaggttggaatctcctccaaagtgaatttttttaagttttcttagtgaaaccttttagaagcagggtcctttaccagaggacctttaaggtcttcagatccgcaacctgggagagctgcctgctttccagttaaacctccttcctctgcagacccccagcatctgctgctaatggaagcaggccttacagtgtgggtctgtaggaattccttttgatttttaagttgggaatcctggcaaccatactacctacttctttgtaatgtttaacttgatggaaagaatgttttgagattcagacttaatttttttacatgtaagggcagattattactgccaagccaatcagtcctataaatctaattctttccaaaatgagaaaggaaaaataataagtatcttatttttatttggctttaagtcacccatttggacttttaaatattatctattttattcagcagtgctactgctggcagtcttatttctcatgtggacaaatgtggccaaaaagacgaatatacatggccagtggttcttgccacataattggatgtccccact

SEQ ID NO: 96735 - DNA, 1422 bp, Homo sapiens
tccctttgctccgtcccctcctggctcgagcagtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtgattcttctcaacgtgattattttttaagaataacaaaaataatgttacatagtgttaatatttttatatcctattcagaaagctgtgcatacaatttatttaaaggataccagcccaaagggttactaagatttcatactgttcccattctcaaccgtctggcgattataactactttagatgttccaaataagtcagtgtgagctaccccacaaaaagtactcttttctcaaacctgtctattaaaaataaataaaagctggtggcagctttactcctgctgggggggcagtctccattgtactgttgtctttgaaattgtgatttcacaggactatttactaatcgactgttgttactatggcaattaatagctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcattaaaaaaataaaaatctttgctagccttaataataatggaagggtaacatcatcaggagtctactatggacttttgaagacaattatctcattattaccaagttccttttgtattaaaacatacttaaatatgccaggtacaagactgtgcctccattgttgctccttccttgacctgagattttgaatcccagttgtttgtttggaaggcatggggcttgttcgaatattgtgtttcgcttctcctctctgacccactgccgtagctcagagccctggaaaaggagtgttcctcagctcaggatcccgtgctgctgtccaaagccagctggagaaaccctcccacatgtgagcagagcttgagcaggaacctttgcgcatgggctctgcactggcattgctttttggggaaacacacacagcctgtttctgccatagttttgccattagcccccaccagccctgaggtaagcagcagccaggccagatccagggaccctgagctgctacctctcccagcccgcattggcactggggaagacaggccctgtcggggacagtgctagccctagtgcaggggagaccacccagcctaatggaccagagtaataagcactagttttaatttcataaaatattttcttac

SEQ ID NO: 96736 - DNA, 2533 bp, Homo sapiens
tggacctcactgtgggagagtgggactggcggttataacacacccaggctttgctttcatgaagggcctgcagtcagtctcaggtccttaccagtgccatggcgaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaagaactttccaagttattcataatttatgctatggttttttagtcaggaaaaatagaccagaatcataactctggcttgaaaggagaatttagctctgaaatccttataatgttagaatgcattgagttccaggacatgacattggtttctatgtggtaaatttgttacatcttactaagtagggggatttgggcataatcaagaacatagacataataaccatcacaatttgaagaaattagtgtgaggtcaaagctaagactgaacaaaaggaaatggagagcagtgtgccctgtgtgggtgcccacgtgtgcctggtcttgcccacttacagatggacttagccctggcttggggaagccttttcctctagaaccatatttgctcacgtgtgtctcctaattttactattcttctgccttgagattgcttattcctttaatattacaacttacagcagagtttccaaagtgtgactgttgttcacctagccacatacatcttttaaaatgtaggggtggactccatcttcatatctgaagtaaatgttctaaaagatggttcggtaattatacaattatccaaggcccagaaacccagtccttgactaaattagtgatgtgctaataattcccctgtgtcaaaccaaatatcaagaccatcctctcattcggcatgcccaggtaacaggtgcctccacagctgagcacacagcagggcctccagtaaagaggggaggtttctggggccacctgccctgagatctcaggctttcttgaggcacctgcttctctagaggtcttaggacaggaaactcagcagcctgcctgagaatgcagcttaaaatccttagagtccaatagtaaacgcatagtgtgcaccagaaacagcttttaaccttaaactgcaaatattgaatattgctttaaaaatatgaagcaggaagcccacattaattttcctaacacatgtatttttaaaaaattgcttttatttatttgccttttcattttgtcaacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttcta

SEQ ID NO: 96737 - DNA, 1036 bp, Homo sapiens
ctggtgggacttctgccctcagtgtgtgttagccctgaggcactggtgacagccccttcttatctactcccgtgaaagagtcctatttcacatattgagattcagtttggtccagaagtttggatgtgctggggtttctgaaggcccagacataccttagggctgagaccagaactgcagaggaatacacccaggggtcacgtggattagaacactatcagctttctcactcctgaggtggatttgggaactatagcttgaaccagaacaaaaatcagtcttctatagatacctgggttaactgaactcacccaaccaaaacttgaggcctccgtgcagtgcagcaccagccaggatagtctgccctgcgagggaggccagatgctccggccctttgctgggcagctgggctccttgagcttactttgtttctcctagtctcatgagatgatccctcctttgcccctgaagaagagtgaggagtgaacagtgaagacaaagatacaaggtttcattccacatcttccagaatgtctgtgcttccctttttatagacttgcagggctatgagtgagtccttattggagatggtctttggtggtagggcccttccctccctttgaggcaacagccctttcccagctgaactgcctggcctcctgcccctgctcctgcccagcagagttgctccttgaggctaagcgaggttggaggggtggggaggtgcagtgggattggcccgtacaggggagggcctctcttctgggttcttttgattccatgaagtgtttagtcacaggtctggactcggagcatattttgtgaacaggccatttgatagttttcttttcgaaggcatcaactttgatttgcgccaacatgctattttcctagtaatctttgctaaggcaacgttaaaatggatttgtattatttgagcctaatttggctgggaagctggtaggaagctggagggggattcctggctgggagagggtttgtcacaagggttgactttagcataaacatcaaggct

SEQ ID NO: 96738 - DNA, 1878 bp, Homo sapiens
accgggaacgcttggggcacgctcgagttctgggaccacccccgcccggcgcgcccgctcgccccctttcccgccttctctgtagccctcgggcttggcaagggcctgggctacgcctggtacctggcgcgggggaggcggggggaggcgcgcctggcaccgcggggtcctgggcgccccccggagtgttggggtgcgcgggtcgcgaagttgccgagagaacttaagccggaggcatggtattgccccagtctgggctgaaagtctattgctttgcttccaagaacactgcgattagcatatccacactcctttattgggggtgggggtgagttaggattagacgttgggggtttttctttaggggtggggcgctgagaagagcggtaattgtcaagattgtgagcccccttgttcttggatgcagagtggtcattttcgggggacgatatcagggcactggcttcctggaggactttggggtgcgggcgcgcagcgctgtgggtgtgcggggctcccggctttggcgcggcggctttccggaacgcctggctgggaaggaagctctaggcattgtgtggtgtgtttgcagacagaaaggtccctggaccggtgttctcaaaacttactggacttattgtgtaaagctccgggaggaaatgtggcgttggccaggtagaaacgcggcgctgcggccaaggggcggaggacgccaggctcggcaacggccttctcccagccccctcctgccagctccagatccgcgtgcctccagtgttgggaccgttctcagtggcgttgttccctgctggagttaacttgggaggtgaggagggaactttcatcttgaacttgaccccagaagcagcgtcgtccgtacaggttacaaggtaaatggaagctgagtcttaacgtgggttggaccgcaaactctggctggcgcggaaaggaagttcctggttcagaatctttgaggaaagggctcaagattgctgagatcgctcgctctggaaatgccagacacaccagactgcagaagttaatgcgtgtttggaggggtgggggtgggagaggaaaggagaaacctggttagttggcacagagggctggtatttctctgtagtggaaatgaagggagtctgcgtctctgctttcaccagatccgctaccctcttttttccttccttggtcatctttattcctgccaggctggcactcctgaggcaggggaggggaaggagaggaaagcagttgtgaagcttcctgggtcagcctggaggtatttcagatctgctactaggaagattccaggattttaacagctgcttcttgattgctgggaatgaaggagtttatgagcggctgagactacttcattatagaagtagtctgagtgttttactcatctaagctacttaaagacctcacaagggaccttccctagagtatgccagtttctgcagtttgtgtcagccagaatgcttggtgagtgttagtcaaaaagcatcataaatatatcctggtggttctgaaatgaaaagtatgtggcagtaaaggaagtatggtatctgatatccttcaggacttcctcctagggttgttcctgttacctgccaagtgaacttggttcaggcttccggactgttgtgatttgacaataagagatgggaaatagtgtcatcgattttagtggaagcaggaaaagtccacaaataaatttaaggtgagtttttatgaccctgtcttgcacatgtggtgccccaaacttaactttttggcaccaagccttttggtttgaagtgttgctggaacttggaagcaatggttttcctgctttcttggtttaaccaccagaatgcccaaattattataatttat

SEQ ID NO: 96739 - DNA, 1312 bp, Homo sapiens
tataatgactcctgccagcatagctggaggttaactttatgtcgttgtttccattagacatttctaacctaattgtaaagattttgtctcagttgggttgagagtagggttgagagtctcatagaaaaagaaatggctttatttttatctttatgataaaataaagtttgtgttacaggaatacatttacagaagcaaaataaagaagagtgtttatatatttgtggggaggatttgttttagtgtttaaaatagtttggttttcaactgtctcttaaatgcatatttcagtggtggaaaaaccagaacctctccctgccccctttctccccacgttatgaaagtgttcactgtacaaagaactcttaagcctttctgggtcttggttttctcatttttttcatccctaaaatgggattaccttgcatccctaaagttctgtgactctccaaaagtttgagaaatgtaggaattctgaagccagtgctgtaatgttagaacactgctatggggtttataagggcttgatttacacattttatccctaaccctttatttgaataaaccaaggcctagaaagttaaattagacctgtatcatctataaatagttgagttgaacttgaaccagagtcttctgattctccctagtctcttctcctctgtttattcaaacctgccaaacagactaaagttaatatgtggcaatttctcacaatacatttttagggttatatatgagttattttgatttcagaaccccagggttaacatctatgctttgatgtcagggattaaaaacagttcaccaataatggtaataaaactttctcctcaagagagtttcagaaagtcacatgcttcaaactaatcatttgtttattttcaacttcttttttattaagtaggcttcagggtgtaatgtgatttataatccggactagtaacccagacagcattcttaaggaaatcacttctcaaatctgtacctctttttaaaaataaaaaatgaacatatcatttgcctttgatcttggtatctctcagcctaattgcaaagcctgggtgagtattcctttttttggtgtcatcattcttggactgttcctactgatggctggataagtctgattttgcagcactttccatgctaaatacatccttcccttatgctgttgggttgatggtaaagaggtagtaggttgcaggtgacccatttttgctgtgtctctaaatgtttgtgctttgtcctgcttgcctagttagcagcactcactgcagcttgacactcatctggaggctggtattgattt

SEQ ID NO: 96740 - DNA, 1084 bp, Homo sapiens
tatgaaaaagatcatacgtatacggctgctggtattatagctctcaagcctcacatccagaattggcctttttgatgttagttccaatttgggaaagccctggagggaacccgaattggcttgatgccagccaaaggagagttacggttagacccataaaatggggctgtggggagacaaagtatcccacaaagaagagggttattgttaatggaagagggagggagctggatcaacaaaagagctagccagggcagtgtacatttccacaagtggtactgctgatcataacaacataccaaaggatatgaagattcttaatgttgttgtgatgtacacccctgtagtcttgagggcagtggacttgtccacattctgtgggactctgaattgctatgtacacagacatgagggggtattgaattactgctaaaaacgtaagagttggtcattattcccatgtaacccattacactcccctctctctgccatgctttgttctaaattacttgggataagtaacattaattattaatgtttattgagtgccggctgactctgaactacatgtttgaattttaaaagtctgtggatgaaacagtttggttctttcttctcctgttgtcctacatacgtagaatactatggcagggatggtcaccatacaacagcattctgtgttctggtcctccttgcttcttgtggcttaacaacaactgtttatttgcttgggattcagaaatgggggccaggttccctgtgcctaggctcactggtgccgtggtggttacatgattcattgagggccattgctgcaatagtttacaacattataaccatccttgatacctatggaagattggttccaggattcccacggatactaaaatcctcaaatgcttaagtcccttattaaaaatcatgtattatttgcatatagcttatgcataccctcatatatatatattttttaattttattatttcgagacagagtctcactctgttacccaggctggagcacagtggtacaatctcagctactgcaacctttgcctcccgggttcaagtgattctcctgcctc

SEQ ID NO: 96741 - DNA, 1034 bp, Homo sapiens
aatgcctgcagatagtgagctgtctgcaactaccacaaagcaaaatcatgggcgataactccccagggtaggatctggcctgagcatccccactgggagatgggaggtgatgggctctgtagtgcttagctgaatagagttatctatgtcagtattccctctatgcaaagatagttgagagttcacaagttgtaggctttcaagttgagctatgttagatatatgctcccctgatggaagacagacatgtctccagggttttgagggtcaaatgacagaatgtatataaagtgttttgaacattataaattgcctccttagaggcaagggaacatcaaatttggttgttttcttgcatcagagacttctagctcagatttctttgttggccatttttaagggcatttccaatgagtttttaagtgtaatgagtttttaagtgttggggttcttaaatggaatatgatataatttttttcagatgaactgcagatattacttaaaatcttgctgtgaaactttcacctgtggagtaagtagaattcatgattaaggtgaatctcttttgggatccagttcagtttttccaaaggatctgtttataagcataggaccacttagctgagtgtggttgctcatgcctataattctagtactttgggaggctgaggtaggaggatctcttgagccaaggaatttcagaccagcctgggcaacataggaagtctctgtctctacaaaatttttttttaaaaattagccaggcatggtggtaccatgcctgtggtctcagctacgtgggagactgaggtgggagggtcgcttgagcctgggaggttgaggctgcagttagctgtgattacagcactgcattctagccttggcgacagagcaagtccttatctcaaaaaaaaaagaaaaaagaaaaaaaaaaacttaccgttttcataaagatgggaatctgtggggcttttatttctggtcctggaaaccctaagtaccaactgaaagactcaaaagagctttgatttcaa

SEQ ID NO: 96742 - DNA, 1002 bp, Homo sapiens
gacacaggagaaagttggcttgctcactggttggtttactcagtcacttaacaggagccaattgagcccccactctatgccaggctctgtgctaagtgctagtctaattcagccctcttgaaggccttaagagagagcaggcattctttcttcctacctcatggggtttttgcaggtgaggctctgtacctacctccaggtctcatggcaggtcgactggacccctgccacctcctgcggtgctgccctcctcacccactccttgcccactctcactatcggcttcctaataggcatttcctggggcgactgtatctgactaaaattggtcattttgtagatcctttaggggtcctggtccaaaggtcagttttaatgagtgatatggggactgtggagttgcagggtggggagagaaatgtggaccataactgacagtgttcacagggagagcacactgggggaaataagcctcactattgcagctgctgagactgcacgtctagttcattttgaatggcccctcaaagataccccctgaggatgctaaatgcagatttgtggatgctgttggcagaatttgcttgtttataatacttttttggggggtgctgggcaaggtcgctcatgcctataatttcagtactttgggatctcacctggctccaccatgatttgggaacaggcatttaagtttagcaattcaggccaggcacagtggctcacgcctgcagtcccagcactgtgggaggctgaggtgggaggattgcttgagctcaggagtttgagagcagcctggcaacgtagtgagacctcatctctactaaaagttaaaaaaaaaaatcagctgaacgtggtggctcatgcctatagtcccagccacttggaaggctgaggtgggagaatcacttgagcctgcaagatcgaggctgcactgagctatgattgtgccactgcattccagcttaggcaacagagcaagactcagtctcaaaaaaaaaa

SEQ ID NO: 96743 - DNA, 1035 bp, Homo sapiens
gataaatttcttcacggccttagtttcttcatctgtaaaatggggattttttttttttttggagacggattctcgcactgtcacaggggctggtgtgcagtgatacaatctcggttcactgcaacctccacctcccgggttcaagcgattctcctgcctcagcctcctgagtagctggggttacaggcccctgccaccacgcctggctaattttttgtatttttagtagagatggggtttcactatgttggccaggctggtcttgcactcctgacctcgtgatctgcccgcctgacctcgtgatctgcccgcctcagcctcccaaagtgctgggattacaggcgtgagccacagcacccggccaaaatggggatcattttacaaggtgagaaataatgtttgtacagtacttttagagtagctcctagcacataatagatgttcagaagttcccttcttgtttgattcagcaggaactaaattgtatcaaactgtaggcagtttgatgaataagatgtggtttctatcctggaggaacttaaaatctaatgggctaggctgacacatgaattcatcctgaggaggttaagtgccaagacccaggttgaggctggagcagagcacaggagcatttcctctgcctggagggttgggagagccttctgggaggaggttatgcctaagccctgtcttgagggattgagtaagaattcacttaagcaagcaaggtgggatgggttgtagccaaagcaacagcatgagcaatggatggagtatttaggaggactacatgcagttgggggttggctggatggaacagtgtgaagtaggaattcctaggaaatgagcctagagagcctggtgagtgtgaacttgctggtgggccttgtgtaccttgctgaagaattcagggttatgggctgagtgctgtggctcacacctgtaatcccagctctttgggaggccagggtgggcggattgcttgagctcaggagtttgagaacagcctgggcaacatggcaaaccctcgtctct

SEQ ID NO: 96744 - DNA, 2271 bp, Homo sapiens
tcccttgggtttggctaaagaggagggttgcagaaaattgagggtgcggcaagggggtgattggtggtggagtccacactgtgggaatgaagaaggggacatactcaagggacatccgagagcaaggacctcaggagggagggggtgtgcgagccggaaggataggaggctgtggtcatgaagcaagagtatggaaatacggcttctgactgaggtgtgaccctggaaatggctggccagagtcaagagccagggatcagagcttaagtgcaggcgtaatgagaacatctgccatcactgaccctgcgctggacactgccctaagtgctttggactattcattcaacccagccccacaaataggtactcttatttattgccatttacaggtgaggcagctgaggcccagagaggtgaagtaattgctcagggtcatggagttaataaatggtggagcggagcttctaacccaggttgtctcctctgctcttgttcctttaggagctgactgctgggcaggaacgtctctcaggagaaagagtggaagagaaaattgtgaactaaggccccctgcccccttttcctggtgcatgtgaagttatcaaaaacaggtaggtgatggctgaggattggggtagagtgtggtatgactgtgagtagtgactcaaagagggatgaatctttacatgaggttagaagagagatggcctgtagaacgtccagtctttccacctgcccagagccactggtgagccagcgcctccaggggagagaagccctgtcaaaagcagagataggggagttagtgtttaatgagtacagagtttcagttggggaagacaaaaaacttgtataggtggatggtgctgatggttgcagaaggacgtgcttagtgctactgaactatatacttaaaaatggttaaaacggtaaattttatgtctattttatcacaatgaaaaataaaaacgtggtggagggagggagtaataatcactaccatttatgaaaccctttcctggttcattgtcacttattaaatatttgaatgtgtgctggggattttgttaagtgctttatgtgtattttcatttaatcctcactttcagagatgaggtaaactctgctgtacagatgaggaatctcaggtttaaccagattaggcaacttgcccaaggtcatacatccagaaatggtaggggctgggctcaaccagatcctcacactccaaagcccttgcttgtaattgttagggaattgaacagtggacagaaggttccagaggctgtgggggaagggagagggggttgttgatggagggaggacctgggatagggaaatgctgggtgaaaagaggagggttggggatagaggagcagctagaccaaaggaatgagaagtcggatggacaggaccatcctccagtgtccagactgggcatgtgctgtcatggaactggcaaaaagtccaagtgacaccaacttgttctcagaaaggggctggaggttatggagaagtgggagagcccagcgtggggtgtgccagtgtgatccaaagaaagtcttgtcagcagaggattcttcccagactgggacctgcggccggaggggctggcggtatggacagtgtggacatgagttcagcctgggtgcctcttctcatcttcctcctgaatgccctttcttcctgctggcctgcccgaggggacccaggctgcccattgagcctgaagtcagcaagctgatcgtgaatttaggtgcatgaacgtagggagggggtggcagtgaggaggactgaatatctttctaatgctgacagaccaaatgccaagggtgagggtaaatcatgaccaattacctggctttgtagatgatcagcaaactgcaaatattttgccacagattttctttgtttttagcagaatggtatgaaatgcatacatgaggaaataaattttatctgactccttcacagagattttgaggttgtaacctgtaacttctaaggcgtggccagtggtatttgtgatcctctgggtgcagatgtgggtttgtctcagatatttgggtttagtgaggcgtttgtgagctgctgaggagggaaatgccctctcgagagtttctgttaccttcatgtgtttactttagattcagcaggattcttttactgtcttgctggtggttctacaatctgtgctaaaagcaggctgcctgagcagtgctttctgtgtaatagaggtgaccatggagagcgtggttctgtgattatata

SEQ ID NO: 96745 - DNA, 1034 bp, Homo sapiens
atctctacaaaaaatacaaaaattagctggacatggtggcttgcgcctatagtgcaagctactgaggctgaggtgggaggatcacctgagcccaggaggcggagattgcagtgagctgagatcacaccactgcactccaacctgggtgaaagagtaagaccttgtctcaaaaaaaagtaaaatttctgtatctattaatgctagtttttataattcattttattaaaaataaatataattttatgatataattttataattttgttatgaggattaaatgagaaagaacttagaacagtgtacagcacttagaaccatgtaagtgctatacatgtttgaaaatttgcctggtctattctgagaccactacaaaaacaaaattgaaaaagaaaaaaaaagaaaattgtccttgaatgtcatttattttttaggatatttgatggcttacttggttttaatttttaagtaaaggccaaaaaatttttttttaaactatggagatgtctttaagactagacctgaataagaaaatgtaattcaagatacaacaggaaggccaaatgaggtctgatttttagtaattagaatgttatggccgggcgcagtgacttacacctgtaatcccaacaccttgggaggccgaggcccatggattgcttgagtccaggagttcgagactggccctggctaacatggtaaaacccccgtctctactgaaaatacaaaaattagccaggagtggtggtgcacacctgtagtcccagctactccggaggctgaggcagaagatcgcttgaaactgggaggcggaggttgcagtgagccaagatggtgctgctgcactccagcctgggtgacagagtgagacttagtctcaaaaaaaaaaaaaaaaaaaagaatgtcacattacaatctgaacactacattaatacaaaatattttataaaccaaacaactagaatacaaacttttagtaggaattatccacacaggaccaagaaaagtatattaggagaaagtgttattgtttggta

SEQ ID NO: 96746 - DNA, 1219 bp, Homo sapiens
tgctggcaaaccctggggtctgcctcacattgtttgtacagtaaagaaagatttaatactgacacgtggctctagtttacagattctaatctgccaaatcctatttcaaggatgtggacggacaggagactacattcagaactatgtgcttatagaaatgaatgaaaggcttttttttttttttttaatgaaagcctttaaaattttttctctgaatgaccttagacagatcactcattcacactggatcttaatttcttatctaaaaatgaaggaaaggtttattggaataatctcctaaagaccattctgcttttgaatctgtccattttggtttttttctttcttttggtttttgttttgagacagggtcttgctttgtcgcccaagctggggttgaatgagtccgttgtgaagagctgaggatggaaggtgatgttatttaatactatccccatgagtgttctggggctttacatacaatagttgctttaatcctgcattattcattcactctataaatcacacctatgagtttaggatatcaccatccccattttacagatgagagtgagtaacagggacaagttcatttaagtactactagttagtgcttgaggtggaatacattgaccaatggctgtaataatgatatcagtgagtcattgtaaggtttacatgaaatgaaaaaagtcattgttttgggtattagaattgttctggtttttctctttctttctgttttctcacagattacttggaagtaaaacaacaacaacaacaaaaaaaaaccttttttaaagatagtaagatctcaaatctactcctcaaagaggaaacactcagtgtttggattctttggatctgatgggggcaggcaataaatggtaggtcagttttccctgtctgaattctgaaccagttctgagagacaaggagaaagaaaacatgtggaattcaaattacaccttaaatttttttttttttttttttttttgccaagacaaggtctcactctgttgcccaagctggagtacagtagcaggatcatagctcactgcatcctcaaggtcctggcctcaagccatcttccctccttagcctcctgagtaattgggaccacaggtgcacaccaccatgcctggtcaaattgcacctttttaagatgatagaactaatatcagagactttgacttacatttttaaaaaaatgattttt

SEQ ID NO: 96747 - DNA, 2042 bp, Homo sapiens
gtgtttcctaaagccagcatcattcagaataaattattttcttttacttgagataccagcttttctaaaagtgaaattggattaaaaacaaacaacaacaaaaaaccctaaccttgttgctgaggccagtgctgctgctgtttctattttagtagaagtcaaagtaaaatattctggcatgtattattcactccgtgctctaagaaagtccctgtacatgattgtgccgatagcaatgtctttcagaacccaaattcaaacacgtgcctctggaaccttaaaataccttggcactctatttttttttttttgagatggtggatagatggaagacttcatgtaaacagaaactgcccctctctattgtggcggttgaagtctctgccacacaagagacccagttttaaagttgtgctttccctcacacagttttttcctaataggaatggaagatactgagactgaaaatttctgtgggcaactgacttgtcaatttctgaagtaacatttttatttaacaaggagtaaaacaaatttgcccaactaaattattcagaggaattacaaaacttgtcacttagagtggatgttgggatattcaggtcatttaggaggctgtggttaaaaataaaatgacctaaatataaagctctactttttttaaaaaagggaattttgagcttttaatttttgtttgacattgttcctaattctgtttctgtggggggatgtaggaggctactctttcggtgttccaaataaagaaaaattcttctcttcttgttggtagttttgcatggtatttatgtagctctattttttagccagggtatataaattctgtattctttttgatatattagggggatgtatgtgtgtgatggagaaattggagaaggtcataaacaaatgactctcttccaagaaaaattgaagacaattcattaattgttctggtcattctttttgtacttttaagcaaggagcatttgaaatatgaacttgccccaatctgcttttgggcaataattggagcataaaatgttgaaaatcaattatgtatttagggaggatgaaacaggctgacatattgaaggcatattgtattatgtttggtgcactaaccaggacagttacgtcatattcctgcagtcaaattgtgtctcgagagggtgagacacagaggatcacacatcctgatgtactcaaacttcacagaacatgagagtatttataataggcctgccatctgtcctgggaacgagtcctatcttaaaaattggctatgcatttgttgttattgttgactgataagcacagagtttgatatttttgtattatacatgcttatacctgatttatagcagtgtgataatttcacaatgcattatgagttccccatgctggctagggggtaagatctttgcaggagagggtagacagagttttagatttctcccgtaaccccaatgtgcctgacacagtaccgacggtctatatccccagttgtagatttgcaggagatttgcagaatattgtcttgtgtcctcctgataggagaggcacccgaggactgggttgtgttgtctgaggtcacataattggtaagcagctgtattagttgctagggtggctataaccaggtaccagaaagtagatggcttgaataacagaaatgtattgtctcagagttatacagaggctggaagtcccagatcaagctgttggcagagctggttctttcctaggctccgggagggatctgtcctgggcctcgctccttgacttgtagagggccatcttctccctgtatctcttcatgccatcttctgtctgtgcctatgtccaaatttctcctttttaaaaagacaccagttaaattggattagggcccaccctaatgacttcattttaacttgattacctctgtataaagaatctatctctaaataaggtcacattctgaggtattgggtgttaaaactttgtattagtccattttcacactgctgataaagacatacctgagactgggcaattta

SEQ ID NO: 96748 - DNA, 1352 bp, Homo sapiens
caatttactgaattagtccattttcacactgctgataaagacatacccaagactgagcagtttacaaaagaaagagatttaattggacttttccatgtgactgaggaactctcacaatcatggcggaaggtaagaaggaacaagtcccatcttatatggattgcagcaggcaaagagaaaatgaggaagatgcaaaagcagaaacccctaataaaacaatcagatctcatgagacttattcactaccacaagaacagtatgggggaacgacccccatgattcaattatctcccactgagtctctcccacaacacgtgggaattatgggagtacaattcaaggtgagatttgggtggggacacagagccaaaccatattagactttgacatgaattttggggacacacaattcaaccctaacagcaaagatctggggtcacagtctctttctgtctcctaattcagtaccttcctctgccctgtttaataagtatttttttttagtttatatgcagcttggtcaaaattttttgtttttttttttgagatggagtctcgctctgtcacccagggtggagtgcagtggtgtgatcttggctcactgcatgctctgcctcccgggttcatgccattttcctgcctcagcctcccaagtagctgggactacaggtgccccccaccacgcctggctaattttttgtatttttagtagagacagggtttcactgtgttagccaggatggtctcgatctcctgaccttgtgatctgcccgccttggcctcccaaagtgctgggattacaggtgtgagccactgcacccagcctagctaggccaaattttctagtcaaagaaatatctactcctcttcttatatttccttccattgctggtttatggattgaaatatttttcttagatggtgacagttttgcttgaggctgtttttcagtgattttaaaaaaatttatctccgccctgtttgatcctaggagtataaaagtaattgctatttgatgtacacattgtttttaaagaggcataaactgcataccttgcctatgatcttttcccttttagtctttttggaacacttctttggcgccctaacaggggaaaatgatcagtgtttgagggtttattatatgggacatacagccacctggggagttgggaccttaactgttaggcaacggtggaaatcaagctgccaggtagttcttgagtttgggttggtactcagaatgtaatatttataagataaaagatattatattctctcactttgaattaccaatagtattttaaggaaccttttatgccaaacagcatttgtgccaaaaagacatcagt

SEQ ID NO: 96749 - DNA, 1035 bp, Homo sapiens
aggtttcaggacaatctttttcttatccagacccctcagcagttggtacttctgggcagttgtccacttgtttggacctggaggcagggtcttgatgatctttgcttccctaactgcagcttgctttctttctgtttttttttttttttttttttttttttttttttgaggcagagtcttgctctgtcacccagtctggagtgcagtggcatgatctctgctcacaaagtagctgggactacaggtgcgtgccaccatgtctggctgagttttgtattttttgatagagacggggtttcgacatgttggccaggctggtcccaaactcctggcttcagcctcccgaagtgttgggatttcaggggtgcagctgcagctttcatatagcaatggtcagtaaatgcatgctgagcaaaagtcttgaaagcactcatgacttctttccaagcgctgccaagagttcacagaaaatctaatttaacacaaaataaaactagtcgattttgagaggattgtatcttttcatgtagaacttcgtaatttattgtttcattacggactcctttgaattaacaattctgactagaataggactttattttttatttttatttttgagatggagtctcgttctatcggctaggctggagtgcagtggcacgatctcagctcactgcaacctctgcctcccgggttcaagtctcctgcctcagcctcctgagtaggtgggattacaggcacatgccaccacacccagccaatttttgtatttttcgtagagacagggtttcgccttgttggccaggctggtcttgaactcctggcctcaagtaatccacctgccttggcctcccgaagtgctgggattacaggtatgattataggtgtgagccactgcacctggccttagaataggactttaaagtgattttttttttccttcagaaaaagtcccaccaaagaaatttaaatatatgctgtgtgtaacacatacaaacctaaacttcttttttttcaataacagccgcagcattt

SEQ ID NO: 96750 - DNA, 1046 bp, Homo sapiens
ttgttggggttttgtttttgacattttttgacagctaagatcaagatctcatgacttgtgttctggccagaggaccctcagctttttgtgatgagtcatttcctaatgcatccggaggcactgggcttggaacccccatctcagagttgggggcagcagatccagccactgcagctgggagggagtccaggtgtcaggaggaaggggctgaggtcttcagggctggtggctcagggtatatgagtagcctgacacaggcacccatgtccccagaccttctctggccatatggagtcagagtgacctccagtcccctggaagattgccaagagcaaggcagctcctcagcccctgaggagttagcagcagattatccagagagggtctcaggctccttatcagaactgagctagagggtgatttaggcctgtggaatgcaggagcaagaaagccaagttactggatacaaggtcagggcctgcctgttaagcagcaagagcaacttagccagagctatttaaatctctatcttagaaattcccgctgggttgagccagcaaggggagtgtgggggcaagggttaagaggcttcagctgtggggaaggaagggccatggacactgaaaacaacaggccaggcctggatgtcctgacagcctagacctaaatagagaggtttttagtgtcctggtaggtcatttcagcctgcttgcaagtgaatgggtcttagggtgtaaggtacatattcaatcatgagcttgaaaactgagaattacttatgtgaatctggaagtggatgtagttttaaattcaatttagacaaaacaaattcctcaatttttcccaagtgtaaattataaccctatattacagaactgtcagttaaattcatgaaagtactctttaccaagcctgaagcaaattggtgcttttgagtgctattacttatcgagaaataaatatataaatcagaaagctgagctttggaaaaaagaaataaatatgaagtcacccaataatccattctgagtagatgaatgattaaa

SEQ ID NO: 96751 - DNA, 1033 bp, Homo sapiens
cacctgtctcaaatatgaaatgtggcattttgtttttgtacattgtctgtcacagtaaatatctagagtctgtctcctgtcatgccaggcctggtttttgtagatagtaatttggtggtgatggacattcttgataaatagggcttttacagactattctgaaaatgaatcatgggacttgcctttaattgctagcagtggcgtgtatgtgacatactcgctcctgctaatgtgtgccaatcagtaagttactgtttaattttctgaattttatgggatgatgcggtaagaaggcactccccagaagtgggcccctcgatcttggacttcccagcttccagaactgtgagccaaatagaagtttataaacaaacttctattgtttataaattaccatctccatgatattctgtgacaaaagtacaaaatggactaagacaagggatctgtgaacttgaatgggtggagaaaaactcaactgtattttcactaacctctagccaaaatatagccattgcttcaatcatgaaagtgggcaaccaaccatgtaagatcaacaggacatgtaactttgtcacatggaaattaactgatttttgtatcatattgtggaaatagtttaaaatacatttatgcccatcgctgctttaaaaactgcagtagttataaaacctgctgctgtgtcttatttatgcgttaagcatactttagtgtatcaggtttgctttttgaacattttgctatctgtgtttcaatataattagttttctttgtaataagactgtctacttaaaaatcattcaaaaacactctgagggtacagattgctgaagccatccatggaacttaaaaggttacagattcatgccttggatatggcacccttgtgtctttctcatcctcatttgagactagatttgttaacattaaacctgaattttttttttttaagtcttaacatatttggcctttgttttctagcatgccttgtctgtgacttttatcatctggagctctggtattccccttttgg

SEQ ID NO: 96752 - DNA, 1034 bp, Homo sapiens
taactgtcataaggaggattgggacttgggtttccggttgccctaaaccttacacaaagaaagactctatggccctagccacgccttctactgagttatgtgagaggaggagaccacgatcagactgtggttcatactcaaaccctaggtggttctccaggagctttttagctgcatggctactgggtccctgaggtgatgctggtatccataactgctacactttcatcctcatgcaaagcctccctttctttgaggcgtgtattctgtgctgtcctgatcacctccctattccccctaccctcagttcattgaggactttggaggcagctattcagtgcctgagctttcaagtcaggcctgggttcacatcacagatttgcctttactaatcctgtgggctttatcattgtctggaattgttccacatccaaattttaaaaattctttaaaaagaaccagactctttcaacttcctcattcatttattccgactgtgtttgttctttgatctctttgagacaccatactttttctctctggctatcctacctctcagggcttcattcccttcctgaccagccttgatttcacagcacaccactctgagcactcctgtactggcccctgcactgtgaactcctgatcattgatcagatcctgcattctctggaccatccctggatggttcttggggctgagagtcagagaagggaattgcacagcatagcttatttatttatttatttatttattttagcccaagtgctgtttatttaaaagaacaaaaaagagtggaggccccctagggacggatgaaacaaaactagcagtgcaagtctgcctctagctcagcataaaagcttgttgccccactgggccatcttgttgttgataggcatcttcaagaagcagtcagactgcatgtaggcagcaattttctccaaagcctcaacggcacatgaaagccttaagatgtgggaactcatccaggcacttgggctcaaacatgcacttttgatccaggacgtcat

SEQ ID NO: 96753 - DNA, 1005 bp, Homo sapiens
aaattggaaaacaaatactttgctggggtggggagcaaggcagggtctgaccattcagaggcccaaagcctggtgaaggaagcaggtgtataaacaattaaaataagatgaagaaggcttcgaagatgaggtgattctgtggtgtgttttgaagtgggtgggcttatgaaattcttttgctttctctaatatatctaaacatctatgtaaatacctggatgatatacagtactagtgacaatattggagttttgtcttctagttagccgtgttttgctgctgtggtagggaggtaagtctcagctagggagcactcaggtgacagggaaatgaagacagggaactcctgcctgtaagtgagcaggagctctctgcaagactgagctctgccttgcacagtagccattggcctgggagacatcatgattattgctggaaatgctgccctttctgaacccttcctttttttgaaggagagtgtattgatttcagatttttggctactgtctttgcacttatcccttctgtgtgcctatttgaaatacccaaataaaacctacctgcagccagtgcttctgaaagcctgttatttgaacagatcttactgtgttaaatgtgcacttcttcatgtatacaccaaattattttgaccataaagttgggaattagtacttggtaccagaattcttaaattattagtccaaactccttgttggaagagaattgccgttgattttgatttcccttccataataaccctgccactcatttaaagactttttttttagtgtttgttgtgtgtaaggtacattgctagatgccatgggggatttgtggagttcaacatttttcaccataattttgatctatcatcatattagaacaaggcaggatgtagaattagagaaaacatatcttttgaccattgtggcctgagaaggctttatggaagaaatggtgttagaatttggattgaacaaatccctttacaggtatatgaagatg

SEQ ID NO: 96754 - DNA, 1190 bp, Homo sapiens
atctgaagtgtttttgcttaggacaaaactataaagaatagaatagtagaatagagttcagcttgtagaatgggttgttgaataaagaatgaatgactggatctatgtgtcttagagaataaattatagtttaatgtcatattttccagctatgcaaattaagaaaaaccagactaggtgctgtacttcatgcctataatccctgtgctttgggaggccgaagtaagagaattacttgagcccaggagtttagagaccagcctgggcaacctaatgagacctccatctctatgaaaaaataagcagctgggcttggtggtacatgcctgtagtcccagctactctggaggctgagatgggaagatagcctgagcctgagaagacaagactgcagtgaactgtcactgtcatggtgccattgcattccagcctgggcaacagagtaagactctcttaaaaaaaaccaaatatataaaaaaaaaagaagaaccaaaggccaattctttacttatcacaattatttacgggttgttctagccatcccccgcaccctgacacacttttctggatgaagcatctggatcctggagaagttccgttagttgtttccagtcatattggcaaggtctctgtcaattcctaggatttctctactaaagtgagggaaagtgtgagagaaatcttggaatgtcaaaaactcatcaagggctggtttttcccagcctcctaggatctcctaggagtgatgagacatggctcttgctttcaggaaatttctgtgtacagggttttccatgagtttctagataacagccagtgtaccatctagcagacctctttgtgtgtgtgtgtgtgtgtgtgtgtgtgtgtgtgtgtgtgtggttttttgttgttgttgttttttttttttggtctcttacgctttgttttttcttatttgctttagtctgtattatttattttgtaggctgcttcagactccctgctaccaccaccactttcttgttgctaatatgaagaacagttctaaaggtgttatacagaaggcatgactgttagttacgtgagtcagactaactacgttttaagaacttttcaagcttctaacacagaggatgtttttgatgcttctttgaagcaaagaagaaaaatgtcttaattaagtgtaccttagtttacagtgtttcact

SEQ ID NO: 96755 - DNA, 1032 bp, Homo sapiens
ccacttaatgccagactgcttgttttcattataatgagaactacttaatttggcttgaatttcattcttgtttgtagagttctggtgcatattgtcactgtgactttaatagcattacattccttgtgctaacctattctaggattattttggtgaatactcactggtacaccatttttctctcgctagaaaaactatatattgtctacctgtattgcacaataaaaatatgttagcatgaattgacttgcctgaaatgttacatttcactctgtaaacccatgttaatccagtctccttggagaatgactggttttctgagttactatgtcaaataatgtttcagttttaatttctgttttaagaagtatgtttattactaaagcatcataaaattatggttaactctttaattcaaaagatcttgcaatgccttgtgataatattaatgtctgttgtttccatacttatataagagaataagtggatttctaacgtttttggttatatagaacctagacaaaatttatttttattgctaattatcccttaaaccaagtctgcaaaatgacaaactcaccttaaaagtagagcctttattgcaaggctgctgttaaagcttctcatcaatgcctgggtgagcagacaccaaagaaaaggagaaaccagtttttaatgacctaaacaggagaccatagttaaccttagaaaatcaacccctggctttgaataattgattagaattgttactctggagaaatttcgttcacagaatttccatccagggggacattcaccctctgctgggtcaagaccaaaatgtctttcttgttagttttctgaaagctgtttaaaaataataacaacaaaaaactttttcagttttggctcatctgtcaccaatcatgggaactttatttgcttctttagaagcctttgtaatttccagcataaagttacctcctaagctgtctgttggggtggaactgccaaccagtgggttatttttctcaggaccagggtccccaagcc

SEQ ID NO: 96756 - DNA, 1099 bp, Homo sapiens
gattgcttgagcctggaaagtcgaggttgcagtgagctgtgatcacaccatcacactccagcccaagtgacagagtagtaagaccttgtctccacaaaaaaaagaaaatagaaaacactcataatacttacaagcaaataacccaagatattctgtattttttgctttatcttttttaaatacaatgtcatttttttgtataaaaaaaagcctaagattttattgtaccaatgtaccatggttttatttgggcccattttgtttccatatttttttcatttaaaaaaccgtctggaaaatacatacctttgtatgaattttattttagaatatgttttcaagcatggagttaatagggaaaggaaatgaactttttataagctgttagtgcctcttgccaaattgttttctagaaagctcatgttggttgccacctgtgtaagcagtatgtgaatgtgcctgcttgcacaattcctattactagggggtatttgtgggttttagtaatctttgtcacttttataggttaaaacttgcacttcattgtttttaattagcatttctttgagattggtagacctcttccagtatttattgctctgttacatttcttcttcaatgattgtctttttcatgcccttgtacttgtttttttctgttgggattgtgaggggcttgttagtcttgttcttcccttttcctaatctggctgttgtgtatagtaatgcaaattttctatatgacttatccagaaagcttcttggggaatttttactgaagtcgctgatggtgaaactgcctatgttctataggtaaaagtttctctgcgttgttaacatttcatgtttgtgctgaggctagagatccactagtctgattggcttatattcaagaatttataaagaaaccaaaataaaagcataaaagcaaccccattgagtcatcaagccatccacagtacttgataacattctgtctttgtgcacagccaaagatgtcaaagttcctcctctacccagatgtgctggaagcctgactcctggtaagttcccaacagtagatggggatagttccagcaacatttccttaataaattgct

SEQ ID NO: 96757 - DNA, 1037 bp, Homo sapiens
ttccagagcccacctgctgcccagccctgccctgcccagccaagccataccctgctctgccccatctgggggtgccctgctcagagatgggccagcagggctatactcagcctccctagtaaacagagactaaagaaacctctggggtcctgttttctggtcgtgtgatcccaggggtgcacacaggccccttgggtgtctgaacagaagggcatgggagagagggccacacccctgcagtcttgctctgctggtgtagcgggcagctgcccactgccacccaaccctgtaccgagggctcctgagtcagcagattaagtattttgtaaattgtatttaaaatacatgttttaaacttgttaaaaaaaaaaaaaagacggtgcttagaacagtgcctgaaccacagtaagcatcttacaaatgtttgcttttattataatttaggtaatttctataccattttggcttgcttttctgctcctttacactctccttttgaccttggtaagtggtggcatctaggatatttttgtttcctagctcacttgtctgtgtggcaaacatgaccctcgcctttccatctggagcagatgggggaaaaagccatggtaataggcatgtccttagcagagtgctgtagggaccgttgctgtaaacaggcttggggtatatgtgttcactaggagacagaagggggcagggatatgaggcctgaatgcagggacctaaaaccagaaacctgtgtgtcttcaaagatgcatgcacattcaaagagtcagtgttcacctttggctttacaagaatgggctctactgtaattgtgtagtgcagtgattcctaaacctggctggttcacctaggcccttgtgactcaaattcccttaagacctaccgaatttagtgttggggtccaagcatctatttttatttatatttttattctttatttatttaagacagagtcttgctttgtctcccaggctggagtacattggcacaatctcagctcactgcaacctccaccacctgggttcaag

SEQ ID NO: 96758 - DNA, 1911 bp, Homo sapiens
gaggataagtggcctctggcagtaatctcagggcttggtgagtaattgggatggagaatggctttagcagtggggtatcctgtggttagttgttgtccctgggttggcctcattgcacagctccgggggcactattaacatagacgtgacaggtgcagcatggtggtccactactgttgtcatttctcatgtcaccttcaagaaagtgctgtgaaaaaaatgtggagttctctgttattataaattaagagggtgtatttggattttttttttttgagaaagtttaatgttaaagcattaactggttgagattgcagatagctggggcagtgaggctccttttaagtgctttgaagcacctagggtgaggcactagatcttggaccctgcagtgtctgtagggtgaagctgatccagaacttcattgtgagaacaatcaataggaaagaccatctgacattagagagatctgggatatggtcagttggagctacatggacaagggcaagtgtgtggcaggcagactgagcaacaacagtgggcatagctcgaggtgcctgaataggggaaaagtgagaccttcctggaagaggactcatgacagcaggagcctcaagaacttggcaggtgtccaatgtggcagcttgcaggggaacctctggaaataaagggagatggatacaaatttgagtttcaaataaatgttcactggaaaataaagtatattttattttataaaacatgtcagaatatatgtcaaactgaaaatgtaaaaggaaggggaaaaaaccgttcatacttccactcccttcaaaataaccaccatcatcttactgactgccttcgaacttttgggtcatgtatcttacttatttttccattataaaagattgtgtatactagcttaaatgttttttctacatgtttttgaaaatgttcatatggtaaactgattttttttttttaatttgagttccttggcaatgaaaacagtcattgtggtgttccgtgctactctgcttgtttagaggggtgggtgggggtaaagagagctttccttgcccagcatcccaatcgtgaaaaatgtaagctattgttagcgagttctggcaggcagcatcagttattgctttaagggtctccagataaagtaagagattctttctgcactgtggggtgaaggatgtggttcaaaaagcccgttcctgaaagagaaggctgtggaagaggggcagttgagtgaagtgctggaaggccaggattggtttatacagtttcttatattttttaaaaaccataatgtccccactgttgagtagtggattctgttttttctctgaaggaacttgtttctttcagaaggataaatgggttgtacattttctgagcttttgagtatctgagaatgttttctggttgatatcatgtataatagcctggtgcagttttagaagatttggccgtgctttttttctccctcaagttttgtagatgttgctttttttgtttttccgtttttttttttttttgtcgttgtttgttgtttgtttgttttgtttttgttttttttttgacacagggtctccttttgttgcccaggctgctgtacagtggcacaatcacagttcacttcagcctcaacctcctgggctcaagtggtcctcctacctttgcctcccacagggttgggattacaggtgtgagccaccacacctggccaatgttgcttttttgatttcaggctttcggtgttggacgggaggggacaagggttgtgggtgaaattgtgttcaccaaaaaggtacattgaagtctcaacccttgatacctgttaaagtgatcctgtttggaaatttgctcgttgcagatgtcaggaagttcagatgaagtcacgctaggttagggtgggtc

SEQ ID NO: 96759 - DNA, 1023 bp, Homo sapiens
cttctgtggctctcggtcctggctgcacagtaaaatcacttggtgagctttaaggaccatcacctgtgccattttcccaaccagttaaaacagcctcgctcggcagggatcgggggtccctctgtgtggagggtgttggaaactgaatcaggtgtagcatcagtaggcctggcagagccacggaattcaagctgcagtgtgttccacaggactggtagacctggacaagtctgtgctggcaaggaaatgtagaatcccaaattccatgcagattgacggtgaatcctgccaggttgccttccaccacagctagctcgtgacttcacccttcattgggccaggcagaatgaccggagccagcgccactgtgctgcagaagcagcaggcccaaatgctgcaagagttaataaatgtccagtacccacggagaggagaggaaactagggtgcttgatgactaaacacctatcctggatccacttcgcttgtatggtgacagcatgaggtgtgactgagagaagattaatgatcactgggcctgggtacctcccaaaaggagtgctgcaggagtgctgtggagctaattaaccagccggcatgaaaagtgaaaatagacgagggaacagggtgtttttttgttttttttttcttcccctctgtggtggcccagtactgtgcgtagacctacatatactatttttggttttccttcttaagtatgcaaaatgacataatgttgaaagcctttctcagtagccttctccaaggggagcaatactgagacagtggactctggatcccgctgcctgggttcagactcagctctgatatatgccagagtggccttgggcaagatacttgatcctttctgtgcctcagtttcttcatctgaaaagggggctaatagcaatgcctaatttgtggcgtggctgtgaagattaagtttaaataatatatgtataatgcacccagaaccctgtcctggcacctaatacatctaaaaaataaaaagagcatttatttt

SEQ ID NO: 96760 - DNA, 1096 bp, Homo sapiens
gtggcacaataaatggaaatcttatttcctgcctctgcagacctatttacctgagtgtctaagtgcacccttgcctttctcaggccttcccttcctgaaatatgcttttactttcatctccttgccttcgttgccctcattttttaaagctgtctctaatgctgcactctatgtactttaatctgtgatgttggatgttgccattctgcatagctgcctttaaacattcatctcccagattgacattttcttccattatgaattgaaatcccttttcacagcctgtaatggtaaaaacattttaaaataaagaactgttatcaaaagccatttctgccaatttaaaacgccttattggatggctttattccctttgataattttgttatctttgcaaactatgactttgacttacttgtatgcgtatatatttttatttattacgaacagagaggttcttatagatgtctgtgtgtccccttgccctttctggacttttatttttggacttaagggaattgatgattttaaaagaagcaaaggagtgtgtgtgtatgagtgacagaggctatatgtaacctgcaaagtctgaaatatttactgtcataccctttgtagcaaagtgtgctgacgccttatgtatttaaaatactcactaaaaatgtgtcgttttggggatctctatctttttccccaaattaaagctcttaaacgtgtgaagtggtgagaatgttagagcctgagctgaccggttgtggggaggttctagctgtgatccctgttcctcagggttaccttccaggccccagtctcccatctgagacagtgtgattgcatttgatgctgtgcgatggaaagcattttggggtaggtgggactgtctgtggtgtgtaaatgttccaatggaaacacctgccagtgaagctggaggaggtaaattactagtcattgataacatagttttcataccctggagaggttgcatcgtcctacctggcatttctgcctgcagtaacaggaagggtgattgaaatgtgcttcccatcacttaatcaaggtggggaataaaataggtcatagttaaaagaaaacagta

SEQ ID NO: 96761 - DNA, 1049 bp, Homo sapiens
agcttctggtggatttgggatgttctctctattagatgtttttggtccaaatgataattaaataaactaagcagatacatctctaacggagcagtgcttgttcactgcccaaatttgtacagcaaattagtgtctcacagtggtaatttggcttcattatcttggtaattttaattggaaaagtttagggcagagatgctgtttaaaaatggcagtgactcaatacatcaaatgatgaacagtattttttttcagtgtctaacacagatttctgcttaaaccattttgttggtaaaagtatccagagctctaatgttctacctgcctggttttaataatttaaaaaaaaaactgacatatggttgtgaatgtgtactggatttaaaaagactcatctattttaaaagctagcactgttgctgctaatgatagagtcaatacagtgtgtctgcagcacccagaggtatggagccactcccctcctctccttccacgctggccccacagtgggtcatgctccagggtcgtgccatcattcagacatgtgctccgaaactaccttgatgacttttgttctgatttgtaagatgccccccacccctgccaattcctctcttgttcaaggttaaaaaacaaaaacaaaaaaaccaaacttgtttcagttgtttgtatagaaactcttcactaattgatgctaatccagaaactgttagggactggaacaattattcttgcaaggatcaaatactacaaacccctgtaagaagacactctgaacaacacagcctgtaataataaaaatatgtatgttaatacaattgatgattacttcctggatcttgggaactgtgggccagagataatttaattaaccttgcaataatgtgaccctgcatgttacatgattgagtttcttactttccactcatattgaggttattatttttatttactcttctgccaccttcctccatttatttggttttttttttcattgttagaagattgttttctgagtattgtttcaaaacttttgtttttaatggtaa

SEQ ID NO: 96762 - DNA, 1011 bp, Homo sapiens
ctcatttcctgtgatttattagtaatatcattagatactttataaagtatctgcatttattttcccagatcactctgggcccattatcaaacaatcaaaacatcatgaatgaatgagaagcaaccctttgaaatgctgtgatggagtaagacagcagatggtgacaagtgggcgatactgccctactccttgtatggagacactggagagtgccggccacttccgcttctgccgattccagttccagttctgtctcacagtggacatagctgatgtagcagttttgaaaacttctctgcctgttttgttaagggaaaaaccactaaattgacaggctgtggagtagaagccatattgtctctttgattcttggaccatgagttaatgtctgcgaaggcactccctcccccaacccgcaagtatttcttgtagaaaatctggaaatcccatcgaaaaagaactactgtgaacatcttttcttctagtcttttgaaaaaaatctgctccacctaaacctgagaccacattatgtaaccctcttgtgtgctgcttgtgtcacttaagttttttttatttgttttgagacaaggtcttgctgtgtcacccaggctggagtgcagtggtgctatcaaggctcactgtagcctcaacctcctgggctcaagcgatccttccacctcagcctcaagtagctgggaccacaggcatgcaccaccatgcccagctaatttaattctttgcttttttcttttttttcctagagatgaggtttttgccatgttgcctagtttggtcttgaactcctggcctcaagtgattctcccaacttggcctcccaaagtgctgggattacaggcatgagccactgcacccagctcttgcttaatattttatcacgagcaatttccagtttacttgaagagtttgatatttgttgtccattgtttcattattttataattgatttttaaacatttctgattgttggatatttgcttttttttttttttt

SEQ ID NO: 96763 - DNA, 1062 bp, Homo sapiens
tccttggggtagcaggttcccagcagtggaattattgaactaaatggcctgcatttataaagagtcttgatacatagtgcccacttcctttccagaaaggctgtattgatttcatattccccccagcattctttgagtggctgctttttgaaattcacatcttctgggaacagcttaaatggatggtgctttgtgcggcctaactgtggactactgacaattttaagaggctgagacgtcattctgtagctgccttctttagaacttcccttctgtctgcacttctcaggcaattttcattttctttctttgcatgagactgtgtcgggaattatgacagctgagtcagatcaagttcatggtcagaaaaacattcagttggctcccagtttcagccgcctggtgcggatcctagagatcatggaggttcacaggcatgttggagttggagaggcctccagagcacatcctgtccaggcctctttgcagatgtgcaagcaaagaccccttggtcattagggaacttgtccaaaattcatacaagttattggtagaccctgatcctccatgctgtccccagcgtcttctcttatgtcagccagcctgtgccgatgttctgcctgtacgttgttggcttgtgagctgtaaataatgtgagtgtgttctgatttcatagaaggtgtgggcaggaggagggcatgggcttaaagcctcacatggatccatgaggctgcttcttggagggtgaagaataacacaggacatgcacagccccatttctccttgtagagccagctggttctagtccttgcttccactgctgagtggttgggaccacagttgacatctaaccttcagaaaggatagttcctcctgctgaggtgaataggagagcattctttgtttcctcctggaaacttgttatatgatggcctccttactgcgtgcccagctgtgaacgtgacgcacagattttctgttgtacttgaacatgtgttcatacatagaaccagtgtgcatgcatttgctccacttcaagtccatttattcccctgccaatga

SEQ ID NO: 96764 - DNA, 1357 bp, Homo sapiens
aacattgtagatgaattattatattcttaatggccattggtaactttttcttttggaaattctttgtgatagttgtcctttattctactaggacaatatgtgtttcttattgatttagcacagcttcattgttttaagggtatcagtcatgtatgtttaaaaaaaaaaaactgtttctggttcgttttccatctaattaggttacagtgttttatgacgcacagaagtttttcattttctccagtcaaatttatgtatttttccattgtgatttattccattgcatttttttaaaaaacagctttattgagatataatttacataccacataattcacccatttaaagtttacagttcgatgttctttttgtagcattttcacagggttgtgcaaccatccccacagtcttaattttagaacattgttatctcctcctcaaagaaaccaaagcaaaaaaaccccatacccgttactagtcatttcacattccgccctgcccttactcttcactccctacttcctagcccctggtaaccacgagtctactttatgtctcttgatttgcttattctggtcattccattaaaatggaatcataatatgtggtattttgtgactggcttcttttatggagcatcgtgttgtctaggttcatccaagttgtggcatgtatcagtactgcattcagtaaaatattgtttggtaataaaatagaatgaagtactcctacatgccactcgttttgtttatccagtcttccattggtgggtattttgttgtttccacattggctatttattatatataaagctgcaatcagcttttgtgtctgcatttttatatggacatatatttttcccttgggtatatacctagtgaaattgttgaatcatatggtagttccgtaaaaccttcttaagttgccgccaaattattttttaagtggctgtactattttatatcactaccagctgagtatgaggtttccaattgcttcatatccttgccaatgcttgtattgtcttttttattatagccattctagagaatgtgaactgatatctcattgtaggtttattaagttgtgaaaattgtttttatattctgaatacagattccttatgagataaatgatttacaagtattttcttccattctgaggattgtcttttttactttgattttattggtggcttttttgttttttgtttgtttgtttgtttgtttttgagacggagtctcgctctgtctcgcccaggctggtgtgcaatggtgctatctcggctcattgcagcttccacctcctgggttcaagcgattctcctgtctcagcctcctgagtagctgggactaaa

SEQ ID NO: 96765 - DNA, 1004 bp, Homo sapiens
gatgccagagatgccagagacacccaggagttgagtctgctgggggacatggacaaggacgtaggtgacaatagtgtatgtgctgtggggaaaggatgactgtgatagcatgtggaaggttctagaattcagagggtaacagaaatgagatggcagtccttaccagcagggtgggcactgtgggatagggagtagacaatggtggacttggacttgagggagtagtttgtttatttttttttaatttttttttagaatcttgaacttccattgagtattctgaaagggagagattgactttacatggtggagggactattttgagccttttgatgttgagagaagcattttatgtacaaatgatatgaattttgcattgctattcagtgcattatggttaaaaattttaaatatggcttctcacaagacttaaaattcaatgtgtcaatcttgtgtttaaaaaaattttaattatttttagaatgaatttcacttaaagctaaaaattatgtatttcaggatagggtgtggtggcacaatggatcatcactcactgcagcctcaacctcccaagctcaagtgatcctcccacctcagcctcccaagtagctgggactacaggcacacaccacaactaatttttgtatttttttgtagagatggggtttcactgtgttgcctaagctggtcttgaactcctgaacttaagcgatcctcctgcctctgcctcccaaagtgctgagattacaggcatgagccaccgtgtctggcctctcctttctcttttacttacggcagttgaggcccacctagataagcccctcatctcaggatccttaacttagtcacatctacacagatgatttttccaaatcaagtagcaaataccataggttccagggagtatgtctttgggaaccattatcagtttaccacaccttcctaacacaaggtaacctgatggtctaataacatgtttgctggagtactagctagcatgtcca

SEQ ID NO: 96766 - DNA, 1970 bp, Homo sapiens
tttatttttttaaagagacagggttggcacaatcatagctcattgcagcctcgaactcctgggcttaggcagtcctcccaagtagctgggactacaggcgtgcaccaccgtgcccaactcagagttcctttcttaatctgtgtcagttgctgtctttcagggtaggtctttcctcacctgcctggtggtccttggctccttatttgtatataaggtgctaaaagctgattgaaaggggtacgttgagggcaagctgtgctgcagcatgatggtcagggatctacctttcttggggtggggggtccccaactatgattatctttaggccttcttctcttgatgagcttccccagagaggaatcctcccatctcttcctgccgtggcctataagcttggctgtcagatctcatagctgggggctgggggtgggagatacgtctctggcccatcagtctgcatgtagaatatttcttaatctactttttccttagcagttacaagtttaaaaaaaacatgaaaagaaaacggcactcatgagtttagctcttgaatctctctccatggtcttagaattgagcctttccagagaataaacttggcctccaggatgagggaggggaagggatgttccaggcttaagaaatttctgggattggggggtctcacttttccttcagtagttttcaaccagccacactactggatgtcacccgcgcccctgccttccgatgggcctgctgtcaccgaggctctggcccgggctgagccctcatcactccccctccccccgccccttcccctgcccccacccaacactaacctttctgctccacctgctccactgctccttggcaatctgtttcctaccttcagaggcttggtttctggccagtggctctttctcctttccccactggtctttctttaatctttttgctacaactttaatggtgttttgagagggagtggaggcaaacacgtatcatctgctctgcttaatgcaaagtatgcacaaattctctaatgagtgattgtgggggacaataaaacctatggttataaatttatcttgttttacagcactttatgttcagctgtttgtgaaaagcaatttaaatacaaggatcatgcaggagaacagttgtttatattcacttaatatttcctctagtaaaagggaagatcagagacaagtaggatgcataaacgatttgctgcctctgcagccagcgtccatggatgttgatgactgggtggtggaagttcccagtgcctgggctttttctagaattgcatatttaatccagatttgatagttgtataagtgctcaatggtgattcagtgcctgggcttcaaaactgcatagaccagggtgtgaattccttcctgctttgtcatgtgtgggccgagttcagataagaacaacttatttgaacctcagtttcctgacctaaaaatgagggaaattgtacttttctcccagagttattaggaatgagtgaattaatgtatgtgcgtgctttgccttgtgtgaccactgaatatatattttacttactttgttatattctaggtctcctttcgtatgtgacattactgtgatttagtgtgcctgggaaccaggtgggcctggtctttgtgcgtggattttccccttgtagcaagaggttcatttgctcacctttagggtctgggacatattaaggcccgagttaggggacatgaggagggaggggtacagttttgttttgttttgttttgtttttcttttgttttgtttgagacagtctcactctgttgcccaggctggagtgcagtggtgtgatctcagctcactgcaccctccatctcctgggttcaagtgattctcgtacttcagcctccaaagtagctgggactacaggcacatgccaccacacccagctaattttttttttttttttttttttaagtagagatggggtttca

SEQ ID NO: 96767 - DNA, 3776 bp, Homo sapiens
gaaattttgtgtgtgtgtgtgtgtgtgtgtgtgtgtgtgtgtgtgtgtgtgtgtgcgcgcgcgcgcgtttaagggaggggaaggcactggctcttcctctaggcatatttgggtcctggtaaggacacacactgtacattccaaggctttgtttgcatctggaaaaaattagccacactcagatctttcccactacaggtcccgtcaggaagcccaagtatgtggaaagccccagagtgcctggagatgcagttataatgccattcagagaagtagccaagccaacagagcctgatgagcatggtaagaatttcagtgatttccttccccctctaccaaagattttatacaatgacacttcatttctgaatgaaacttgagtgtccttgcagtactgctttgctgagaatgtatttgggaggtattttcccctccagcagttacagagatctgtttggctaacgcaaattcttggaaattgtatacctggcgtataaatagttaagtgggtacatatgcattatttaaggattgagtcctatttcctctgaattttgacctaccaggtcttggaggataggaagcgtcacccagtagattgcttccaagattttgttttgtttttaatattctactgcttgagaaaattcaacaacaggctttggctgaaaagctgaaaccttaactggacaaagcatgtaattgctagctttaaaaaaagcatttggtgtcttttgaaggctgctttttttaacatctgaagtttttctttaggggatgttgaagtaggagcaaaaaaaaaaaaaaaaaaaccaaattgatggaaatatttttaaagacattttatatgtatatgtattttatacctggaaatatgtgtgacattacaaatttgcagcatttaacagatatattcatagttgtttattttaaaaaatcaattcaagaattttcctgtttgttcctttctggggagtccccaactcacatctctcttgcctttaatttgggtgttttgaatttccaccctgtttttctgcagaaacatgggactaggaatcttgctgtatgtaaaggggcttgctttatcctcagtgtggacaaaagtttatgtagcaatgctgaaagagaactcaaccatatttttactttggcatatctggcaccttcctctgcctaattgtgggtggtgggagatacagaccctttatgtcctaacctgtgtgtgccttttgtgttgctggtgctgtatggcagggagtgggtaataagtaggacatgggaagacaatatactggagtggtggtaaaaatatagctaaaaatgagctgtgaggaaggatcagcaaaagctgaaaactgggaagggaaggggagtttgggacatggggaaaagatggggccaggcactgggcactctgggcaggcaagaggtgctattgcaggtgtcttggcatgagaaatgccacccttttcctttctgtccaggcactcattgtgtggttgagggaagaggatttgagctgaggatttgtgcacaccgaatgttgctggtgaaggtggagattccactgtggtgtctggttaggatagccaactgctggtacatgaggcctctcttgattgtgcgttcacgtgggcaggcagtctgttctctctctcctcggtgtcctgaaaggaaagtaaaatctctctctctgtagtgaatatcagtcatcaaatgtctaagctgtctgcctggctcagattaagcctgctacctacctcttcccttcttccccacccaccaaagcctttgtagccctggtcaattatgcccctggcattttggctggcctaggctccattatgtaacctcttcctccctggctgggagtatcgttaaggttctgtacagggattgggacctcctcctcctggtgtgggagtgggggtagaaaatttggatttttattaggcaataaaaggttataaatagttcctattgttaacttttctcccttgctcaaagcagaattggccacctttcttgacgaatggaagtgttcttatgcttggctgtgggctgagctaaatttcaaatgcagcaattggtcttgctggagtggcctgaagtttgcatgtgtgctcactcctgagacctgagctttctgattcggcatctttagtcttcatggggaccaaagttatgagatctatgggctacaaatacaggaccagacatttcggtttcgcctgaaattaagaagcagggtatgttttcatttttgttaagtgtctcgggagcaggtgtagttcacgtctgtgggtgcatggtcttgcctgaagatagccatgatgttggtggatgccgcagcagggtgagctttctcttggttgatgaggagaggtggctgcctaacaaagtcgaacaggacaattagtatagaatggtatgttttgtaatccccatggagtcccttaaatttcaatggggttaattaagtctgccatgtcaaagtgtaaattttatccagatcactgaacccaaaggaaatgatagagccgactaaaactaattgagtttgagtgttaacccaggtgtgtacagatacatgatgggcaaaccctcatttttagggtttaatatcagcatcatcacttaagttttactttaaaatgtggtcttctgttatctatatttcccttggacattcttgtttaagtttctaagacgcttttctgggtgctgtcaataatagcatgccagtattcaccagactaacagactccactgaaaacagctctttgtgaagtgcttttgaaatttcccatggactcgtgaaatagcaggttattcctaaatgcttgaaatactttcctgcctcacttttgctttggtcatgtagctccatcaactcttgattcttagctctctgtttggattttaaatcaaaggaaaacaaaccaaagaacattttgaatttgcttatttataagtaattgcatttatgtgtgatgcacgttttagccttctgggaagtgtgggttcgatgatgtaagaagatgaatttttttttgtaagcaaataacttgtttcttaaagcttgcaagctggggactgtagctcacacctgtaattccagtgattcagggggccgaggtgggaggattgcttgagactgggagtttgagaacagcctgagcagcatagtgagaccttgtctctttaaaaaagaaaggaaggaaaggaaggagtttgcactcacctggaaacatctttaggaaaaaacattctatcttagtatgtttaaatatatttgaaacacagcattttctactctaggaaaaacggatgacttaataaaatcatcaaacaaaatacaaagcccattttcatgtcaaatggtcctaataagctgtgtgtcaggtagaataagttcttaatgagtaagcttcctattgctaaatcaacatatcgtttaggggaaagctcatttacccacaaacaatatctgcgttaagggaaaaaaaaccttcagataaattagagatgattgttataacaggatccacgctttatttctttgatttaggggtaaccataatttatttaggtttgcattaatatatttctagctactagggcaagttttgaggaggggctagaaagtttttagtctcataagtcattgctctgtgaagatcaatctcaaaatatgatgaaactttttttaaatgatatcttcatgtcagtcagtgacgaaacttttttcctggcagtctgactaagcaaat

SEQ ID NO: 96768 - DNA, 1364 bp, Homo sapiens
aagctgcagtgagccatgatcacaccattacactgcagcctgggagacagagtgagaccctgtctcaaaaaaaaaaaagtgaaaaaaagaatatgattgaaaaaaatgcatagtcatgttttatttcttaaaaccctttctttcccaagaggtaaccttgatcctgctttaattttcagcttcttagaatggcagtgcaacattcaaccaatggttgaatgaggttttatttgatggaagtatagaaaaggggcatacctggtatgtgtgcacagaagagagactcttggaagtagagtatccattcattctgcatttccttgaataagtattcagtttctatgctgtgaaaaaacactatgctaaatgctatttgagatgggttatcaagcatgggtcctgtctttatggagccttagagtctggcaggggattagagacctgtatatggcgtgactgtaataaaggaggaagtaatgactaatccaagctgtgtgatgaactaggagttcagcagatggagattctctatttttttttttttttttttttgagatggagcttcattcttgttgcccagactggagtgcagtggcacagtctcggctcactgcaacctctgcctcctgggttcaagcgattcttttgcctcagcctcccgagtagctgggattacaggcacccaccgccacacccggctaatttttgtatttttagtagagacagagttttgccatgttagccaagctggtctcaaactcctgacctcaggtgacccacccgccttggcctcccaaagtgccaggattacaagtgcgaaccactatgcttggccagcagatggagattctgagcatggaaagacttaattgtagctatgccttaagatttacctgttgtcttagttcaggctgctataacaaaaataccataaactgagtggttgataaacaacagtaatttatttcttagatttgtgcaggatggaaagtccaagatcaaggtagtctgcagatttggggtctggcaaaggcctacttgctggttcatagacagccatctttttgctgtaacctcatgtagtggaagggacaaacaagctccctcatttataaggtcactaatcccattctgagacacagacattcagactatagtacgtggcaacagagtaggatggagtgggactggaaagagactacggttaagaatgattaaaaaattgttttagtaattaagtgagaggataaagtctcaaattagttcaggttcagtgaagaagaggtggtgaatggaagattcttgaggaattgcaaggacctgggaactgaaaaagacagagacaacaacttcacgcctttgag

SEQ ID NO: 96769 - DNA, 1032 bp, Homo sapiens
tggtaagtccctctcatccagaagacctcagctctggagaccatgcctcccactgtgttttcctgcaggttgcaagggctgtagagggatgagagggaggcactgctgttgacagcgttcctctgttctccttccgtgacatgcagaattagaacctgttgccaagggacacgctggaggtgtggtagggaggagaaggaaaagacgcaagaatttcctctccaggcagactgtagccacaggtctttgaagaggcaggagtggtggggacagaaaggggaagagcttccttttaaatcaatacagggtgtgcaggttccactgcctcttcacagagcaggttatctatgactcagttgtggttctgtgattgctggagtaggggtgtgccttttccatctgaagagcatgcctgtttttataaggtgtagcctgggaatggcagcttttgggcattgtaagtgtttcacagagtaaagtattcaagagcaccatgaccctagttgggcggagatgaagatgagataccttggcttcctgctttggaagacctaacagtggcttgtaaaacaggctggtgaggacccatgctcccaattacacagggcctggagaaggcaggaagaggctttccatttaattttccattttaagtagtttaatatttgtcagccagtagagctgggtttggaatggcagaggctttgggggtggactgttacaaagtgcacacagctgccgaggccttgcaagctttgggcagctgtgggctcaaagcagggttccacatacagtattcacatggtttattcagagcagtttggggaaatttcagacaatgctaaaccatcctttaaaattcctggacctttctttactctttaagctgattcgcatcatgttggttatatttaatctaaatatttttgtccagcagatgcagggacaggaagcttgtgttcccacatgcccaggcacccagtttagaaagaaatataaagtatgtggtttcatcaggactgccacagggtg

SEQ ID NO: 96770 - DNA, 1246 bp, Homo sapiens
ccggagcatttttgtagtgtcctgaatcggcctcctttggagaaacggtgctaggacagttccatgaagggaggggaccctgagggaacagtggctgcctctccccagctgggtgtgtctgccacacagagcaggtatgtaatctacctgcccagctctcagcacctgagctggcaggcatgagccgccacattccacctggctaggtggctttctgggtgattaagtgctcagaattcaagctcttctgaatgcctttcctttgctttcctcatgcttacatttgttttcttcttgctcagtttgaagcagagaggcaggtatgcatttagacaggggaataccttcgtagaaacacttctgcagaagtagcttgcagtaaaatattagacacctggttagtatcctgctagagtatcttgctagagtttgataatatttatttttctgcctagttgcttaggatgtttaaaaaaaaattatcatgggctgacttttatcttcctttgactctctcctacctcctgctaggcttataaaatgaaagtgattccagaggtagctttagaccttttatttcctggactttgtgccccaagggagataatcagatgcagaggcacacaaagatgaattaattgtactttattttcctttttgacttgttgtaaatcctgcccttttgattttatgctaatactgctttgttgccacctgtatcgccctgctcactactaaattgaaatgctttgaaattgatttggtaataactatttagactgtttcaagtctgggttaatattcattttgctacgttgcctgcaatttttaaaatcatccttaattatagaagccttttttttaaaatctcttgggtgaagagaagaatttttctttatgtatataatttggtaatatgcttaatgtgggaaagaaattcttggcaatgatttgagtcagcaaagagcctgctgtacttttattcagactgtagttggattcttcaggctgttctattggtgtagcaagcatttattggcgcctactgtgtaccaggagcaagcatgttcagtactgggacaataaagataaggcacagcatctattgtcaaaacttgtccacttgtgggactacaaaatggtcttctgttctgtggagagtctgagcaagttgtgaattactgagaagaatttaagacatgacagtgattgatacctctgacggaagatgtatgctgtgggcgca

SEQ ID NO: 96771 - DNA, 1265 bp, Homo sapiens
cttctcagttgggcagtgtggtgggtcccatcctccccgcccagcaccacctgctcccagccattcctttaggtgtttccttagttgaagagcctgatgaatgtggctgggaatgtgcggctcgggcccctggccttgctgcatgtcatagcagagcatgccttgcgcaacacaggtgagcactgagctagaaatttcgtacagagatctggctgtcacaagccagcatacggggctcccagagcaaggccagagagggagcagggccctgtggcgcattggatggggctgggcagttgcagaaggagaagccagaagtctcctgaagctgaaggttaccatgcagggttggggcgggggtcccacctgggacattctgttggcattccaggcaaggtggcttaagtgccttcactagacccctcaggttaaaagctgtggccgcaggtgaaccagggactttgttctctgtggttggttagtttgcaggtggccgggcctaggtaggggtggaaataaaagtacagtctggcaattctggccagaaaggtttaagtcaggccggtttcattgtgcaggctttcccttacacacttgggaaaatccaaaatgtggcctggtggcttgaatgcctgctgggtgtgaggtgtgggtgcacaagagagggacgccacctgtcagccaagaggcctacagacttctgcgcgcgttgccttgacttgtctctgatcttttcctgatcggacttcctctgcagcagtgaaacctaatttggaaagttcttagtcacaggaggcagtctcgctacagtagtgggcttttccttttctattcacttcttcctttcatccacttttatgagcggccattatgttcctttcttgtttgatccttaattcattggtccagtgttttaactttaaattcttcctgtcaaccactaagctaaatacagaggttaaaaaatgtttgctttttaagtgctactttatttttcttcagttgtgtggggaggaaaacattcctgagcattcatgatgcctgaggcacttgacatatgcccttatgtctaattttctctgcaacccagggaaggacaaatcactctcttcagagagtcctctcaaaatgcgtattttctattataatagtatatgtacataatttatagtacatgtatttgggatgtatgccaagtcttgtcttaatagtatggtatgatcagagcagtgtagagaggccgggcatggtgggtcacgcctgtt

SEQ ID NO: 96772 - DNA, 1434 bp, Homo sapiens
tggggcagtgtgagtggcccaggtgatgatgacctgtggttgcaaggggatcccatatggctcagcatctttaaattagaagtgactctttgtagaagctatgtagggtgagtattgcttcgctttttgaccatgttctttctgctcttttgccaagatgtttacaaaaggttttttgtaccttttttctgtgctggttttctttcttggagattaaatgtgaattctgcagtcatagtataccttctcctgctggtacttcacctgcgctggatatgggaaggttttccatttcgtgttgctgaggaaataataagtcagtctctctggatcatcttgaatagatgttataagctttaagggtcaaattctctgtttgactttataattgtatttttgtttctaaagattttctcctgcaccgtttctgcattaaccattctgttgtttgttcccactcccccacccccagcaaatgtttttaatttggaaagtatatttaaaggttcaaaggaatttaatgagaaatgaattcttttgtgagtaatctttgttaaaaagaggatacattatctccaggttacataattttactcttaactctgatactttttagacaatttttttcattatcttcctatcagagtttctccctcgctcctcttctctgtagagtgatttagcagcttatttcccctggtaagccacattcttctaatttaccaaaatacattgtatggaacatactttgataaaaatctgtgtggactggaaaactttccattgatcctggggagggcagtgtgcatgttttaattcttcagccccagctgtgcctggcctccttcaaagtattttggtctttcatttcagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcaggtaaggccacacctttccctggaaggattatctcagggataccaaggtgccctgtgttcactgtcttcacatgggaagacactccagatacaagccagcttcgtggccgtgggtcaggcacttaccttttctaagcctcagtttactaatctgtaaacacaataaggctgtacttaatggtctttaagtgatccttctgctctggaattctttaaatcgattatttggactgtcaggctctttgtatataagagaagaaagtataaaaactctcctctcggtttttgttttaagcct

SEQ ID NO: 96773 - DNA, 1049 bp, Homo sapiens
aagaaaccacaaaggctggcaactgtcagtagtcagactggtcaccaggtgtgtgtcaagcaaggagaatacagtcagtcccctgtatctatagttctacatctatggattcatccagccatggagcagaaatacccaaggaaaaaaatcgataaaaaataataagaatttaaaaatacagtctcacaactatttacattgtattaggtattataagtaatctagagattatttaaaatatataggaggatgtttgtaggttatgtgcaaatattataccattttatagtaggaacttgagcatctgaggatttcggtatcctcagggggccctggaagtgatctccagtgcatagtgaaggatgactatagctccaggtgggtggggaaaggagctctctgcatctgagctgtggggcctgtttttaaggtttctagtttctaaactccatgccctgtgctgagtttagaagaggaacttgttacagtcattctttgttatcagtgtagcacttaacatttctcttctactactgcagggacccagattctccgctcctacgtcagagaatttctctgtgatttatactgtgctttcaggatgcggtgggtcactctggtggttgttgggtgttcttttacaatgggactctgaagtagctgataaataagtggccctaatggaaaagtgctgaggcacaactctaattcactttcaaaggaagtgaaatggccttgttccagaagagggatttggcatgtctgctggagagaaatactagagaacattatacgagttgactgatagtccttccacaagctttcctgtcctcccaccactgtcccaccactttaacagagtatgtggcacccaaggcgctttagaccgtatttacctagttatgatgaatgggtcatttgtattatcccagaacttgatcactttattaacttcaacaaaaatagtgaacttgtgctcaatttagtcaagctgttttaaaattaggaaacattactgtgttaattttaacagtgttaaaagcatccca

SEQ ID NO: 96774 - DNA, 1049 bp, Homo sapiens
tgcttcttatccagatgttagatatggtgtgtgtgtgtgtgtgtgcacaacaagtgtataattaatttcgctgtagagattctagcagtgggtttattgtagcatgaaattattgctttacctttgggtttttggggccctgagtagtgtctaggattttgaaagcgtttatgggtaaatactgaatgtgagtctgacttttgcataggtaacaactgagaatctactgtaggcatgcctgagagggcagagtggcccaagttacctgctcagagggtggggagcacctgggcacatagctaagccactgaaatcttcctgccctattcactggcacctctattggtggcttcgaaaatgcctcagaaagctgagatagctggcaggtggtggcttatggccctgctgcagctttcagctcggcttaatcgtatttgaaattgagaatcagccaagagctgtggaagtgctgaggctgctctgttgcagattttggtgccgaagctctagtggctgggaatctgaaaacaggcctgtggaatcttaacatctcctgtacctgtttagatacaatctagggcatttttgcaatcctttatttggaatgtcttttatggtcacatatttttaatcctttcagttgttataaatttataaactgttctaaggagtcaggggaagaagggaaataggcaacacttttgaggctctaaagcatctttttattctctagggctgcagcattatgtcagatgttcatgactgttctggctctgaaatgaattacgggttatgaatatggctgcctgccccttctacctgtgccttggtgggtgcattcaccatgaggcatgtgaggagaagggtctcagtgctcaggcaggagcctagaaaatgttccaagctgtgttactgtagggaggtaagaaggtttggggaagacagtgtagtcctgttagccctccgggagattttatacaccctacttatgaagggcctagagagaagctagacgctgtccttggattaccgtacattcgatccattta

SEQ ID NO: 96775 - DNA, 1915 bp, Homo sapiens
tatactattactactgagccaacttttagtgttctcggtgctgtggaattgtacacatagaatctgcccatttaattaataagttgggaattccaaacagcagaaagctccccagagctgcagagaagaatctagcagcatgccacctgcttgtggtgttaagtactgaagctttgctgtgtgccacatgattgtcagatttcctcatcaaacactttatggtgaattctgtctctttccaggaataatggagaattctgacaactcagtcaacataactttaagaaaaagaagcatttggtttttaccacttttcaactaatgatactgccagaaaaataaactggggcaaacaatatcaaaatgaagtttaagtaaattttgttgaaagcctgaactgaattgcttagtgatttataagttatagtcacttaggtatgaaatttaaagtcacctttgaagatactaaacttcagtttaatattacagcaacaagctcaaccaaattggaagatctgagttatttagacgggcagagaaatgctcctctacggacgtcaattagattaccatggcacaatacggccggaggtagggcacaggaagttaaaggtatttatcctggcatcagctgcgataatggttatgactaactcagtcagtaactttgaaagtctgtgataaccagcattgaagccaactgtgtttataacatgatggaaagtgtgtttgtgctaaaagcatatctgtgaggtgtgctaagaggtcatcctcaacagtttggggcttcttcctttaaaatatgtgattaacttgcttctggaattgaaaaagtaattctgcagtaagttattttgaagtgaggggtagttttgaagtgaggggtagtttaacactcattaggtgtttattactaataaagtataagctttgtttcaattcttggactaggccaggcgcggtggctcatgcctgtaatcccagcactttgagaggccgaggcaggtggatcacctgaggtcaggagtttgagaccagcctggccaatgtggtgaaaccttatctctgttaaaaatataaaaattagctgggcatggtggcaggtacctgtaatcacagctacttgggaggctgaggtaggagaattatttgaacccaagaggcggaggttgcagtgagctgagatcgtgccattgcactccagcctgggcaacaagagtgaaactatctcaaaaaaaaaaaaaaacacttggactgtattggccatgttctctgtctacctgtaacacagttgtgtgaggtacacagcagcctcactgtacaggcagagtcatcacacctggatgagagcagagccctatttctagggaaaacatgtttctgttttattcatacagcagggaagaagcacgtcttaaatgcagttccagatgaaccaatgagacatgatttggcccctcacatggctttctctaatcctctgtgtgtctgccttgagtcctgagaataattcaaagccatgacaagactagagagtaatttcaataggacactctagtttcctattggtccaataggtccaatagggtatggtaattgaggtattacagaagtattaatagaacgagattggaaatgcttacagacagatcctagtgggggtaaagctaaggatttagtgtaacacacaagcaataatatttgagtttcttagtttataaaattatgacatttttctaaaatttttttttcttcttttgaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaac

SEQ ID NO: 96776 - DNA, 1271 bp, Homo sapiens
gcactttggtaggccaagatgggcagatcacctaaggtcaggagattgagaccagcctgaccaacatggtaaaaccccgtctctactgaaaatacaaaaattagctgggtgtggtggcgggtgcctgtaatcccagctacttgggaggctgaggcaggagaatcacctgaacccaggaggtcgaggttgcagtgagccgagatggcaccactgtactctagcctgggccacagagtgagactccgccttaaaaaaaaaaaaaaaaaaagaaaaagaaaaaaaaaatttaatagaggaaactggaaacagtacactgatggctgttctccagggaggggaaccagttgggtggcagacagatgggaacctgtgctctcatgtggacctctgaattttggaccatgttcactccttgcttattaaaatatgccctggcacaaatcaagaaatatattcaataccacaccctgctcctactgtgatgtacataatgaaatgggtctttctctgcagcctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtaatctttcttgttttattggagccttccacatagagagatttgctggtttggtttctgagaagtagattggaaaagggagcttaaaacagagacaactgcttaatgataaagtatagcttttaatgaaatagtgatacagttctccaagtaaaagtgtgaatgacagtaagtatctgttttaagacattggcagtggacctgatccatcttaaacaatggattgaaagagttcctcaaggcagcagaaggtagcatgtgcactcgccacaaatccatgcttatctgcatgtgctcttcctaatttggtatgtgagcaggaaattgggagcttttgacttgacccagacctcttcccctgcactctgttgtctgaggcctttggtttccttggctttctgacagaggtttctcgtgaagttgtaatagagccttccttggctaactttcccttcttaaatttgtgatcatcaaggtctttctgaagtttttcttctgcttagcacccatcactggctcaccaaccgcactcctgcattaaagcagttacatcccttgctcctagtgagctacttaagtttccctgggcagcagtggtgtgagtcg

SEQ ID NO: 96777 - DNA, 2127 bp, Homo sapiens
tgatgaccatttttaagatccatcagttttttggggttgcacaggaagtctcatctggaacagtcccctattagctctgttctctgttaactcgaggagttaataggtattagtaggtagaacaaggctgttgcagacaggaggagctattgaagacgtcgcatcagaatgagcaggccgtgttctgcaacagcaaatctagtttgacttgaccttttttcatggaacagaggagaggaaagagctggcagaagggagtgtgcagggcacagagtgtatagggcctactatagcagtcaggagtggggacttggggggactggggttagagacgggccttgctgacatgaggtagctcttgtggcttggcctcatgggcagagtagaggaagaagagccagaaactaggtgtggcattgctcttgggaagggtaagaaaggcaggtggtatgtggcaggctttgcagggacagagctggttttagttttcagcagttgagattgcaagatagccgtctgtcccaggcagacaggttccagcgccagggcgggtcggcaggttggaggagaagctgacagttgaagatctagcatcactgatggagaggtgtctggcatgactcggtgaggaagctcatgtcattagagaaaagatagcactgggcttccagggcgtggaggagggtttcagggagggaccttacggatgtaagtgttgccaagaggtgaagggaaatgacggttaagaggaagccattggattttcagtgagggaggagggtcctggatccttaggagactccgcctgttgggttgagaggagagagaggagggagccagcgtcttgggatgggaggtggaagggcttagggggcgggtggttttgtttgtttgtttgttttttaataacacaggagattggaacattgtcagaaacatcactgagagatagtgtggagaaagatccataaagaaggagaaattgggaatgtaaggaggagggaccggggcctgagtgacggggcaggttgcctcctctttgttcccgtggaatctgttcacagcacccagttaactgacttgcatatcgtttgcgtgtcccctcccattgcttagagcttctcaatggaagcaccttgcattgttcccccatagaatccccccgtcagacgtggtgccagtgataaggtgtagctgtgaatgaatggaggactcaagctccgcaggttaagagcacaggctctcctgtctgaccaactttagttcaaatctctgttctgtcatctagccatgtggtcttgcataagtcgcttaacctgttcaggcctctgtttcttcatataagcatatgggggtcatagtacttagtcacaggattgtgcaggtaaatgagataattcaattaggtttctgcatctggcatagagtaagagcttgatacctggaagctttggaaattaacagaatcatgaatgcagattgtcttagaaggggattgcttggtctcaagaacaggagggcagggaggaactatgggcagggtatgcaggagtataggtggggagcagtggcatggggagttgtctcctcagagaggtgggatgccctgtgctcagctgggagcactggaaactttaggcccggccaccaaggggtgtgtggtcatcaccctgtaaagtgatagttagtgtgtctttgtgatggacacggttggcctggccacagagctcagccaactgggagacttaggaggacttagcctgtggttgggagagtggctcccaactgacatgaactgggccagaatgaatcctgggatcagcccatgggtaggacctggggaggccttgggggcctagagcactagagagatgctgacagcggtttccatgggaataagggaggaggggaatcccaggctcaagatctgggacatggaaggtgttcagggaatgacagggcatgtgctcgtgggaaaacttcaggccattacaagacaatggacgagactcagtgggcagtgtggccttaaacgtcatgccctcccctgtagtataaaaactgattccttggcctccatctgccttgatttcctcatctctaacacggtttataacctatttgaga

SEQ ID NO: 96778 - DNA, 1687 bp, Homo sapiens
tgggaaggagatgctcaggcagatctgtctctgattgtttccaagatctgtctcgattgtttccagggcctcagtaagaagacgggaatttcttcaagccatctccaagccctgtggatcggctacagcaccgaggggctgtccgccgccctggcctctctcaggaatctctatactcccaacgtgaaggtgagcaaccttctgcacagagagccggagacccagccctggccggctgctggccgttcctccaacagccctgtttccctctgccctgggtggtggtgagaggacgcagaggagcttctaaagatgtgcttccctgatcacacgggcttgggtgctgtattactcgttcttccagaagtttagcttttctttggcaggaagatgtgggtggtcagggctgctctgagcacatgtggtgactgtttcacagcagatgtgataaggaagcaatttacaaaagaaatcaaagatcagagagatttctagggaaaacggattttttaagtgtcctgcgttactaatctggaccatctcttcagagttcatgggaaattaagcatggatgggtgatgcatagagataagtacacagaaaaacaaacatcgaggtttcatgtatccatatttctgcctatggaaagggtatcagcatggccttctgtggagccaagagcttcttcacttcttggtcagtggctttcatgtcatgatgttccactcagctttttaaggtagatttttcttcctgatttcatgtagcctgggaatctgaagcacacagaggccaagcagcctgttaaggccacagagacagtgtccaggcctttcagcttcaggccctgatgtacccggctgcctgtggaagccctgggtcagtttagggagccaggtcttccccccgaatcactcacattgtttcatctttcatttcagctaagagtgtatctctcggcttctccataactaataaaattctataatcataagaaagatgagaataaaaatggcaatatgttttcatatgttaatgaatttctgggcatagaatttattttaatatggaaataagtaaatgggaaacatctgttgagtacaagtttttaagacagtaaatttaaaggtactgcataatagtgtaatgagcatggccctcctgagattataaactttgctctttaacgtatgtgcgattttaagagttaatcatttttactttgttttgtaaaactccagtgtcacctacatctacaccatctccgaaattatttctataatgtggttatagaatcttaagtcttttcattatccttctgtttcttttatctttcaaggggggaaaacggttttcacaggatcttgaacaaattacagtaattttaaattatgcatgcaattaaggaactttttttagagtgtattaaatgttgtcatacaggaatgaatgtcattttgaacaataattgcagtttgccactttggtaaattaaagtgacttgctctgggatgattacttggtagatggattttagttgcagtggcatgccagcagtctctaaccatgttgtctcctgtggccaggccaggatggggccagcctgggccccgctggcccactggagtcccatccagccagtggttttgttgtaccatctcataggactggtggccagccgcaagct

SEQ ID NO: 96779 - DNA, 1026 bp, Homo sapiens
tcatgatcgtattgcctcgcatatccccagctcccttcctgttttcctgttttcattaaatccagaagttgagagataccaccacttctgagtgttgtccaaggagggcttctgtgatcatggtcggaaaatttccatatcgttgggggaaaatctataggatgaatcatttaaacaggttccttcagcacagtgccgtctcagccaagactgctgctctgccacctggctgctctgtgaccatcattagctttgtgcttagcgctcagctcggccttactccctctgagccttggctttctcacctataaagtggagacacaaaagaggctgtctctcaagtgatgagaaaccttactgagatgttaaaggtactgggaacatacttggcatttattatgtttacatgaattgttgttagtgctttgcctcatctctggaaacagtggctctgctgtaggcacctgggaagttttggatgtgccagttggtgcttgttaacaggagctgccgaccttgaggatgtgatggttgcaggtgacttacctctgccctcatctcggcatgaggtgtccctgctgctctgtgctggtgaacagcccaggctgggcatgcagggtgatgtggacaggagggcagagctccctcctgtgccttccagaggtcagggacctgagttcttgtcgtttctgaagactccatgaaaggttgattataacatcgattaatgtttatttaacatgtacagatgctgagtgctgtgctaaatgcttaatgcacatatatatacatacacttttttttttacacattgatttttaatctttacaaccaccaagtgaagtgaaacttttatcctcatttttttagatgagaaaactgaggtttagggcagttgatactttccaaaatcacacagctggaagggcgcctgacactcagcaagcccttgctctgcaggtgcctttatcacttgatgtgtttacagccctggctgccagctaaaatcacctgggagctctgggc

SEQ ID NO: 96780 - DNA, 1088 bp, Homo sapiens
gggcctgggtgcacagggtaccctctcccccatgtcctggcactggagcagagccctgcaggaagtgattatatttatggaatgagcattccagtcagggaactaaaagggggtaaagaccatgaggccggccctgcttggcattgtcacagcacgtgttgggtccaaggtggctgcagtgagggaaggattctgcagagaagatcagagaggaagctggaggcctgtatcacagaggttcaagcttcagcagccaagacatcttcaaatttgacacctggggttctaacctgtcactatgccattgtgagttatggtttcactacttggtagtataattttccagacccatttgtttgtaaatattctgtttgtcagctactcttgtggacatctatcactgaaataccatgaagtttttatgccttgtcatctctctgtatcttttaatgatccccatgtgtctctagtcaataaatgatagtctctgtggttttcacatttagtgggcaggtggaggacctgccaggctttggcaggggcagtgattgatgtgggtcaggaccattgaagtaagccattgaaagaaacacactgggcatcttaatagctgttaaaggagcatcatttgtatctaatgatctgaagatctgaaaaaaaaaatattattatacctaaaatttgcgtatgttcagtaattttattttaaaacctgtagataaaaagcttttcccaatacctagatccagggagattactaagtgggggatatagtaattagtggaagcagcacattattttctagcagtattatgctgcggacaatcatggcacatgtggacatttccatattttctgtttcttttaggaacacatccctataaagtatttgtatttacttttggccttatctcactattaacaccatgactatttttttctttttaaaaacattttttatagagacggggtcttgccatgttgcccatgttggtctcaaactcctgggctcaagcagtcctccctcctcagcctcctaacatactgggattacagttgtgagccactgcacccagccacaattatta

SEQ ID NO: 96781 - DNA, 1461 bp, Homo sapiens
cctctcaaagtgctggaattacaggcgtgagccaccgcacctggcctctactgacatttttaattaaaaatttttttttttttaattttcacatcagggccttgctgtgttgcccaggctagagtgcagcaggctgttcacaggcatgatcatagtgcactacagcctcaaactcctggccccaagcaatcctcccacctcagcttcctgagtagctgggattacagtcacgtgcctggggcagtagttctatttttaatattttgaggaaccatcttactgtttcccagtaagctacactattttacattcccaccaatgagaatgtgcattgttaatatattcccaggtgatactggtgcacattcaagtttgagaaccactggattaaaatgataccgaaaattgaggatactgcccatttccagaaatgtttagatgacatacatgtgacaatcttgttggggggccttgtccaacaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtaagcggcagcctgctcttttggggctggggcagggaaatggcttcatctcattgctagaattgttatttgctgggccagactctcttgtctctgaaaccacagcatacacagaaagggtcgggctccagggattggtcactttgtaatgtggcagcctcagagaggtttgttttgctcatacacagcaactctgcttaatgttgtccaggggaaggcagaattccagggagaccctggctcctagccgcatgaggagggccagcctttaaaaagcctgcaagtatcgatctagaaagcaccaagattggtttaaaatattttaaatgtttgcttttttcccctctcttcttcttatcccattttatgtccttttaaaacagtaggatgagttccatgaactcatgaagaagccatgtgcctgagctccaggaactagattgcctggaatcttcatctttccacttgccagccctagggtattgggcaagttattgagcctatatatgacttcaggcttcttatctgtaaaatgggcataacagcagtccctaccacagggctgttgagtaagcattcagtcatatatgaagtaagtatgtattgctatacaagttactctagagcgatcaacttttttttctgttttgacagtctcactctgtcactcagtctggagtgcagaggcatgatcttggctcactgcaacctccacctcccaggtttaagtgattctcctgct

SEQ ID NO: 96782 - DNA, 1051 bp, Homo sapiens
ggtgttttgtgaccctgaatcttgcaaagggaacctgaggcctggaatggtacattcattaccatctggaagtaatccagactaaggttccatgttctccagaaagacaagttggaatgtgaaccccatgtacgcttacagggagtggggtttgcacacagctaggtggtgcatctgcatgctcagaggcaaagtaatgctcagctgtaaccttcccctactcctgcccccaggtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtgagtggggcaggggtttccctcctgggaaacaagaagctgtagcccagcaagtcagttgacacactgaaggaccgaaagaaggaggatgccaagaactagcatttggcgttgaccacctgcagtagaaggtcttctatgggcaccacatccttcccgtgagtgacagtgcacactcctatgcacacgtgatggggacaggcaggcttatttttctatgggaagccttttgatgacattcactctcagctcttcctcatgtctctcctccttccctgctctgccctctagacctgctgttttaaattttttcccctttgattcgtttcttctgtccttgtgttcatttaaaaataatcacatagaatcctgattctaaaatcgttcctgagtatttgaaggatttttaaaaatagagctttaatgctttgatagcacacaagaatgcttgtcatttacagctcctccactgaatgaaaactccatgcagtagttaaatagagcatttatttctgacagatgttggtattcctcagtttgaagatttaattgtcacctcctgacctgtgtgtcttggctttctttatctgtgaatttaataatgttttgctcgcttcctcctgtgtatttct

SEQ ID NO: 96783 - DNA, 1076 bp, Homo sapiens
attagaattctgagtacctagtaatcctgaaccatattgctgaaattcactgagatttttttttaattcttctccaactgaaagtgtgaatagcatatgaattatgcttgaaaacagttttcattatatttttctctccttgggcagtgtgagataatggttaaaaaacaacacactgtctcctttgatacatgggctataataagcacctcttgctaagagaactcattaaatcaccttgccacttctgacaggtggtccagtgcttgctggggatggagaaggaacatgaagtagaagtcaatggcaccgacacattgtggggagaaacaggtaattataatgccactgcttgtagtctggggcagcttgcttgatgttttagccctattttggcctaattgtcttaagaatgactgatatatgtagtcctgtttctattttatcacaagcatttgaagtttagagctccttgaactttctacatgagtagcaaaactttgctggaagcgtaagattttattttttaaagcaatcctattaactgattattttgaattagactagcagttacggtacatctgatgaatgtcagatggaagtacctaactaaggtgttgttttctgatttgccaaatctcacacatctaaccaatgtgatcttcctgtgacctgtgcatggcgagccaggcatgaacttctgtccccatcgtcacacgaatcaaaggcggctcagcacagaaggcagtggcctgccctgccctgtacagaatgagggtaaaactcagcctcgtggggtttactcacattaccgtacgaatgcaagctatcgggtcatttccattggtctttacagtgagaagcctgggctgagcacatcctggtgaagatttgagctggttacttgtgagactaaaagtaatgctgctttccagttttccacttgactggattagtgttagaaatctaagactttaaattacaagttgtttttaaatagatgtcagcatgagtatttaaaatgaatttccaggttatgtttctgtgtgtgtacctggtatatatgatttccattt

SEQ ID NO: 96784 - DNA, 1069 bp, Homo sapiens
gtcatcctggacctaacccttacattcttaggtccacaagaccaggactgcctgctgcccacgcttactccctcactttccggtgacgaggccccagatagaacgcagagctcaggtgatccacgggagagatgtggctacctctctgtgacatgtgaagaggtgaggttgccagccacactgcaccatggccctaaggacagtcggtagagactgttcagtaggagagctagtttcttgcagggagataacaggtttgccgccttttgtttatgtggctcctggaggttaaaccatggccatgctgactggtgtgaccagaggaggtcacaaatcagcaacagactcccagcttccctgggcattattgtaggcaccagaggaagcaggcatctgttagctgctctgaggggtgtcaaagaagacaggcagaccaaggggtgtgtgcagacaccagcatcactgagcccttggctcccggggcttagctctgagacccgagctcagaaggtgcgcaggagacaaaccaggtcccgcccttgctaatcggaagcccacagatgaccctctcccgagatggctgtcgtggcactctgcttttgaactatgtatgaacaaaatcctctgtgtgttttcttttgggtttggtttctttcaatccttgttaagtttgtgagactgacttggtcagtcgtgtttagccacatggtgtttattcttgtagacatgtagtgttctgctgattgactatgccactttcttgaagcttgctaatgatgatgatgatggttgtttggattgtttgcagcccggggtgcggtgagcatttttgcttgtgtttctggtacaccttgagagtgcctgcagggtgcatctctgcaagtgggttgctgggtggggagatacacctgtcttcaacttactcgtagcgtcagcctgttttccagagcagccaccatgcacctttctgctagcagggtgcaagctttcctgttgttccgcatccatctctcgttaatgagcctggttactaatggggcttggtgctcttcataggctccctggcatg

SEQ ID NO: 96785 - DNA, 1061 bp, Homo sapiens
acaagcaaggccggacgcccctcatggtggctgcttgtgaagggcacttgagcaccgtggaattcctcctttcaaaaggtagcagcgtgatgccctcaaaggtttcttttggacggacacagagagaacttcagcagacccattcagtgctttctgattcaaattctaagttttctgttaatggaaattttctaataaacagtagagagaataggcaacacagccacatgcctggtattcctcttcagcagcgatgaccattctgccagcccatccggccagtgtcacccttcacagtgcttgactgacacttggttcaggccgggtgttccgcaggtgtgaaacaatttgctttctggctttgtcatctcataatgttcatgttctgtgaatgggctttcctttcaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgagtaccagcaggtgttccccacctccacctgcattggaaagaaaccccaggaagtgaacagctcaatccagggcctgcatgaggttgtgtctcagtgtcatcagagagtgtgtgtgtgtgtgtgtgtgtgtgtgtgtgtgtgtgtgtgtgtcttgtcagggatctttcatttttctctaattctgtgacatgcagtctattccaggacttaagattttagtcgactcttaaaagcttaaaaatacctgcttgcaaatagcacatacaacagacacatacgtgaatatgcatacacatgtgcatatgtgattttctcagtcatccatataaataaaacttttgcatagatcatttagaaactacttttatatatggtaagtgactaatcaaatgactacctggttgctttttttttttaagttgttttgtttttaatttattaatttttttttcccaagatggagtcttgctctg

SEQ ID NO: 96786 - DNA, 1012 bp, Homo sapiens
gtctgccgtgcacaggttgtgtgggtctgagtatttctaaagtcaccactgctgtggcctgctcatttgttagagctcattgaagaagtctgctgcctacttcattggagatgcaaaggtgactatgtcccgtctctgtggcctgggaagtggtgtgagacagagacagatcacgcatgtgtgcacacacccacctgtggtagcgtgtcccctgctttcctcatccctgacagcaaaatctcttcagcagtgaaggttttagctgtggattgcagctcctcttctctgtttcgtgtccactttatttctagtctaggatccttaataggcagaggcatctaaaatcagagtgaagctaagactgcccacccctaaatccgtgtgcgcccctgaactcctgttcccagctgctgcttaggcttctgctgtctctgcaggtgctgtacctggtggagaagggagccgtgatcgagcatgtggaccacagcgggatgcggcccttggacagagccatcggctgccggaacacatctgtagtggtggcgctactcagaaagggagccaagttaggtcagtgagcactgcctccattgagcaggaggagcggtgagctcccgattgtagaagcctagacagcacagagagtgacctgctcccaggttaggaagtaagatgtcagatgtttgcagatctctgtctcagtctcacttaatcaccattatacacaatgtgtaagtagctcacggtgtttctgcggggagggtgtggaaagcagaggctggtgttgaaggacagtctggagtggtatcagtggccaggaaccacgccagagaggaaccacagcctcttgctgtggggtggggccgggtagtgctgctgaaagctcccccaggtgactctgagcagcagcggaggctgagccactgttctagagccaccagtcagctgtgtggggaaatggccaccacagcaagtttctgtgaagaagtagtagtatgatttcatggagaca

SEQ ID NO: 96787 - DNA, 1028 bp, Homo sapiens
tgtggccgagctgtagggtaggagagagaagccatgacatctcggagtacagcagatgacacagcacagggactgcgtgctgagaacacatgcctgcacggtggccgctgcaggaactgaggaggttatgctaaggcctcatttaattaattttccccacatcccacccggaagggaggaatgagttttcgctgctcggatgccttcgtttctcattacttttttcagtaaaataacaaggacagatttgagtgcccaggtcagtgggaaaggattagcaacagcctcgccggcgtcctgctccctccctcatcgtgctgtggtccttgcagctgggctcctgctggtgctgacctccagccgtggggccacggaggaattgggatcctttccgcagggcctctgaagtgcctctgaatgcgtgtttgttttgcaggaaatgctgcttgggcgatggccacttccaaacctgatatcttgattatacttttacagaaattaatggaggaaggaaatgtgatgtacaaagtaagtggttccgcccttttctttgccattgaaactgcctgggagcaccctcttaattgggtacataatggctacagctgtgctactgcacagtctccatgtaatagaagtgcaaaaagtggctgggtggggtggctcacgcctgtaactccagcacttttggaggccgaggtgggcagatcacttgaggccaggaattccagaccaacctggccaatatggcaaaaccccatctttactaaaaatacaaaaatcagccaggtgcctgtaatcccagctactcgggaggctgaggcaggagaattgtttcaatctgggaggcagaggttgcagtgagctgagattgcaccactgcactccagcctcagcaacagagtgagactcagtctcagaagaaaaaaaaaaaaagtgccaagaggtgctgacctggcctcatgcccgttgttggcttaatatctttccggcagaatcttaaaggtagaaagcacctctctttgtgt

SEQ ID NO: 96788 - DNA, 1077 bp, Homo sapiens
tgttctgatttttaaagcccatgttttaattcctcttagaagaaaaattattattctgcagcaagctctctaggtttatctacaagatgctacttgtcctaggaataggatcagtttttcatctgatttctattacacttagcattcaaatagatttgagatcattcttgaaataattttcaaaaatacataccagaaggtaatctgattcattaagtttggtaattatcaatctagcagtttacagacaccttattgtaaaaccagcttctttctcactgtgtaaccacaggatgcgggtgcatgtgaggacagtgaagccctcatgtgccagcccagttagtgaactagctcccaccttgacacttgtttggatgctttcaatgttctgtcgtgggtttgcaggggggagtaaactccccacggtgttccaggtgtgggagttattcattttagaacctctgaaaaaggacaaatgtttgtgatttttgaatcctagaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgtaagctgtgcccctttattccaacccagtcttccagcaacagagcccttctccagcagtgaaggccagcccttctccagaccagatcctgggccctcctgtccaatttgcttgcacatttacatgaacctggcatgtgggaaacagctcctatccgtgactatcgtttggtcacggctgctacgctcctcgcatgatgttgaaggaatgcacttgggtttcgtttccttggcctcagtaatgagaagcaaatgcagtctgctcctctgcagcttcccaacactgttgctgctggcactgccgtccccggattcaggagagtccaacccaagcctattgtggtgggcctgccttctgtgttaggtttgctcagagggtctgccagtaactaatttgtaaccggtcgtggggaactcatagtcgatttgtaa

SEQ ID NO: 96789 - DNA, 2878 bp, Homo sapiens
ggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaatgtgttttgcactaaatgagtcaatggataagtagagaacagcctgatgacagctatctctgttgcttttaatctttgttaccctagagggaatagtgaaaagcatattttatattaacactacaaaatgcttatttaatttcgttttataatttcagaataagggtgacagctgctagaaattccacaatactcaagggccaaatttagtctttttgcctcaaatagaaagaaagcatgcaggaaagcaatatatacttcctatctatctgtttcaagacatcttggtgtctgtttttactggcaacgggacatctttactactgtaattctcaaacactttggcaatacactgaacactgttatgacagtttgttctttaacacatttgtattatctttcagttaaaagtatgtctttatgcctacatatttcaaa

SEQ ID NO: 96790 - DNA, 1188 bp, Homo sapiens
gctaagatagtttattagaatagaaaatactctattttctagaactctagagatggagtttcgctctgtcacccaagctggagtgcagtggcacgatatcagctcactgcaacctcctcctcccttcaagggattcttctgcctcagcctcccaagtagctgaaactacaggcatgtgccaccacacccagctaatttttgtagctggggctccaggcatccacaaaccctattatgaactgcgcctgcgagggatcgagggtgtgctgcttatgaatctaatgccggatgatctgaggtggaactgtttcatcctgaaaccatcccccacaccccagtccagggaataattgtcttccatgaaactggtccctgctgccgaaaaggtggggaccactgctttaaaatgttgatgtagaagctttcattgagcaaattaaaacattttggcccttttatatagactcaaattgcatgtatctgattcctagaataaataatctttatctgcttaaaaatttcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatataggtatggatatttaaatccttcctgttttaatcctgttgactaggtgtacttaaaaaaaactgaaagcaaaatattttgatactctgcacagtctaagtgatgtagaaaaaaagaaaaatattttgatgaccctaggaagccaatagttttcaggtagcacaaggaaaaatattttaactgggccaggtgctgtggctcacgcgtgtaatcccagcactttgggaggccaaggcaggcggatc

SEQ ID NO: 96791 - DNA, 1098 bp, Homo sapiens
ctttaaaaactagggaaatgaatagaatcttatctgctgggaatcttgcttcaacaagatctcttagacttgctttggcctcattacaactctacaaaaaaaggaattttttttaaacctcaaataattgaggtaattaatttctttcttcaattcatggcacactctttacattattcttgcaaagcccctctgtgttactttttttgttttattcttcagttcatctccactttcccctatatacaaccacttaaaatatgcctttccagtcgactacttatgtatttatttagcaatatgtttctttatataatatgaaaaatacgtatgtacacacagtggtttttagacatatcagttgtattatgctataaatcttattgtttttaaattctgtttctgtttcttttgagttgaaaaaatgtgtaactctagttcattggttttgattgctataaggtattccatcagaggcatacacaacattttacttacaaattcctctagaaatgaaaacctaggttgcctgcaactcattgtcactgcaaataatacttcagtgatttttttaatacatggacttgtgtatggaatccagtttccaaggtatccccaagtgacccttgtcttctagtattcatgcccatgtataatccctttccacattgtgtcggggttaatctttgtgaccaacctaatatggcatagtgatagctttgtgaattcccagactaagtcataaaataacactgctgcttccgccttgttctcttggattacttgttctcggcaaaaccagccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataataaatgtttattgttggtttaaaccactccgttttgaataatttgttatccgtcaatag

SEQ ID NO: 96792 - DNA, 1996 bp, Homo sapiens
gagcaccatatcttggggtgtatatagaagctacaggacaagtgtaatttttatcattgcatggggagcattgacataatttctactgcagctgagcattttttaatatggataataggattctgcaagtgatacatttggtcagagaacttaataaactagtcaagtgggataggtcctgtgacagaattgtgtgatacaggtcaaacaggagttgggttatggggaaaatgccagttgaaatatgttttgatctttggagaaacctattttttcatttaacctgttctttaaatccagtatgttccagaacatacaaaaatgtttaaatgttccatttgtaagaggatatcatgtattttatatcaatttaaatgcagttatcctaatcatttttctttcatttttaccctttattaactcttcatttgtttacaaaacaaatccactctatgaacgcaatctctaattatttgttttctttcaggtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaattttttagtttttcttaatgtacctgaaaatatattcttttttaaaagccagttaatttaaatttgatt

SEQ ID NO: 96793 - DNA, 1050 bp, Homo sapiens
tcaagacaggtgggtcacctgaggtcaggagttcaagaccagcctggccaacatggtgaaaccctgtctctactaaaaatacaaaaattagctgggtatagtggcgtgcacccataatcccagctactcgaggggctgaggcaggagaatcacttgaacccgggaggcaggggttgtagtgagccgagatggtgccactgtgctccagtctgggcgatagagcaagaccctatctcatatatatatatatatatatatatatatataaaatatatatatatatatatatataatatatatatatataatatatatatatatataatatatatatatatataatatatatataataactgaaagcttttttaattaaaaaataagacagttgtaaagtatggatactgatttcaaacattattttctttagtatgattctgactgaaatggaaactcatgaggatgcatggccttttctacttcctgtaaacttgaaacttgttcctggttataagaaagttattaagaagcctatggatttttccacaattagagagaaactaagtagtggacagtaagtaaatcatttcagttcactaaatatttattgaatacctgatatatgctaggcatatttttagtgagccaaagatattttaattaacagcaagatataggccctgcctttgaggcaggtgtgtgtgtgtgtgtgtgtgtgtgtgtgtgtgtgtgtgtgtgtgtgtgtgtgtgtgtgtgtgtatttggttagagtagaatagtatagaagagaaaccaactaaaattatttaagaaattaaaaacccgtgtaataaacctgcttttgacattgaaagagcaccacaaacccaagctgaaggtaaggaaaagtatcaggagagcctcccaaagtaagtaacatataagccggaatttgtattttgcatccatggagtatcaaccacacgtcatatggatttaacaaaaattgactcaaatattgttagattatcacaatgtagaaatagaagatctttggaagctttacatatt

SEQ ID NO: 96794 - DNA, 1065 bp, Homo sapiens
ttatgtgactttgcagtctaggatttcttaacaatctggttaagggaatagtagttttctaaaagtgtttggtgtgtaccacatatttggaaaataaaaataaaagccatacgttgccagaagtttacatatctttctttcatgatctattatatttattataacatttaactctcaaaaggcagattttttttctctatgaatacagggtggggcacccttcttgttgcatcagtgtgctgcctgcaatttgtagttatattgcataagaccatgttgagagttcttttttgcatgtaattctagagctagaatgactttagcaagtatgtggcttgtcatccttattttttaagtgagaaaacagggcctcacaaatatttttgcttaaagttagtagcagagccatagctggaattcatatccttcgattccaagtataatgtcctttatgtcatttctttctatgttgtttttctcaaaaacagacatctttttgccccatctttcaccactgctttgttcacacctgggaaccacaagtttgtggaactctcttcttattgcaaatacctgttatcttttatccaggaaaaaaaatcaaatcaatttctagtagatttgatcacttggacttctctatttgacacttccttagctctttttcattttttggcctggctttttattacctcttcaactttcttattaacaatctctatattttcatttatattcatctttgttcctaattctgttgtgctccaaaagagaattcttttgtatctttaaactcattcaagtagtgacctagactgaaagaatactacagacaccttctgtagatgaattaccatgagattagcatcttcaagttttaagaattcttaagatgaatagacttttcatgttttattagattttatccttatattatgagaggaaaaaatacacagatctttcttaagaataatagttatcaacattctagatcagagttattctttttacttatttgtcctgtcagactttcataatttaaaataataggtctgtagacagtca

SEQ ID NO: 96795 - DNA, 1091 bp, Homo sapiens
tgcaatctatagctttatttccatttttgcaaattcattaacctttctcttgttcttcatctactcttattaatcatataactccatctctcacaatcttcatttcctttttaaaatgcttaataatacatttcttgctatgaaactaccttgaaaagaaggcagtgtttcatattcaaagattaagaagcaccttataacctttagagacataacagtgcctatagtaatcctcatagtaagtcctgacaaaatattaaagtgctcgatatctttagaaatacccttttggacaaagaccaaggttatcaagaaaaagagggagttgtcataatttgcctccagataattctctacccacagtatgctttatattgttaaacagtaggcagcatccactattttttactgtagtagcagaggaattaaaaccaaataataatatatttactgtaacatattgtgagctattactataatttttcaaaattgttatgagtttgatatctgtcaccctttctttaaaagtatcaggaaataattttatttttaaatcctaagtgtgagatgtaagacagatcttgtagcatttatagttgcctagtagagaaaacaatgagtatttacttatgttcatgaatctgatttttaaattgtgttgttacagggatatacatataaccttgcaattgttatttctcagtgaatacttttacaatagaagttttaacgatgtaactcaaatatggagaaacaacaccatcttaaggtattcagtgatggtgatgttaggaaaggtcaaaaaatagatactgattattggaatgttaaactgctgcttttgcccttggtaaccgcgccaatgttaatatgaaatatatagtatatacatttgataaacatttgttaacttgaatagtgtgtctgctgttttgataagattctacaactgtcattggtatacatactaagttataagaagaccattttagactttcccagactaagatataatgttgcattgaaaattaaagtaagttggaacagttaagctattttgtttttaagagcgtataaatacctaactttaa

SEQ ID NO: 96796 - DNA, 1869 bp, Homo sapiens
ctagtatataagataaaataattatatctaaagagatgtttaagtttattccatttttcatttaatatgcatttattaaatacctattgcatctcaggcagtggacaccaaaaaattggataaagtgtcgttcctaccataagaaagcttgtcatataatagggagatcagacatatacatatatgcagaatctagtagctgattgttgagaacagagtaatgtatgaatttagaagaagaatactgacttctggcagagatatggaagatttcatttagaagttgaaatggaacttaagaaaatgagtatggtttggacaattggagaccaggcaatatcatcccaggaagtgggaacagcatgagcagagcacgaggattggaaagcttatctcatgtttgtggaagagcaaattatagaatttgactgcaacataagatgtgtgaatgggaacatgaaaagggatagattgaggtacttcaatgccatggtgaacatttcctaaagaataggaaatctttgaaggattttgagctacaggatcattgattgttcagtcaacatacatgtattgagtgcccattatttgcctgcactgtactggagataaatgagtaaaagcagacatagtccctgctctcatggaatttagaagtagaaaaatattcatcgaataattacactactataaaattacatttatgacaaggctaaggagcatggtcctatgagaacctgtcagagagggacttagctcctgaaagaggtcaggaaaggattcctatcaggatcctttcatgttaaagtgaatcttaacatgagacctatgaaatgagtggcgttaactaggtgaagaggagcaaaagaaaagcaatacagataaaggtaatagcatatttgaagcccctgcagtcaaaggaaaaatggtgagcacagaaggacctgtacagaagaataatggaaggaatgaaaacagaaaggaagagcaaaggctcagaggctacccagagatttccatttaagtgatcccatgaaactgataagcattttggtctaaaatccttcaaaatattttgctgattgttcttataccttttataatatcaaaagtttataaattttatttttcaaacttttcttacaactatttcttttaatttttttcttcttatttccacctagttttaggaaacacaaggtaaaatcttttagtaacaatccttgagatctgccagtatccaatgctgtattttaagtaaaggtaattcacccacctagcattttaagaggaaaccataataacactattctcttgatatatagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacgggtaggttattgagattaacttgaaaaattattgtgcttctttgctaattggagcctattttctattgcctgttatctatgtatcttcttgtatgtctgtgatccatacggatcatgctatttgcatggtgctttgtaaaaactttttttttgttatgtgcgttgataatcctgcaaagtgatcttacatctacctggttgtgactaagctttgaggcacgtagccacagtctg

SEQ ID NO: 96797 - DNA, 2191 bp, Homo sapiens
cttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaaggtaggtacattgagatggtttacagccacttactcaatttcaatattatggattcctgtattataactgaatatttgatggttctatatatagttaataaatctttttatttccatggtgtcatttcctattcaaaatatttgtaaaagttctacttatttatcttgacttagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatggtgtgtacctaaaagatatttcagctttctttcttgcttagttatgagaattaattattctaaaccatattttagtacagtctattggtccttcatattcatgggttccacatctatggattcaaccaatcgcagatcaaacagtcaaagaaagatgggtgcatctgtactgaacatatacaggcttttttttcttatcattcttccctaaataatatatagtataacaactatttccatagcatctacattgtctcaggtactataagtaacctagaaataacttgaagcatatgggaggatgtacatagattacatgcaaatagtacaccttttttttttttttttttttttttttgtgagagagtcttgctgtgtcacctaggctggagaatggtggtgcagtcatagctgactgcattctcaaagtcctgggctcaagcaatcttcctgcctcagccttctgagtagctgggactacaggcacatgcccccacacccagctagttttttttattttttgtagagacagggcctcactatgttgcccaggctggtctcgaactcctggcctcaagtgatcctctcacctcagcttcccaaagtgctaagattatgggcatgagccaccactcctggccaacaccattttatataagggatgtgaacatctctaggttttggtattcatgggggcagagggggtcctagaaccaatcccccacagatatcaagagagaaatgatatcttaatgcactactatttttttctgttttactcaacaaactatttatattttttaagttggtgttactgtcttgtaattttttacacccgtagcatattgttttgtgtttcttagcgtgtttctacttttaagagtaagctgcctgtacatacacaagtgcatttgtgtatgtcaagttagatgtacatgggtctcctagaattttattcactttctggaagaggtctctgtggggaaaagcttaataagtggatttttaaattaatttctttttaaatgtagttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaaggtaaaatcgacttggaataaaatatgtttttaggataatggaagataactaatgtttattacttgcctaatatatgctagttaatgtgctaaatgtttttattttgtctcatttaattctgaaaacaatcctggattaatttgccccatctgttaaggaaccaggctcagagtaagtaatgtgccaatggtcatatagtaagtgcctaaatgtgcatttaaaccaagtctgactccagagcccatgttctttttagtaatcttgctacctccttaatggtattcagaggtattatttccgatgcgcagttctttactaccagcagaattccagtttcactgagatgaatgtgatgatctagtacaaatattatcaaactcctattgtagtgtttcatatagggccatgaacttccttacatacaagccttgttatatgtcagacttttatactatat

SEQ ID NO: 96798 - DNA, 1012 bp, Homo sapiens
cactgtgcctggccatattatatgtattatttgttatatactgtaagcaatagaattgaattgaaccagtttgctttggctccataaaatacttgatcccattgtttattatcaagtaaaaggataagttttattttatcaggtagcttatccttttactccatggcaacaaaaataattatccttaaaatgatttctatctttataaatgttactgaaattgaagtcaggcatgaatatttagaccttttgctcttttcccagtagtgaaatttatgtgcttaaaggtacaataagtataaagttacatatatattaatttttaaagcatttaacatcccaaacctaattatatgtaccatttttttaacagcaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggttagaactcataatccgatacaaattgttaaataagaaactatatattttaaaactctgttacttcttcaatatattttgtgttcccataatcaatgtttggtaaacatgtaaaaccttaattctcattccttttgcactcataatgccccttcactgatacacacttcctcctagcccttgatattcttttgctactctttctgacatcagacataagctgttctttctttctttggtggacagagacttgtatttccatctatattaccttttatagctgctgctccatttctctttcttcccattgtcaaacttcccaataagtggtttattcttttacaataagcatacatcctgacagtaaccccctgcaggtaacttgcttaaatctaagatcttcatcataatcctcattccttttcaaatcttgttaatgtttgaaatttgtgatcacttccttctccttcagacttcttccttttttgaatttt

SEQ ID NO: 96799 - DNA, 1047 bp, Homo sapiens
attgtgtgtgtgtggtttgctatgttttgttttgtttcttctggggatagggtctgcaggctggagtgcagtggcatgatcatagctcactgcagccttgaacttctgggcttaaccaatcctcctgtgtcagcctcccaagtagctgggactgcaggaacaagccactaagctaattttatttttcgtagatactgggtctgactatgatgtccaggctggtctcaaattcctggcctcaaatgatcctgccacctcagcatcctaaagtgctgggattacagacatgagctaccatacctaggtttttgtgttttttttaaacataatgttttatgtatctctctaccagattattagtttatagaaaagaactgagtcttaatacctttccgcagtgcctataggagactttcattaaatatttactgattgaataaataaatcttaaaacagataaatgacactgtattttcttatgtataggatgaaggtgaccaagcagcaagtgttgaagagctggaaaaacagattgaaaaactgagtaaagtaagcacttttctgattaacatttaacttcttcacagtgttttagaaatctacattgtaaggggattagtttttctgactgctaagcaaaaataggcttttggtgagtaattaaaaatgaagattctgaatagcatttttgtcagaaaaaaaaataagatgaggaacactagaaacattcttacaattgaactttacaagcttaatgccaaggttaaaagcctgcctcttaaaacgtgatattgaacttaatcagagcctagaaagaaaatattctatactcttcagctcttcatataaatacaaaatgtcaattaaggcatagttttatttcttggaattaattactaaaaaattcagttgaatttcatagtaacagtttcagcatcttaggttttattttacatttgtatatttgtgggttttatttgcattggatttgtaaactgtggatgtatttacatacatcttgttaaaaattccatttcagaagtggtt

SEQ ID NO: 96800 - DNA, 1148 bp, Homo sapiens
cattccttcattccgtagagttgtgttgagacctatgggagtttaacctcacaagttggcctgtgagaggttctgtggacaattaaactctgacatatagggacatataatgatgctgttttttggttggggaactgtgactgggatagattctgtgttcttagttgttgttgctgctactacctttctgtctattcttccaaggtttttttaatgtctgaaaattttaagtactattagccaaaactcctttaaataaaactttaggagacattttatttctttttgcatcataggaagagtcttaaaaattgcagttagaatatttggctgatacatggcattttcaaatatttgatatctattttgaatatttattgattgaactgtatttttgcatgaacagattatcagacatttgtcctgctgatcagaagatcattttagaatctatatataaatattcacataaaagtcaagatttaagagttgttgagctagttatcttttgagttttcttttaattccaaatagaattcatgttactgttagcacaaataatgtgcctaaatacctttgtaactgggttccctaagtttgggtaaggagcggatgaatgagagataatggtacaactatgggagtctttttttcactttttttttcattgggtagtagccatactggtcagaaatatatatttgtgtgtggttggtgacagtgtggctttttataaatgcttataggaagtaaacatcaaaaacaagttgttatttttctttaatctgggctgtacctgcatcttcttattaaagtaggaacactgttggttactttcagatctgttcttacttagtcctcacaaaaccttcatgtagtaggtaacattatcaccaaatttacagatgaatagacttacaaaggttaagtaatttgcctatgtctagtagtgcagataagatccaaagaaacccgtgtaccttctgttcatgctttccctctaaaacctacaatttggagatagttcttctgttgtcattttctggaatgacaaatttcacacaattacttacaaaccttctatttatgaaattaggactatgcatgttaggaattatttttattctaaaaactcaatgtgttcaagt

SEQ ID NO: 96801 - DNA, 1812 bp, Homo sapiens
tatgaattgcaaagatagaatttaaacttttattgtctaaagaaaagataatgctcaatttagatgggatataaaattaataaaactcaggggcagaatttgcaatggacaaaagatataatgagattcattgagcttatattcttcatacttagaagaaagtcattttctctttttcttttaaacaagtcaagcaattacattttctaagattgtggttgctattaagttgcttttatcacaaacagaatgtttggaactgtaacttgttttcttaattgctttctaattaaaatttgcttttacggaatctagctaaacttattcagcattaaaacttaattatcttcctgccagaaaatatcaggcagaaattactcctatgttaagaggttagtttctttgtagtaatttgaattgaaatttattcagtcagttagtatgggatcagaaattattactcagccattgttagaattcttcttttcaactttcatcattttttttaatgagtctaattccaaagagatatctagaataactcttgaaagtgaatgcatcctgtaatttatggaaacatttcttaagtttcctaattctaattttttttaacattggtatatcgcttaacacaaaagaaatgccataaggtatttttgcatacaactcatgttttgctcttttaaaagtatattgagaagtctttttttccttgtcatcacttttcataatatttaaaggctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggtaatgaaatttaggttgattttaagacaactagaactgcataacatatttttaaaaacagaatttggagtcagatggattcggatttgaattcagttttgacatttacttgcctcagtttcctcatctgaaaaacaaatattacaatctgtatcccataaagatttttgtgatggttatgtaaatatcttgtagaatgtctatacataaaagacactaagactgaataaaagaagtttttttaatataatttcttgagaattctccaaagagatatgcagatttttaatttcaggtattttgtttcattctgttaacatactgtgttacatttgtacagcgcttcatgcctttaaaagtgttgtcaggtttagtgaaaataatgtattcctcaaacaccaattactatttctctagttctaggtatttttaatcaaagacgaataaggcactgaaagtcccatctcaatttacagtctcactgagaaggatttgcaaaaagaaaacataatgtgataactgctttgagaggggtattgacaatgtgctaggcagatacaacttaagagcatttagactttctgagtaataaactcccacaaagagtttctggacccatcagctcaggctataagctgagctgaacattaacctgggtaaaggtctagggaagagtgttccaggcagagagaaatgcatgaccaagggcacagaagcaggaaaccacaatgtgctttaaggggattgcaagtgcttcagtgttactggagtctcatatgcaacaatgatgaactaggatcttttgcttttttagtggcaggaagccac

SEQ ID NO: 96802 - DNA, 2024 bp, Homo sapiens
ttattaatggttgcttacttgtatgaagatacttcaagacactatgcttagttccatgggggttacagaaatgcccccagagaatttagcatcccaaaggaagctactggtacaatacaagaggggaaaaaaggtagcagcttattttactttagaagatacgaaatcatggcttttaaaaaattaagctgtttttattttatttgtatttcattttattttcagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggtaaaaaaaaacaaaatataaaatgttttaaatttgtactgtcagtgcattggtagatagctttagcatattagcagaagattatatagattgatctaatttttccacataatgtctcacaaagttaactgtagatttgtgtcaggttacacttcatacaaagaaaacctggttataaagcttaaggaatgtagaccattctcaagttattcttttttcctctagctgtaggcaaagaccaaggtgatttaaggaaatccttaagcgatattcatcaacaacagaattcataattcataaggcaactagaacttgtatgtgccttctgatattataccttgttctctctcaatcactgtgaataactgaagctaatcaaggcacctacagaccagcacgttaagaccctgtgctgctcagtggatcctcaataagttcatgtttatcttaattccaaatacagtatacattccagggagctttgctctagataatattgtggagagagaacctcccagatgcacctgtttttcttctatctccctcagtgtttccctatttattatccccagccagtaaaacctataacactttaagggtagaaaacaatactgttttttaacctccccactctgtcattcctgataaaatatccagatgaaacttggggaaaggttggtgtcgcttttatagtcatggaaggcttgataggtaatttaaaacttctgctacccatgaatttgcatactcttctccctgcctgacttggaaccaaggatttgaagcggggaaagaaagaaacaaatacttgaatatttgtctgtcttctattgactatttttgtgtctctttcattaaaaaaaaagtgaataaagctcttgtcagtagtatctaaatcaaataatatgaggatttttaatcttattgtttttatggtataaatggttgtgagtaatactgataaaaatgccaaacttttataggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcaggtgagcatatgcccaggcttttccgtgatttttccattttgaatttttctaatcaaaaagtaatacaaattgattatagaaaattggaaagttacagactagcacaaagaagaaaattaaaattgtacttatctcagtatttagagatggccactaataatattttcatgtatttctttgtagtgtattgaaaaaaaatttggattatactgtgtgtctgtaatacgtggtctttgtcacctgttttgtttaataattctgttaattctttatacataactttttttatatttttagttgctatggtaccagaatgtggtaccaccacaagaatacagaatttttt

SEQ ID NO: 96803 - DNA, 1048 bp, Homo sapiens
actgattttacattctcttaagtgttgtttatggtggtgaataatatttttctttcctcacaggtgctgtcttaagactagctaattcactttgaaagaactacttgtgcaaattcaaacatgttacttccactttcctgctgtaaatcatttgcttgctggagccacactaaaatttgtgctaataactttatttaataagatatgtagttgcccatgttcattttatgtacctgcttgtattaataagtattttattcttataacttggcaaatgattgaacaaattttgaataacaaaatagtctaggtcaaatctaatattgatattaaatatatacagtcataagattattttgaaaattagagagtaagattaatgaaaagcaaaataattcaatgttgctacataattctaagtttattccaacatatataatgattaagaagaatatgtgtacatggttttctttttaaggaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaaggtaatttatacgtcatgtacaccatttcattcataagtttaatttttccagttttcttacctgatttctttgccagagctgctattgtgaaagcctttcatttttaactatagcagtgaatttccaactctaggtcaatttgcctttcctagatagctagaagtaaacctctctggagctcttgtgctggtaatggcggtttttttgtttgtttgtttggttggttggttggttggttggttggttggttgttttcagacagggtcttactctgtcatttaggctggagagagggcagtggcaggattatagctcactgaagcctcaacttctcgttcccaggctcaagtggtcctctcacctcagtcttctgagttgctgggaccacaggcgcttgccaccatgcctggctagttttttgggtttttg

SEQ ID NO: 96804 - DNA, 1094 bp, Homo sapiens
cttattttcatactgtgcctttaagattccacctgtgagcccatggtgcagcttttgtggctttaaatagagtatcaggtggcagacatcagtaaataggaatatcccatttcattggtggtgtatgtgaaacaagactagtttaactaaattggtataaaagccttaaaaaaactctaatttattggtggcttattggatttgcaaaatgattttgtactgaaaataacctactctaaaatcatgaagttaaagtgactataaatcaatttcttcctgatctaaaattttaagaacaacacaaccgttagtttaattggccatagtatttgtggtttttctaatagcagatgtaaggtaactgacctgttccagccaaccattatgctttttgttctgccagcttttgaaggagcatcacaactgaccataagtaaatcttgtatgcttctgtttacactgtctccatgttcattgctttacctttttgcttttgattgttgtatttgctttctaaacctgaactaaaacatgcacagactggccattcttgtcttatatttagtatttactgtgacttgtctataaatgctaaacatgctatactgagtttttgttttgtttttgtttttgttttttcattggaaaatcaaactgttaattgtggctgagttattttccacattttatctggcctaataggaacgagagcgaaggcgacaacacatgatgcttatgaaagctatggaagctcgtaaaaaagcagaagtaagtgtatgtttctagaaaaatattaccttataaagtaatgctttttcctaaagcattggctcttctaaatataaatttttcagaatataggtttgttgtgatttactggttttcatatgcaaaccaaaagtttagagatagcaactgagtgttagaacataaaagaatgtaggaagagttccaatgtatgtgttagttttcctggctaagattttaattgtctttttttagtgtagtaaataacattggtttagataaaagtagctatttatcacaccagagtttcacaaaactagtattacagcatgcctagacaaatcctg

SEQ ID NO: 96805 - DNA, 1028 bp, Homo sapiens
agtcattcgttaaattttaagttaaaatgactactgaagaaagatccttgctaccatatttaccatattatatgatctctatgtaagtatttgttaggtagaagcatacaaaatcgaattgacattttataaataaaaaataattgaatattggccatttcatatggttcaacctaatgaaaaactatagaatctcagaaaaggaacttttaatacttttagcatgttctaaatcttctctaaaaatcacgtattaaaagtttcttatttttaaggaaaaagaaatgagaagacaacaagctgttcttctgaaacatcaggtctgtatatgtatagttatacaattgttgaatgtacattttataatattgcttaaacctatttgggggaaaatcttcaaaatattttctttaaaatttctgatataatttctgcttaagtttttccttcaacctacagtttattgccttgctttggtattggtgtctttttggggggttaaaaaattggttttatgactctgtgatttctgtttcataatgttgtgccaactctttctaccaggagttggagaggcatagactagatatggtatgggtatgtttatttttgtacatctaacaccgcattgtgatttggttgtgatatggttgtcatagcaatgcataaagtgtagcactggctgctgtcatattacatactgctgcatggctttacagcacagtgcattgcatacatctgcttgtctgtctataaagaagtatgatgcatctccaagattttacattgaattgtacaagccttaaataaggctgctctctaaaaatttacattactgatgtcacaaagaaagttggatcactatacaattagatataattatgacccgtattctcccatcattctagatgcaaaactgccattgaatacagtgggaattttgagtttgtttgatgagagaatatgaaatatattctggtttcatagacaaattttagaaataattttagaaatatccctttggagaa

SEQ ID NO: 96806 - DNA, 1032 bp, Homo sapiens
atgaaaaaatagctttcttcaaaatgactatctgaaaatatgtttagcagatactacatgtgtatagtgtatgtttttatttgtatgtatattgtatgtgtatttttattttattatgcagggttttttgtaatgctttgagctgtttaggagacatcaaatcagaaatgcaaattgttgcttaatacctgtatgtagttttgctagataagaatgaccccccccaaaactgttttgtgtgttatttatgtttatgtttatgtttatgtttaggcataaactagatatggtataggtatgtttatatttgagtctcaatctgattctcccctttataactttttctttgttaatattcagcaactgttttatctattaaaaatgaaaagcctacagaaacaaaagccaaacttcatcaactgttatttaccaataataaaattagctgcttttaattattttaacttcatgtatttgggggtgttttgttctgatttcctggcatggggtataggagagttgtccccttcctcccctcccccaccctgccgtccaccagtaactgaatactgaaagggggtagctgggtgagcctactggtactggaaacagccaccacagttatactttgtaaagccagggaactgtttattttttctacatagactgtcttactttattttttaaatttctaccttttcatgtctgccgttaatattaatttcatccatattgtaacttcatagaaatactgagatcagtgacattcctagaatggtttgccttaagccccatccccttggaatggtgccctgaattataggtggacatgaaaatttcacactgattgcctagtttttgtcactttaattcatacgtagtgtatagaaatgaaaaaaaaatgatgttaattatagagtatatttgagagtttatattcagaatggagagagttctaatcagctagatttgagggttgcaccataatgtattaaactgatttaaaaatacatgtgtgggttatatctgata

SEQ ID NO: 96807 - DNA, 1051 bp, Homo sapiens
aatgcataagccataaaaagtaaaatgtctacagttcttaatgaaaagagcctttttttctgagtcatttaatcagtaaatatgtgtggcaaatacttaatgtgccaggcagttttttctgtaagtagatgtcccctaaaggcattttcccatagagcaaattgtgaacacacctttcagtacagaaatgaagttgaaagcctgaatttgaagaaaaactaatgttcatagagaaactgaagaatacaaaaaaatgattgttggtttagagaagcttattctctgaggaagataaaacagtaggcacaatgctgcccagctaaaaattagggttttgttaataaggagtaagaggaggcttcacagtaaggtgggcaacacacagtttctggcacaattataatgctggtaattatttcgaattaagtgaagaacaaaagattggaagtcaacaaccagagttctaattcagctctgctgttaactgtcacacctaatgcaacatagccgtgggcacgaatggacactgagaacatgaaagatcagtaccagaaatctataagtccggaaatttatgtcactaatctaccaggtaggatttttgtggctaggcgaggcctatactaggaggacaactgtgtgaatccaaggatatagaaggaggagatattgaaagtcgttgactattagaggatgacatactttgagtaagtagaaagcatagtcagcattgtggaaacagttgtatcaaaccacatctttctcacttgtttttaatagatgacaccttttctcatggttcttactctttcacatctttaaagtgctatgtagtgtatggtataataagctatatgactagtgtgacttaagaatatctgtcataaagttgataatctatcaccctttcactgcctacctctggcactattaagtagctagaaatagacataatactaaattgaaaaggcataaggaaatccaacaaaattttgatttttttctcatgatgttaatttttttatgtgaattgtcaaatttcgtcgcaaat

SEQ ID NO: 96808 - DNA, 2611 bp, Homo sapiens
tatacagtgttttattgaaaaccatctaaaaataatgtataaattacagaaatacactaaatccaagttattaacatatacttttttaaagaaaagtttctaaactatcaatattattatttatattaatgaatgttttatattaaccaattgaatttttttaaaggcacttccaaaagaagaagagtaacagatgaacgtgaactgcgtattccattggaatatgggtatgcaaaataaggttttcctttttctttttcccccatatatttatgcaagtttgatgtatacttgatttctcattctctacaattaatagaagaagtacatagctgcatagtatttattagagcagaagagccggagcaaagggcaaggaatttggtatatcagaaaactgaaattaatcctgtttcctggaggtatggcagagctggggtgggatgatacagccaagtaggaacatgactgaaaaagaaccaagagcaaatcagatggcaaagggcaggagtacatgagactgtgagaagtttttgtgaagatagaattaaaggacagtaaaagccactttggtcaaaattgagggactcaaccagagtttggctaaaatggtttaattagaaatgacagcttttagactggatgtacgtgaaccccaagcagcagagagccaggtttactttactcctcccttaaagcttttcagatgtaaaaaatcagtacacattaacatgttactgaaatgtcagagtacccaaagtaatcaagtatgatttctaaaaattttgatggagtttaatatataaattgaataattaattttctagttgaattagctaaaaatctaaataattttgagagttaatgtatttgggttgtttgaggagtttatttttgttttcattttttatgttttctagagaacatgtatactttaacttatttttaatttttaaaagctttcttgaaattaagtatgtcataaccttcatttctgttatgtgtagctggcagagagagacaagaataagaaactttggagggcgccttcaaggagaagtagcatattatgctccatgtggaaagaaacttaggcagtaccctgaagtaataaaggtacatacttttcaccaaataatgtacatttggtgcctattaagcatgatcatgtacaaaaaaaaagtgtactcctttctcagataaagttccttgatactaaatattctcttgtatgggactattgtacttaacctaaattgatctcctataaatttagagccccttgatagaatatgcaaaacattagtgtcctgaagctagctatacatcaaagctgggttgtaattattaaaacctgaagtggaaaaatatgtgattttttcagtatctcagcagaaatggaataatggatatctcaagggacaatttcagcttcagtgcaaaaataagagtgggtgacttctatgaagccagagatggaccgcaggtatccactttttaaaaagtatagtctttgaaccaaaaagtagtaccataacctaaatgaagtaaatttcactacactctggagcattgcctttctttaattagttcatatggctatacatataactttgtggtaagcactcattaaggcctcaattaactatgtttcagtaacaaggagctttgacataataggtatctttttcatatttaagtaaattttttctgtttattaattcaaccaataactttacagtttatataggtataaaagcatctgcatcttcatatgaaatataggaaaacattagttttctgaaaagtacagctagttttaaaaactaatttgaatatgaagaccctattattataagtcagtccaaaagaggatatgtatgccctagtgttttggaagaatcttgtccatttgattatgccacgctatatgatgcattttcacaagtttgataagtttttttttgtcatttcttaaaattaggtgaatgaaatttctggtttttgcagaaattcagtttttacattaagtggtacacatttctgaacatatcaccacagctccctttgagcttacagtgttaagtacacatcctcaccagtcagcaaaaagaacccaccaaggagatctcatttcctgtatgttttctttaatgctttccctttgttccttagttgtattcagctgcatgtgcttattattccctttagctgcattgaaaggggtcccagttaaggagtgatgagacctagattcttgttaatccgtgaaatactcttgtaattctgaacaataacaaaataatgcccccttttccatccactttgttatctgccaaatagaaacgattataattacacttcttgtctcataggattatggcaagattaaaatgagatcatatgcataaaaatgtttcaaaaggctaaaatgctcagccagctgaagttgatattttccttcttccttgaacctctctctcttctgtcccattataatgcatagaaaagttttttggcaattaatattttctttgtgaatagggagcttttctatcctatcttaccctttaattttataattttgaaatggaaaaggtctccctcattc

SEQ ID NO: 96809 - DNA, 1010 bp, Homo sapiens
caggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggttattttcattttaaaatttaaagtatttctctaaatgctatgtgaaccaaacattttaaagggtttcttaattcagacttaaaatcagcgtcatttactatgtttcacacaactttgtgcatttctataatgagctcataaaatacaggagtaattgatactggaaatcctaagtcagattctcagcttgttattcatttgacattaaacaaataatcactttagggtgaatacaaatgatgcataaattaagacataatttcatcaacttgcttaatttttatttcattcaggaccactcttttttcatttcttctgctacttgttaaaatgcatcaccagctgttttgaacacagataaaattatagtcgtcattcagaaagtaccaaaaacctaaatctctatgaatgtt

SEQ ID NO: 96810 - DNA, 1012 bp, Homo sapiens
ttgctgattttagtgttaggagcccaggtctgatgctgacaacactactgattttaatttcaaggcaatcattttcaatgcagaattttaccttagattaagaaattcagctccttctgttaactcaaaggattttaataattctgctgctgttaatttttatgtaatattttaattatagtagcttaataaaattcatgattgtgttgttttcaaggggattctaatagttaaataagtttttgtttatagacataaattttatggcttaatagtttataatcttttccaagaaaattgtatttttctaaattgtttactcgggaatattactgtgcaaaggcacactaaagtagatcccacagaatgttgaatgtccatttccaccagcttagtatcttaaatctttgcttcaaagaagttcttgctcaggaagttattcattcagcaacctaaaattgttttttgagtacatatcaagcacagggttctgagcaatgtcttaggaagaccataaaggtgaataaatgagtgtttctaccctgaggaatttatcaaagatgttaagttatctccttagaggtataagtcatataggcatattctatgtatactaaaggtggtatggcataagagtacatatagtcaccaacttagaattgtttgacttggccgggcgcagtggctcacgcctgtaatcccagcactttgggaggccaaggcaggtggatcacgaggtcaagagatcgagactatcctggccaacatggtgcaaccccatctccactaaaaatacaaaaattacctaggcatggtggtgcatgcctgtagtcccagctacttgggaggctgaggcaggagaatcacttgaacccaggaggcagaggttgcagtgagccgagatcgcgccactgcactccagcctggtgacagagcaagactccatctcaaaaaataataataataataataataattctttgacttatgatctttcaacttcacaatggag

SEQ ID NO: 96811 - DNA, 1031 bp, Homo sapiens
ttcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtataatttttttcatggacagtatccaaacattattcatatttaggaattaactggtttatcttgactctcaaagtctgtagttttaaagttaatcattactttgagttcatacttttgcccaagaaagaagatgaagaaatgtttttaaagggacatacggtatttcttttacgaatttttagatttttagatattatcataaggcattaagaacactttgaaagtacccgtttttatctccaggttttactgcttgatagtctttgtcttaatagatgttaggaacttaccttttcatttttatatctaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggtgagttacaaattatttatacaagaattttactattagagaaagatagagcttctatattgtcttacaatacacaagtttaagttaaattctaccttcatttttatactttcttagtctccaggaatagaatatgtacagcagaaaactaaatttctctgattttat

SEQ ID NO: 96812 - DNA, 1060 bp, Homo sapiens
actcatatgaatgttacctgaatcaatgttcagaagacacaataaaaagactacagatttgcaatctgtaaccgtggcttcaatttggctctctgttgtggagatatattactgtatttcattccccaatcccgagtagtcataaaaggatgtatttctgttaagatcataacttttgtaatttattgttattttttctatattttgttctttatcagcaaatgccattaaaatgttcctagattgtacttaatcttgtggctccatcatttcaatgtttctccttttcagtctttctattggtgaaattttaactttcccattgttaaataattatgaatattttcaataatctacatgacagagcttgtactttttattgaggagttcttttataagttaattgattggtttgttaatttgttataatacatctcatgatttttcctctttttgtccactactattatgttttcttgaacacaaaacttcacttttatgtgacctaataaccactttctaccagctttggattttatttttcttgcagagtcttaaatgttccaaaaataaatctctctcgtcatatttatctacctcatcttctaccttttttttaatattttctgaaatgaaacataaacagttaaattccttgaccctaactaaagcagccccataggtcttttgctaccctactttatcttctctacagcacttattattatatggaataatttgcttttatattaagcatttgtgtaccctcccctatcaccagcactagtaagtttcttgaaggcaaggactcagtcttggacatacccagaaaggtgtgtgtggcatgttataggtaaatgtttggctactgactcactgtctgcaaaaagaaagaagactaaagctaaatgtgtaacttttgatgtatgtatcatagttggaattattttgtgaactgatctttttaatctgtcatacattttgaagaataacagtcatatgagtacatctacacatatgctatattgatattttcaatattctacatgacagagcttgc

SEQ ID NO: 96813 - DNA, 1976 bp, Homo sapiens
cagcatcaagctccatatattttctggaacaaatgaaacagaactgaacaaatacatttattttcttttgctgagcatatttcatagatatatttcctctaaatctttaaatttccttctcaatagaaaacattttccagagtataacatgcttatatgaagacttgggggaaggccatctggtaatgctaagaagcttgacggtacccatcacaaaaatgcaaaagtactgtacataggccccaagacaaccattttctttccctttcaacctacaccactgagcactgaagcaaacatgataaaagattcttaattgtttcctcccagggacacaggtatcagtgtcatactctccacctgttgttctgtacctgctcttggctcttctcccataggatttgtttcaatggcagtctcggtgtaagcgctaaggtcctatctctgagctactgccagtttctctgatgccagacactgactgaaaccatccatttctgattcccatattattttgaaccaaatcccagacatcatatcattggatgcatttttatatgtgcttccaaaagttaaatgcccatgcttttaacccttatgctatcctacctcttaagaagtagtgctaaaatcaagtaaaatctttgttgcctctacaatgtgtaaggcattgtacaagatcttggaggcatgaatatgacacagttcctgtacttagttctaatgaggaatctacattgacattcctaaacagaatcagtgctgtcatactaaaaactgttactaggagaacatactgaaaactcaaagaggcacctctttctacccagttttagagatagattctgaggtaccatagtagtgtctaaggcaactaagcagaaataacattatagagagattgtctattcaagtgaggcatactagaacttatgatttcaaaagaacagcactttcagatgatatgtggttcagcatgggtttgtgggagtgggttgctcaagtaaaatggagataaagggcattggaactaaagaagaaaatcctatactttttcacccagtatttcttcagttttcaaaacttttttaaaaagttgcttcattcattcttttcacatgtagtttgaaaaaaaagttcagctaattttgatacctcccatgggaggtggggtacttatctcagccattctcattgaaagtcattgattaagtccagtcccctcatatagtctgcatatacatttagaataaatattgatattttaattaaataattaaactaagactaaaatatacagcctgttaagaaaagaataaaacaattcaaggttgaatgagttttatcccaactgtcgtacaagttattcttaccacaacaaccaaaatagcctttaaaaacatatctgattttttatggtttgaaagtatcacatgttagggaatagtaaatgatactgccactgtggaaaacagtatggcagttcctcaaaaaattaaaaattgaattaccatttgattctgcaattctacttctgggtatataccacccaaaattgaaagcagtgtctcaaagaggtatctgtatacccatactcatagcagcattgttcacaatggctgaaatgtagacacaaccaaagtgtctatcaacagataactggataagcaaaatacatggggaggcacatgtgtacacatacataaatacatgttagtattatccagctttaaaaaggaaggaaattctgatatttgctacagcatggatgaaccttgaggacattattatacaaagtgaagtaaaccagatgcaaaaggacaaatactgtactgtatgattccacttatttgaggtacttagactcatcagaattatagaccgaagtagaatgattgttgccagtggctagcatggaaggagggatgggaagttagtgtttaataggtatagaatttcagttttataggatggat

SEQ ID NO: 96814 - DNA, 1154 bp, Homo sapiens
ggtgcatgctaccacaccgaggtaatttttacattttttgcagagatgggatctcactatgttgccaaggctggtcttgaacacctgagctcaagggatccaccgcctcagcctcccaaagtgctgggattgcaggcatgaaccaccacatgtggctgggacttctttttctggttctagtgttttcttctttttcttacgctgtggctgccaatgggtggcttgcttgctggctgacagcttctctactggtggtatccaggagatccagtggtggtcaggagacccagtagtatacactgtctagtgagtttcattggcatctcagcaggcagtttactagcaagttttgaaaagtaggtggctttcaaactaattttactgccactgtagctgacaggttcccagccatgtttttctggtatcttagcaagcagtgttttgtgtgtgtcagccttgactgtgatacctcattgagtttctctgccatccagtgggcaatagccacatcctctcccacaaagtctgaaacttagccttgggtgaatgaaggggttgggggaaaaagtcccttttcaaaggttatctttatttcattactctaccttagccctacaaaaagtacatattccctacatctccttttcctgtattatttagaggtcactttattcctcttagtagttaatcttctgttattaatcaataattctttatgttaaatttttcctgttcagattgttaatgcgatttcttcctcctgagtagatcttgttggctcttatcattggttccaggagtagggtgggtatgcagcttgcaggtggtaaattcacttctacattctgatcactctgcacttttggattccctcttccacattatgtcagaagctgtgacatctcaattttataaaatgtaggtcatcattgagtccaggtttcatttatctaactaagtaagctgagaagcctctaactatatgatctagcatattatgtattagaacactcttatcagtggatttagtctgctccaatttttaatttcttcttgagtgagaggtcccagttaaagccttgtcatcaactgcaaacatttgggaaacaaagataagagttgtgtcttctcttctgtgttttataaaaactgct

SEQ ID NO: 96815 - DNA, 2947 bp, Homo sapiens
ctaggtagaacttagctttcaaacttataaataacaagattgtgactgtgctgatacaagcccaaaacacatactttttcttcctatctaaatgtacatctttcatctaaacggtggataaatgatcaatgcttttgtatagttattcttggttcagttcccattgttcaggcatggctgaatatacattggtgtcattttactagtaatgccttcctgcagtgcagaagaatagcttttgcagttttctacttatactgttttttagacctttgagactggcagctaccatgaaaatttcacttttcttttaaaccagattttgccattagataatgaaggtgcataccattttacattctatttttaatgaaggatattcctagaaaagtttttaatattatataatataaagactgacaattttgagtttctcccatactgtattgttgtgggtttttttcctctaatgttcttatggttgtcacagtcaatgaaaaataccccatatcttttgggagattggtctgaaagataataactgatttggtaatctagcagactagccagttggagaagattgtttttgagattttagatgggtcaatataagattacttcatccttccttgaaaaatgtataaaatttggcttatttccttttctaaaactttaagagacactatttaagtatttaccttttattgaatgattttctaccactggtcattttatatcaataaaacaatcattgttatctgtaattaatgagtggaagtaaaaacaaaattcaggctttcatcattaactttaaggggagaggctttataaatctttaatattttaatgtgaaattacttgtttttgaaatctcctttgagaacttattttttagaacataaaaaggcctactgattttgctatatttatggttatctttaagtatagaagttttcttccataaatgtacttgagatatagtggattacaatagtcttatattattatttagactaactgatttatcagagccagatttatattgtatgtaatttgaggaaagtcttaacataggttgtagatgtaaacttaaattctaagggtttgaaacagatgagaaaagttatgggataagtcatcaaagagtgaaatacttcttttatattccaagttttcactttcattttttaaactatggactacctttgtcctttacaagtttgaactctacaaagctgccaagtgaagatccttagatactgacctaatgagaagagtgataagtgtacaagttctactgtttagaattaggaaaatgatcagaagtatgagtaattcagttttgttccaagatgaaacttgaaatttttttaaataaaacatagaaagccattgtgacgttaactggaaagttaatttatatatttttgtttggttggtttgtttggttttgaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtatccacatttacataagtgaagtactataaatcttccattctaatattattttcataatgttcaggtttaatacctttttttgttttttgtttttgtttgtttgtttgttttaatagagacaaggtctcactcttttgcccaggctggagtacagttgtatgatcatagcttactgtagcctcgtcctcctgggctcaagcaatcctcctgcctcagcctcccaaggactacagtcatgtaccactatgcccagctacgtgtttaaattttatttttattttttgtagcaacagggtctctgtgtttccagcagtctcaaacttctggccaccttctggcctcaagcaatactcacacctcagcctccaaaagcgctgggatcacaagcgtaggccaccacacccggccttaataacagttttatagtgttatgctagaccttttcacattttcttgcttaattcttaaaataattctttgagattagaagtattttaattttacagccaaggtcaaataagttgttcaagaaaatactacttacatatggatgtggcctagtcaggattttagcccaattctactgttttttcctctgtatttcattacctccctatatgtaacccaatatagtgtgttacttcttttgtaattaagtattaacttcattaaaattaataacctagtacttttttaaatgatcactaatatttctgcaattaataacttgttagaatataatttgaaaattataacaacattttagatgatttactatctttcttttcactgaagtgttttacaaagttctctaatgtgttttacaattaaaacacaaagttttgcatttcattatctttctaaacattttgtttaattgaggtgaaattcacttaacataatattaaccatcttaaagtgaataatttactggtatttaatgcatttgcagtgttgtacaaccaccacctctatcttgttctgaaacatttttatcactgcaaaaggaaactttgtacccattaagcagttgcctcccattcccctctctctcagccctggaagcgatcagttttcactttgtccctgtaggtttacctgctctgaatatttcatgtagatggaatcatacaacatgaccttttctgtcttctttcacttatcatattttcaagttcatccaactgtacatatatctgtacttcatttttaaatgatgcaataatattccattgtataaacatgtttatttttattttcaaggtgtaaatgggtcaataaatggaagtaatacatcatctgtaattggtatcaacacatc

SEQ ID NO: 96816 - DNA, 2374 bp, Homo sapiens
aatgcatccccatcattaaacaactcatgactgtgttagagaacagagcttcaactctggcatgttgaaactgggatggccttgcttagagtgtataataatttgagtattgacctggtgacagatcctggacttatttcagtggctttcaaccttagattaataggatgttttttatttcccttcttatgagtaaaatatattgaaaatatattaatgtatatatattaacagaaaattggcctcacttcctcaggtcagacaattttaattagtgaaaattatctacttaaaacattggttctcaaatctcaaattcaaaagttaatttatgccatttattttaatgatttttagcatgtcttcatgtttctagaaacattttatagggtttgaagagtagaaaatgcagcaggaaaagggtaaaataaaaatgtaataggtaaattattataaattttaactataaacactgaaatcagataagtctcatctgttttttatagtacaactttaagtgtgtttttttccctcccaggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtaaacatctgttacaaacagtgttcaagggaaggaggaaagcttgagaatgttcaagcaataatttgtctattgaacaaaaggaatagtctaatgcctggtatatttaaaactttggtgcaagaattggcttaatcctatttatcatgtgcaaaaaattaaacaccctaagtgtgttaggtggcagagcagttaattagatatccaggtatttaactagagaaataggtgtctgtcacaggagagagtaattcaggcaagtttttctcatgtttttttgttgaagtataatatacagaaaagtatacatagtgtaaatgtagagttgaattaatttttctcagccttatttgattttttaaaaaattatttagtgtgaaactaaagttcaggttttatgagtatttttacactcctatttcaaggtcttacttttcttcactgtaaggaaaatgagctagactcttaaatttctttatttttctgttttttgtttgttttgttttgttttctgaaacgaaatcttgctctgttgcccaggctagagcgcagtggtgcagtctcagctcactgcaacctccgccttctaggttcaagcagttctcctgtctcagcctcccgagtagctgggattacagccacgcaccatcatgtctggctaatttttgtatttttagtagagacggggtttcgccatgttggccaggctggtcttgaactcctgacctcaagtgatccgcccacctcggcctcacagagtgctggaattacaggtgtgagccactgtgcccagcctatttttctgtatttgatcaaaacaactagagagttgtaccacttacatggaagaagaccagtattatccaaaattctatagataatgaggatttagtagttcagtaagacatcagttaattaaaactttcgacaaacgtgcttcaatttgttatattatcttgaaagcctaaatttgtatgtattttctatagattaatttggctttaataaattttagtgaggtctgcatgttttagtgtatgtaagataatttaaaacgttatagcataattctagagacaaataggcctgaatttaaatctggctttgttagttcatagctgtgtgaccttgaacaaattatctgacctcttagcctcagttttctcatctgaaaaacgagaatcataataatagtatctgacttacagggttcttgtgaggattaaaggagttaagtcatatgtagtgctgagtacagtatctggtgcacataattagtccataattggtaactatcattattatttcattttgcccactttaatggttaataatttatcaaatccttccttaaaaggaaagaagtgtttttaaaactacgtgtagaaaggatagatggttaaatgtgtgtttcaagtactgtttcttgagtcatattacttctttaattcagttgtctgggaagcagggatgctaaggaggagtaatgtgagtggacagttaaagaagtcttaaaccaagttttaacatttccttcaaaaatattaataggaatttattcagtttctagcatggttgtttagcaagatgagcattccacagatatttactgaaatacaagattgctgaataaatatcaaaatagat

SEQ ID NO: 96817 - DNA, 1004 bp, Homo sapiens
ccacatgtcattccttttagagttaaaaaagaactttttgttgtcaaagtatgtatcattggttcttcattgttgccacaagagtgataacttcatttatttactgcttatgttttctgcttgtgagactacaaagtttagcttgtttgcttcttcccaataatgaaattaatgctgtaactatgcatctaagaatgctgcttactaccaattatgtattacttattatttattactaccaattatttattacttactaccaattattaccaattagttattacaactaattgtaattacagttagttattgcagaagtgtttctatcagtttctaatccttgataatttcaattattctggatttttgtaatatttaatatagcttttgtaattttgaggttacttccctcaaatttctttgtattaaatcacaactacatacatgtaattgatataatttaggaattgttatttgtaaaacataaattacagatgaccccaaattctccaaaactgcaatgttcagttcaacttgcttaccacacaaattgatggagaaagaaaagaactgatcatagtatgtttataaataaaacatttaacaacatttgagtcaggaagttgaattgactggtgagaaccagagattttatatgtaataacaaatgaaagtaaaaactggtttttatagttacaagctcatttttttgagaaactagctgggtttctgagaatttgccaaaaaaaaaaaaaaaaaaaaaaaaaccacaatatttctggtaacctatcactggtcttaaagataatgacatttgggtagcttttttggcagtagcatactctgttttattttgactcatcttcagtgctaatgcagtccactctgataaaacagaagaaccaattcaacaaaaacaatgattagctgatttagaagagacacccaagtttatgccctttccttgtcctcttacctcacagtatccttgtgggccttccttg

SEQ ID NO: 96818 - DNA, 1008 bp, Homo sapiens
gttgttatgaggactttaattaatatcagtaataacttagtgtaatagcaaaaagaacatcatcaaaattactgtaaatcaaagcaatattcaaattactggctcacatattaaaattcttaagtatattaatgtttaaatatttctgaactcaaaatgtccaaattctgtaaacttgaactttgattaagaacagaaagaagtctacagttactggtgacaaaacatttctctccaagtaattctcatttcactcttgcattctaaaaatgctttgagccagttaacctttatatataattttagaacaaaacaggtatatttctattagactatctcatacagaagatagtgtggtatggatggatagtatggatgacaaataatacaaatatattttatttgaaataaacaaaaatgcatacacagctcaatgggtacttggaaacaaactgttccttgactatattactgagcaaaaacagaactgaagcacaaacacgttttttttttacatgtatgtggagataggcaggaagacattacttgttttttttttaaactgaccttcccttaaggcctggtcatagaactgtaagcaatgtaaatgaatccaccattaccagttgttatattatatctatgtcacctgtgtattctgagattacacacatacctgccaatatacctgggacaggttattttatcacagttacacttgagttcttggcaggcaggactgaggaagagtaatctgaaataagttttacatcctatttagaagaaatcgttagtatttccttaaataacaggttacaatagaaagatactgcctggaagttatccttttcattttggttcattttcagtttttgtttatgatttacatagctgtttaattcatttgcttatagtacaatcctgccataaagtattaaagcacaagatacctgttattccttcaacatctgcatttttcaagttttatactctatatccacagtatgt

SEQ ID NO: 96819 - DNA, 1614 bp, Homo sapiens
agactgtagtacagcctctttaggtgctggtggatcagtaaaaaccactgcagtatcagaagtgcttggaaggataggggtagaaagtaatgaccatataccttgtctaaatcagtagcagcgcttcatggctaggaaacttttttaaacagtaaaatgtctctaggatagatctctctctccaacattaaatgtggcagaattaaaaaaaaaagacttacacttggatatagcaataacagaaaattacaaagcagagaacacaaaagaatcagacaatgctataggttcaacagtattccatgaggttagaaaactggttaactttgaaagctctagcaaaatatcactcttgtttataaatcacttatttatcatatgaccacatgttgaatccttgtctttccacatactgaagaatcctacattcagcctttaggcattctgcatttctttgctaatgttgtagctgagtaatcttgttccagtcaattttggtgcgggtaaccggaagctgccggcgcaagaccttgaatgtggtatctgacattgtttgacagttttcactaattgctgtctgatattcattttctgcattctctatgattttaataaactccttggcagtttgtgcgtcattcgaaacagttagcgaatcctgtacatctttatgactaaccaactgaacactgccatcttcgtaatagtgaacctgaatcttaagcactccaaccacctgggctgtaggtggtgtgatggtaaacttccactctgatctccaacgaccattccagaagtttttaggctgacactcatggctttcaatacatgcaataatagtctgttgcccatcgatagtttttagcataaacagtacagaagccgttggaataatggtctttcacataggctcttaaagcactgtcacaggattctctccaagacttcagacctccatctacttgttttggctgggggtcacttgcttttttctataagtgatcaaatgtaaaggaaattttgtttcttggatctaaaactctgctattacccaggtcccccatgctctgtaattatgacctgatcttcacatccttccatcttcacgggtgtgaactgatccatgttataatgggcaaatgcacgtgctgccctttccctgaggagactgtcattattacatagtagccgaatatcactgaatacttcattaaattctcctgcgggtgcatgagtgatgaatttagcagctatgcataccttctccttatccaacacacaatcattgaagttggccatcttgggctgttctcaacatttatattttgacacttaaaaaagacgattccttaacgtgtctattgttaatcgttctgcaatgaacatgggagtgcagacatctcttagacaaactgtttacaagtcctttgggtaaatcccacaaacaggatggctggattatatggtaattctatttttagttttttgaggaacctccatactattttctataaaggctgtactaatttacatccccattaacagtgtacaagcgttcccttttctccacatccttgccaatacttgtcttttgtctagttgagaaaagccaat

SEQ ID NO: 96820 - DNA, 2204 bp, Homo sapiens
gtgaaacatctgggcctggagagttttggttgtttgtttgtttaagttgttgttgttgttgtaagatactaaatcatgaattcaccttttaaaatgtaggtataggccgggcatggtggctcatgcctgtaatcccagcactttgggaggccgaggcaggcaggtcacttgaggtcaggagttcgagacctgcctcgccaacatgatgaaaccgcgtctctactaaaaatatatataaaaaattagccaggcatggtggcgggcacctgtaatcccagctacctgagaggctgaggcaggggaatcgcttgaacctgggaggcagaggttgcattgagccgagattgtaccaccgcactccagcctgggtgacagagcgagactcggtctcaaaaataaataaataaataaaataagtaaaaaatgtaggcatagaacaattcaggatatctttttctctttgaatgagctttggttggtgtctttcaaggaattcgttcatttcgtctacatcattaaatgtatgggcccaaagttgttccagatattgcctcattcttttaatgtctgtatgattggtagagagattttttctttcatcgttgatatacataacttatgtcttttctttttagtgactagaggtttttcaactttacagatttttttaagaacaagcttttggtttcattgagttttctcaattttctgttttttttctctcattaattatttccttctgtttttctatgggtatgattttctctttttccctacttttttttttttttttttgagacagagtcttgaactaacgcctgggctgagtgcaatggctcaatctcagctcactgcaacctctgcctcccgtgttcaagcaattctcctgcctcagcctcccaagtagatgtgattacaggcacccaccaccacacctagctaatttttttatatttttatttttagtagagacggggtttcactgtgttggccatgctggtcttgaactcctgaacttgtgaaccacccgcctcggcctcccaaagtgttgggattacaggcgttagccaccgcacaaggccttttcctactttctagagggaagcttagatcgtttatctagcacctttgtccttttcttatatatgtatttaatgctatgaatttcccttgtaattactgctgtagctgcggcacataagttttatgtgtcattttcttaccattccagtaaaaacattttctattttcctttgttaattcttctttggctgatgggtagtttggaagtcattaacatttagtttttaaaatcgatatccattttagttttactgtggttagaaaatgtactgataatatttgtgctatgattcttttggcttcccacttctgctttttcatgctagactcctctgggtctcctctgtacctgtgaaaattcttgattggcaaagtatttaggcagagatgggtctcctttcctctgtttcttttttgggttttgtttttgttgttgttgttgttgttgtttttcttctaagattaccccctaattttcagttgctctgcctgctttgggctcagtgctgtgacacttcgtacttcctgccgcctgagataatcatgatgagggagtgcacttagtaaataaatacatcaaacccagcagatctgctatatacagctctgcttttcaagagtagatttatcttcattctctgccagctagtttgtgctgaccctggagtcctttttcattcatgcacagtatacttgcagctaggcgtttggatagtttaaattgaatttgggtctcatacttgctgtggtttgctcactaccaagatttcccctttacattttgagatgctgccttagctctgaattctgacctcttgcacctttagttgataagcctgctgttttttatttgaccatcatctgtagttataactatgtgatttaggcagcagaccagaaagctacaaagtcatactttttacttcttgttaaccattggtccagactaaactctcctctgccattcttctgcttttggatgctttccagtatttcagggggctttttaaagcccaattttagtaattattctctgtggaggatttatacgaccacctcactccaccattaccagcagttgtctccgaccccaaaataaatcacttaatttaaaaaaattt

SEQ ID NO: 96821 - DNA, 1112 bp, Homo sapiens
gcctttagtgaatttgagaagtttgatataaatatggaaaagcagagtttattggcacaaatagatttcttggttggcaagttaaattttaaggttcaatctggacagagtgctatgtgcctgtagtctcaactacgcaggaagctgaggcaggaggattgcttgaggccaggagttagaggctaaagtgcactagggtctgcctgtgaatatccactgcacttgggcctgggcaacatggtaagaccctcatctcttaaaaaaaatttttaaggtttcaacactttattaaaattaagaggccattgggagatatacctaatgctagatgacgagttagtgggtgcagcacaccagcatggcacatgtatacatatgtaactaacctgcacattgtgcacatgtaccctaaaacttaaagtataataataataaattaaaaaaataaaataaagaagtattacaaaaaaaaaattaagaggcctaagtgccaacatgcatctcttatcagaagaatttgtataatattctttgcaagtcatgtttatttaatgttaggataaatatactaatcaacatttatgcttttgccttactaagtttacagtatattcagaaaacattaaagcaaaatatagatgtttggcatattttattcaattcactactttgtgggaacttttgaagagattttctgatttgccagaagaagccagatatcggccaggcgcggtggctcacacctgtaatcccagcactttgggaggccgaggcaggtggattacctgaggtcaggagtttgagaccagcctggccaaagtggtgaaaccctgtctctactaaaaatacaaaaaattagccgggcgtggtgggaggcacctgtaattccagctacttgggaggctgaggcaggagaattgcttgaacccgggagggggaggttgcagtgagctgagatcacaccattgcactccagccagggcaacaagagtgaaactccatctcaaaaataaataaataaataaaaaagaagaaggcagataaaaaataaaaaattgttatatagtacaatgttataagtgacttaattagggaatacacaagattaacag

SEQ ID NO: 96822 - DNA, 1106 bp, Homo sapiens
tatatgtatatgtgtacatatatacatacaaatgtacatttatacatacacactagtatgtataaatgtacatatatacacagttgctcatatatacatgtacatatatacatatatttgtgtatacatatccatatatttgtacatatatacaaatgtacatatatacatatgtttgtacatatatgcaaatacatattaaatatgtatatatgtatatcacatttgtttattcattcatcttttgagggatataggtgtacaagtatgttttcaagtccctgttttcaattcatgtagtaattttacattaactttttggaggaaccacaaaactgtttccagatagctgaatcaagcattgattttattctgttacactgtatagtgaatgtaaaagattaggctgaatgaatactggcttcagcacatacagggtatttttcttaaaagagaggaaaaaagccatatgtgttatgtgtgaaaacatatgtatgtgtaaatagccacctcttaaagtgaacttttaaaaaataattaagccttctggttgtatgtaaccccagttttgtaatattttctagaagtggtcgttgagtttgaatttcttagtccctaggaacaatgttataaaaggatgtttccacaagtaattagaattaaaagtgtatttctgcccatttttaagatatctattagttgccttttttgcattataatataaaatcactgaattatatctgactggaaagtgtttccaatatattctttttagtcaatttattttctttgatatatgttaatattttatattttataagtgagagagaggactataatgatttcattcagcatttttgagatcactcttacaagtataaattctggaattcaatatggattaggagaacaatgtttacctatcttttcatagatcagtgagggaccactaagccaaaaggcagggattatttcactggcttgataaggttataagagtgaggaaatggggagcaatattaaaacagggaaactttgacctaattacaagtttccctaagagggatatataatatcacaaacccacaaacagtaatgaattacca

SEQ ID NO: 96823 - DNA, 1059 bp, Homo sapiens
gtgttgggtgcctgtaatcccagctacttgggaggctgagtcaggagaatcacttgaacccaggaggcagaggttgcagtgagctgagatcacgccattgcactccagcctgggtgacaagagcaaaactccatctcaaaaaagaaagaaagaaagaaatgtccagagaatgagtattctgattaattttttctggaatagtttgtcttaacattattaaaatttgatgtatttgtgcaagtataaaattgaatattttttgatgatttgaagacatagagggctactgggtcctgatttgacaatctgcgctattactaatctagtttggtaaataaagtataaacaaatattaaatgagtcttgatttgataatttgagcaaccagtctagttttataagcaaagtgtaatcaaatattaaatgtgttacagtaattaaaaaaaccagagatgtcaaaaggagcataagattaattgcttaatgagtgatatgtaagtaaaatattatgagttgacagtaagagagcggtcattggaatgaccaggaaagctcctttaaggaaaaggaactagaacagtatcttcaagcactgaagaaggacttcaaacattaatttttacaaatagcttttttgagatataattcacataccatacagttcacccatttaaagtatatagtttaatggattttggtatattacattttttttacattgcagtaaaatatctataacataaaatttgtcattttaaccatttttatctacacaatccagtggtcttaattacattcacagcgctgtacaaccatcattagtgtatttccaaaattttttcatcatcccaaacagaaactctgtaaccattaagtaataataactcctggtcagatgcagtggctcatgcctgaatcccagcactttggaaggctgagacggggtctcaaggatcacttgagaccaggagttcaaggccagcctgggcaatgtagtgagacctttgctctacaaaaataaaataaaatagctgggcatggtggcacacgcctgtggtc

SEQ ID NO: 96824 - DNA, 1824 bp, Homo sapiens
aaattgttcagagtagagggaagaatgtatgtatatatgtattatggacatataagtgcaggtgatctatgtagtaagatgtttaatttttaaactgtagtattaggtatgttgattatataaaaagaaaacataagattatgaaaaatcaaaagtagttactgaagaatgttatagaacctaacatctaggaatgttaaaaaatgggataatgtaaatagactccttcttttgttgaaagaattaaggtagtttctttcacataatgcttatcagggttattttaggtaactcagtaatttttgatataaattactggcatattctgaggagattctaaaggttaagtttgtgagtattctagcttagtcaagttatcaaagtaaaagttataatagtgcctctattttaatttataataagtaatttatgtcatttattgaatacttactatatgcaaacctctgggctaattcttttgtcatttactattcatgataatcacatgaggtggaggtaccattattacttccatttttatcaatgagaaagtaattgtagagaatttaaataatttgattaaggtccttagccagtaaataccagagccagactgaaaacactaacacaattcagaatccagaacagtctccagtgtcatacccttaaccattgtgtttatattttggagatagtaaaggtgcttacacacttgatttggatggttttatttttttcattaatttatcaaatattatggaatgcctaagtatcaggcactttaaggaattacaggcaatagcattataaagcagtacaaaatcccttgtctcaaggagcctgcagtctagtggaagaggcagaaaattaataggctgttaacagtacaatgtgataactgataaaatataggtcagtacagaatgctaaaggtgacgcaaaggagagatatccaatgtattgttttatttccgtatttaatttgcatatttgtgtggtgttctaggtacatgggaaatatcagcaaatgaaactttcaaaggtctctgcttttgtggcacatgtagtaggagtggagattaataataataaataaactgcatagcattttagaagatgacaaatgttatgaagtaaagaaaaaggagcaggatgtgaaggttaggtgatgatgggattcaggggctgaggaaggattcacaaaaaagatgatgttgaggaaagattaaggaagttagctatgtggatacctttggaaagtcttccaggcagagggcatgaggcaggagcatgactggtttgctcagggaaatgaatggttgtcattgtgagtacgggtatggagagagagagtaagaggaggtattgtcaaaggaaatgagtgagtgggttattcatgtagggcctcagtggggactttgaggagccactccagggctttcagtatttttaaaaaggatcactccagctgctatgtttagaatagactatatgtaaggagtcatggaccaccagttagaaggttcttagagtaatctaaatgagagaaggtagtggcctagtagcagttaaattctggatgtttttgaggtacaaccaaaaagatttctggatgggctggatgtgagatacaaggaaagaggagaaaagatgattttaagggttttggcagctggaaggatggtgttgccatcacctgtgacatagggaagaatttcaggtggagaaggtgtgggatgaggatgaagaatcaggactttgactttggatgtggtagaccaaaatgttcattagatatgcaagtggagatgtgagaaggcttta

SEQ ID NO: 96825 - DNA, 1033 bp, Homo sapiens
ctcattttgcacatagttcttaatatggacgactgagctctgtggtttcttggactttccagagtacaggggaattcactctgaagctttttgtctgtatagcactaccaggtccagttaaagaatgcctcagaggataagtagggctgaaatatacccaagagaaggaaaagatatatttttctcatttgtcagctctgagggcaagtctttttccaactggtttttgttccttaccttttaactgaattgtaaactcataatatcaaaagttactgcctcttgataaaaaccaccttcagtgaaaccaaatatcaaatttatttgctgtacctctttatgttttcatttcatcgtgctctaaatttgacacattataggaaactaagatggtcataaatcattgaaacaattgaaataataattttctgatttaaaattttgttttgttttggtgtatgaattacatactcaaagctacttatgtggtaggaattacatctcaaattttctataaaggaaataagaactgtgttttgcattccatgtgactactatggtttttaaattatttaatgttaacgtgaccaagaaattcagctggaaatgttaacttcgtagttgtagttttttgaaaacttgctatttcatgtgtcattgtagtaaaggtggtgattagtgatgttagcaacttgcattaatgtggctcaataccgaatacatactccttgaaatgacatattacgtatatgtaatgagacctgttctgagattctatacccttggcacagtcttctctcctgggtgttctttttgttatttgttatcattctgttttgttctatttcagtgcattataactttattttgcaaaatgaataaatacaaacctaatttaagtagtataattttaatatcttaacatgattatattgttgtaacgggctcttaagagctttttgcattaaaattaaatcttacttgttctaaatagttaggatattgatgcatggccttagtaaatatagaattt

SEQ ID NO: 96826 - DNA, 1323 bp, Homo sapiens
atctaaagactactaccttttacaatagcagaattatatattgagattactaaggtttgaatttttataaaataggaagttcagaaataaattttaatggctacacattggaagaattctttgaatggtaataaagtaataagcttcataaattttatgttatgagttcaaatacgaatcaaactgtattggatgaaaattgtcatttaatcttcgtcattttgaggtttgacactagcttacaaaatagatttggtttttggtagtgttctcaaaagttgtctcacaattgaaattattttgacaagcttgaaaacagaaaagcccaaggtttgattaaatatgggttgattgtataccatgcagaaatcacctgtatggtaaaaatttgccttctggttcaattgatgcaatcataataaatatcctagttatgttgaacaaacatgagctgttataaatatatacagcagtttattaatgcattatagtaagtttatttgtatttagagtatttgctacatgttgagcattttgttattcatggtgggtaatataaaagaaggaatttcaagatctaataaggagaatccccaaataattatatagtaatatatagctaaattatgtagagaaagcttttatgggcccttcaagtagagtctgagagagagccatcctgaaagtgatgagacctaaactgataatgaggtaggagaagagatatgaaacaacataagcataatctgggaggcaggaggacataaatttaggatctttgggaggcagagagcagaccaacccagtagtaaggaagatatgatttgctacaacctatttacctgacatgaaaaccagaatgcatcattgttacattttattagtgttcaggctggatattataccatggtagcatgtcgtttgacatcactggtagatcttgttttttcttgtataataaaataagagataggacatttcctttgtatcagttttgctgtctttcctctgcaccagtaacaaaaagtaaatgttctaaaagtatgcaaatatgaatctaaattgatgcaaactgaatgtgaagacagagtcacatttatctactacggttagaaataccaaactggggaggattaaacatcatcatagattggactcccagctgttgtaatgggcaggatcatagaaggaagatcaccaacgaaaagaggaactcatttcagttaaaaagaaaggtcccttggccagtctcagctactggggaggctgaggcaggagaatggcgtgaacccgggaggcggagcttgcagtgagccgagatcg

SEQ ID NO: 96827 - DNA, 1063 bp, Homo sapiens
tggagttaaatgattaacataagtacttagagatttcagggcagagatgcaagtaaacttaagtccctaacttctaattccaaaattccttcttatgtaacacacttcctatcactgtacagtgcattgtctttttagatgcttgttcatgagtgcatttattatttccgcagtttgaggccatgagtcttgttttaaacttttttgttctccccgtaatattttgcacataataggccttaattcattttttatttatttggtagagaacatttactttcagataaaagtgtaagactttattttcatttgtacggatattatagccaaggattttactgcttttgtttaaaaggatggaagaagtgtttttaatagttcttggtagttagcattctacaaaatataattgaaaaattctctggttttattttattactatgtaaatgggtttcacttgtttaaaatgttaaaaaacattgattagagtacaaaactagaaatgttatcaatatttcttcattgttttagtgttttcaatttctaaggaaataaaatattttataaaaaataattttgtggcagattgttaaatggaaatacaatgtacttctgttgtcttagtttctaagccattgaaaactatgtcaaactaaagtcattttaggttttaaagttttaggaatatatttgatttcaggtacataaagcaaaaggaattataggaaagtatatgtaagtgtatagataattgaatatatacactttaaaattcttttgcaagttagcatgaataaaaatggtactttagagagcagcttaaatacctctcaggtgaataaagcatgggcttcatgcttgtagttggggatatatgtatcatctgctgtagatgtattacaaaggtgatgtcaaggtgaaagcaggcttgcagaatggttggaaatcattgatattctgacttggaggctgtaaatggctcggtggcagatggagtctttgtcaaggaagaaaaatggcagctttggagcacatagatgttttgctagcagctcagcatata

SEQ ID NO: 96828 - DNA, 1051 bp, Homo sapiens
tgagataagcaaccagaaaatacaggacatagtagaccataatgagaacttctgtttgtttaataacaaggacttttggctggccgcagtggctcacacctgtaatcacagcactttgggaggctgaggtgggcagatcgcctgaggtcaggagtttgagaccagcctggccaacatggtgaaaccccgtctctactaaaaatacaaaaaattagccagggatggtggtgggcacctgaaatcccagctactctggagtctgaggcaggagaatcacttgacacaagagacagaggttgcagtgagctgagatcatgccactacactccagcctgggcaacggagcgagactccatctcaaaacaataataataataataataataataataataagggcttttgtttgtttaccctagagcaatgggaaatgtttgaagtatgtttaaattatcaacaacccgattttaattgaggcttatagaagttaaataactctctcaaggtcatacagtgattaagcagtaaaacaaaggtcataatccaggaatgtttggatctaacatctgtatcaccccatttcttagaaatacaaatctaggaaatgtgtaaaaaatttaaaggctgaagtttctgtgacctgatgttattattatttcagcagatgaatgcctactatgttgagagatgtgattttaccctttgcaaatgtagtcacatttacattaattttgttagctctgcttgtgacttgttgcttctcagtaaacaggtgaaccacagttttcaacagtgaacattagaataaagataggtttgatctattcttatgatttcttctacttttcagttcctgctctctaagggagaactaacaatgaaggtacttatataccagatagtttccaagtatcgttttgtcttagacttagtgaaattaagtaactgctcctagttgacataactagtactggttgtaactaagattcaaattcatatttcactaactgaagaccatgctgtttttactacaatactctcaaaggatata

SEQ ID NO: 96829 - DNA, 1091 bp, Homo sapiens
ctgttgaaagagaataaaactagtattacttttaaagttccaaaataaaagagcttttttttttttaacttttcagtctgcatgaactcctttctcatgaatgagaacttaagaactcatttaaataatttatagttaaattacatataagtacaaatttaatcattttcagcagttgattcatctgataatttttttgttgcatgccttaatccagtcatgatgaaaaaattacatgctttttctttttcaagctataatctattgattttcatagtttttgttgaaaggctgcatgctgctttaatatctacctttttctgattatttgacaatttcaagtttttgttgaatgttaacaatatgattttctatggacatcagctgttcattagctaggcaatacatctgatgggtgaggaggaagagaattcaccagagacagaccaaggaatggagagtgactgcttaattgatatgttgtttcttttgggaatgataaaatgttccggaattagatagtggttatggttccacaacattgtgaatgtactgaaaccactgaattgtgcactttccagagattaaaatggtgagttttatctcaaaaaaatttattgtgatttttatgtttatttatttttagttttttgagacggaatctcactctttccccaggctggagtgcagtggcacaatcttggctcacggcaacctccgcctcccaggttcaagcgattctcctgcctcagcctcccgagtagctgggactacagatgcgtgccaccatgcccagctaatttttgtatttttagtagagatggggtttcaccatgttggtcaggatggtctcgatctcttgacctcgtgagctgcccgctgcagcctcctgaagtgctatgattacaggcgtgagccaccacacccagcctgatttttaaattgtaatattttagggaggaatacctgaaacatgtggaatactgctactctggatattgcaaactcatcctggaattaaaataatgtgcaacattctcaaaccctcttattttagctaaaatgcccaagcaatatgccattgacgaact

SEQ ID NO: 96830 - DNA, 3553 bp, Homo sapiens
catttaaataattcttcaaagagcataaaatttgtaacacttaaaataatttgccattacaaaaataaatacttaaaatatgaaattgattagaatatataatttgctcaaaacttcctctacaatataaatttttaacacttatgccattgattccagaattatgatttcctgaaatcaaagtttatagggaccctttccttttaaataggttgtacattactgactaaagctaagatttatattcagacattatgctttctcaaccctttttacatagtagccatacaactccttaaaaagaaaatcattctgttacctttgactatgactcaatatttaagaaatgtatttactcataacatatttttgttgaggtagatattcatataaatcaaattaaggaacattgaattgtgtatgaaatgtgaacttttttttaaaggactcctgatgcttagtttatctttagagataatatagtcttaattgtactacacataaacatcctgtagtttaagtaggaattttcaggcatcagatttctagaaggaaggtaattctcaatagaaaggtcattttaaaagttcaaactttgatttacagttttttctgttgaccgtattaagtatgaaattatgggtaataaatatatttaattcattttcaactgcatattgagttataaaatattggccacatgtttattgaaaacaggaaaagtaaatgaatatatatgacttttaaatgtattttgagtgctatttgatttgtggcagtcataatagagtttgaaatataaaatatttaaaagtatggatatttacagttaaacattgagtttttaaccttaatagggttttataagaatatgaggtgaaaatatagtttttattccacatacttaaatttttactatataaggtaagagtatttcaatttgttttaaaagataacgctttaaaaatagtttttataatttataaaattcaacttgtactttggcttttgaatgcctttcattcaaataaaaactattgcatattggggataataataatgatggcaacatagataagaacctttactaattttgtgttgtgcacatgtgtgcatggtatataagaaaaaggagcatttggtttgaagataattcttggattagtacttcagctatgtgtagacataattgggtgttttttcctgttttctcctcttaacacttttccacaaacatgcactcattaatcaaagacggtgcactcctgctgagggcagagaggttcatcaaattggcagtcagtttggtgtaaagaacggtgtactgaagctcttaactcgctaggacataaataaatctaaggtctttgtatgcaaaccctagaggttaatactgtataattcagtgtcctgtctttgtttttatgattgatgtttttaaatgtttcaagcttggtgaaagtcttctagtaggtcaggtctgacaatctgattggctgtagtaagaaagcattaggttgtcagaaggactttgagtatgctgcagagattttgattttttttcctatgagatcattgtcatattgcctgagctgttataggaatgtaccaatgattgacattgcctgctgtgataatggacctagtgcatgaaatgccaatagttcggtcctatttgttcagaagcttactgctatttgtatccttaacacagctaacatgtagaacaagcaaaactactgggatttctctgtagaaatagtgctgggatttggctttaacatgaattggttgcatattcataatttaagaacagctggttacagcaagcacatagtcatttgcaagctattataaaccattccactcacatggagcctgtgcttggtgatttttttttttttttattgatctacctgcatttaaaatctggtcactgctgctacagaagctctttattttagctgtgtttgcaacacagaacaggttcaattttaaatatttaatttaaacttaatgctgaataaaatgaagaagctttgaaggaaacaagtgtaaaaggtcatgtcctacctgtcacggccagaatcaaccaaacaaacctagattatacaactattgtaatttttggaatatgtgttttatgattttgtccatagatcaataacagaattatcctggatttggaaatattgctaataatattttactagttatacatagttttgggaaacaacattaacagtagattgtgattaattagtctaaaacaatgtcatctaatatgtagaaaagtagtataatacttttagcttatgagtggtggtgtaaagcaagatagaagggaaaattggcatgactttataactggattagaataatgctaatcctaaaactatagagttactctagttttttagaagaaatctaataaggagtctcttttgctttttgagtcacttctggagtattaagcacaggtatgctcttacagtatttaggtggtattggtaagttaggccagctataatagtttcctgcatgttgtcagtaataactgtaaggaaagaggagaacacctttgtgtctcaagcttttagtgagaagggtgggaggagaaaatgttaaatgctatttcagctctccttttaggaatcacagggagctgtgctttgatttgtgtatattaaaataagtgaatacctgagtgatttacaatgatgcgtttccacacatggtgttaggctcacatgtgcatgtatgtgtttgtccccacactagatgatgaagtagctctcagcacttcaaggttgagtaccagtcctaagagtgcattttactctttcttggcttcagaaatggctggataggtttgtaatataacagaatatatggccaaatttaatccagctgatagtaggctgtacttttttttaaacaacaaatccaaaggttattaaaggatgatgcattgtgttttagttttgagttgcataggatcataactataattagttaactttccattatttgagattatatcaggcattttgtaaattattttatgtcttcttcactcccttttgactattgtcctttcatttatttctctgctctttagcatctcatcacagaataaaggaaggaaaattcaaacaaatctggttttccctgccttccccacttcttgatgaagaggggttcttagtttttgactaaaatgcaggtttgggattttatttgtctgccttttctggttctcattacataattatatttagaaaagaagaagggtgagttaatggactggatttttatttttactttttatttttttggagacagggtctcactctgttgtccaggctggagtgcagtggcacgatcccagtttactgcagcttcaacctcctgagctcaagggatccccaccgcctcagtccgccaagtagctgggactacaggcttacgctgccatgcctggctaatttttgtatttttgtagagacggggttttagcatgtttcccaggttactcttgaactcctggact

SEQ ID NO: 96831 - DNA, 2077 bp, Homo sapiens
ttatttacattttgaaaagaaatgactatggaaaataccttaagataatggatactttaaaatttagtagcagatattaagtcaaacaattattgagtatttaagaggcagaattgattttaaaagttattttataatcgctagctataaactctttgtcagccattatgaacagataaacaaaaactagcactgttttaatttgcttgtctaacatagtttttcgcctcacaaaagttggtttggtcacatgaccaagcttaatgatacactgactagtatataaataagaggcactgtatattgaatgggaaagtggaattctgtctcctgtagtcattttcagtcagcatatttacatctcttctaacaaggacatgaaactgtctgtatttaatttgcattctctttgtcttctgggttgagggaaaaacactgactacaattaacttaaaaaaagctaatagaaacaattctgaatacattgaaaaggtttgtgtaacacacagaaatttatgttctatatggtaagtttttatttctgtagcagtcttctttggtgttatctatttatccaggaatttgcttcatgtaatatgctatatagaaagcttgactgagttgagtgtctgccatttatgtgaattgtaggtaggtgaaaaatgtttaaatagttaaaagcacatagaacagatggttctaaattatacatgcaacaaaggactagaagatttggcagattataaatggcaagcaacagaggataagcagtttaagaaaatggtagttaagtacatttgatgtctcacacctattgtaaacactgtacatattattgtcactctgctgcataatcagtaatttggacaacattaagacactcgtatggttcagatagaaaaaagtaatttttacaagtatttgaaacaagtggttgaatttaaaattattttaagcctacgatgatgaagagtcttttttttttttttttttagaaaatcagattgtatgctttaaaaatacaaagttatttatgagaacttaatattgtgttcttataatggttggagagaaacaggaatgggtacatattttaaaatccagataatagtagcttcactgttctcacatgttaaactagtgccgaattgtagtaccatttactcttacaaacactaatgaaaaaatacttctaaactcttcagtcttggaaatgcatttattggaatactgctggcatcatttatgaaatacttattaaatgaaggaaggatatattttagttttaatttttgagttttatacataacattatgatactgattttacttgaatattgtttatttacaatttttagaatagatggattcttatgcaggttttttctttctagaacagtctctgagtaattatatttagcattttcaaaaaattgggaatagcttaaagtattcaacttggtagaaatttgtttttattttttataagccattcatttaaaatgcacataagactgtaatggaaaccttagaattttaattctgttgccctttctcccatttctttgtttgcatgtttattatagaactgcagtgtaaaggagcagatgttttgccaaacatcctgatgtgttgctttttcttatgggagtgcataactgttccttctgatgcatcaacttgacagctggttgatttcatggagctgctaagaagccattagtggtgtcattgaattgaaacagaacagtcattcccagcttgaactgcaattgttaatgtctttgttgctacttttgtgttactatacaagatgtaggatatcacagttgcatgaaagttcaggatttctgtcttatctccttgaattagtgaaagtatattttggaacttgattacttttaggtttaaaggtttctcagagaagggatcttaagttgtagtttctgagtagaactaccaaaagaagagatatgatttagcacaaattaatatggtgattttgacccttaagaggaattacgtcatcaagttttagtgattattaatatatttgatttcctgggggattaattaag

SEQ ID NO: 96832 - DNA, 3579 bp, Homo sapiens
tgtggcgggtgacgggaagaagcctgagccctcctttggcgcggggcggcctcctcttgggccgtggggcggggggtcttcggagccctgcgggccgcgggtgtcgcgcgtgagctcgccggtgagcgcggggcaaaggcgggcagggctccggctcggccagcccggcctcgagtcgaagtgacttcggtagccccttagattcggccaagattgtcttattggtaacgtcagtttttgaatatcgtgacgccctgagagttatttttgtgttgtggtgaattgtgggttctgcaactcgaagtaggtgattgtattaaaaatggacctgttggcctaagaagtaaaaatatagaaggcgccgggagtaggaaactccctcattttggtgaaactgcgtattgaagatgtgtgtccaccccctcaccccaaaatgctgcacttaatactttttctcaagtaccaaagtaaatatattgggaaagtctatctgggtaataaattcgtcacgactaatgttgtttgttactattagttaaatgtgtgaaaactgaaatttggcgaggttttctcccccattttgtaggattgattagctatttttctgattacatgttattttaaatctccacctttctgtccagaaccaagatgtaggattaaagatgaattttcgatttaaaaatccaatagtatacagttattaagaaggcacacatgtagtgtaactagatcttttacttgaggtagcaaaaagtttgtttgagaaatgaggtcagtataatatttttatttaacagctctacagcattttgggagacaggactggtgcatgaggcagtagcaccagactcagaagacctgggtttgagtcttgatttttgccatagttatttaagttcacgagattgtctcagaaacatggcagttaatttctagagaggattaaatttgctgaggtggtgtgtgaagcagtcactaggggacataatactagtcttggtttttttccaagtttagtgctgggtcaggtgtcttgaattaagaattcctacttattcaagtacaaatgatttcttttttctgccacctggaagagggctattttcccagataaagcacgaggatgcccaggttatgttctacatgaaggtgtcaggtaacgaacttggacacaaaagtcatccatgactctcatgtagccaatttttagtccgctccatacccaccttacacaactcttttatctgctctatgttcaagaatcgtctacattttgacattttattgtaggaaaataattttataatgcaaaatctgtcaaatatcttaaaacttttttagataatttgtaatttgttgtagtcaaattacaaattatggagagcttcacattacaagaatgagcttgacatggcatctgccctccacaactcactgtttagtcatcagactaatgtataaacaactattattatcttaatatgactgtacagtggttctgtgggagcataggggaggggtgcttaatcttggaaattttacaggatttatttatttattgcctgaactaagatgtgaaggctcactaggactttgataaagaaactgcaaagtcatgatattatggtttgttttaggaattcatgatttgttcctgtagctgaaacatacattgaatggtaagttagagcccgacataaaagactttctgtactgtactagaaaattagtgtctgggtgtggtggctcactcctgtaatcccgtcactttgggaggccaaggtgggaggatcgcttaaggctgggagttcagccaggccacaaagaccccatctctacgggcatggtggtgcgggtgtagtggtgcgcactgctactactagctacttgggctgctgaggcagaacgatcattttgagctcacgagttgcagagactgcagtgaggtatgatagagctccactgcactccagcctgcaccacagagtgagaccctgtctctaaaaaaataaaaataaagttagtgctctatgctgcggaatggagagctattgtgttccttaacaaaataaaaataatttttagataatctttgctgatacatccttctgttaccacagataattaagtgccagtaataaagaacaatgggacatgaatgaatgaaatgcacagcgttgcattagactttacttttaaacaacaaattaactaatgaagcttttaactgttaaataagtgaatcaactgatcacattagaatgattacaatttaaaaagaatcggattttgagttcctactaagattacttgaattcaccaaagcagaattcaattgcagtcaaaaaatttatcttaatatacagcatttgctaatcataggatgagccaaaaagtctgaagttggggagaatgaaattataatttgagagtttaggtggggggggtaataattttgtgtgtgtgagtgtgtgacagggtctcactctgttttttaggctgctgcagccgcagtctcccagactcaagcagttctcccacctcagcttcctgggtagctgggactacaggtgcgcgccaccatgtctgactaatttttatatttttttatagagacagtttcaccatgtttcccaggctggtctccaactccttagctcaaggaatcctcccacctcagcctcccaaagcgctgtgattacaggcctgagtgtgagtcactgcatgctggggtttaattttcattaatcttaattttcagctttctgccctggcatgaacttacatggtcagagctggtttttcctgccctcaaatatatttctctgactctaccggttagactaggtaagttgaacacctggttttaaaatcacctgctgctctacacccatttttgtcaacagcttaaaaagaaggcaagttttgaaccttaaaagtagttatctttccattatgatcattgttcattagtgtgatgtttcatactttgtagaaagaaccctaaaatggtttctacttaagatcgaaacttgatgcttagagattaaattcatttcaaggagaacagtttgccttttacagtggtgtagtgtagacttaacatcatagtcatattttctcatgggatgttaagcttttttctaattttttaagatttgggcatgtcatatttttgtgttttaagtatttgtcagctaaaagttagttaagggagacttttttttaaggcccaaaatgttgtatactttcaaagtgattccctcattgacccacccttagcttccatgtctccatgtttactatgatttcccactaaggaaaaaaaaaatttccccagaagcagatttttttttttaagaaaaggatatgcaaagtatatgtaaataatgaaatagtaactgcgtgtttgtatttctgcaagactcttgaaatattgcattggggctgggcatggtggctcactcctgtaatcccagcgctttgggaggccgagacaggcagattgcttgagctcaggagttcaagaccatcctgggcaacatgatgaaaccccgtctctactaaaaaaaatac

SEQ ID NO: 96833 - DNA, 1030 bp, Homo sapiens
ttcagtacctgtaatcttccctggatatttaagatagttcccaggttagactcagttaaaatcagagttttcagagactgcaggcataagataatggtatggtaacagtagaaaataaggataagtaatgaatctttgttctatggctgcataacaaaccacctcgggacctagtggattaaaacaactgttcactgttttttacagttctaggtgcctgttgggcagttctactgattttgcccggggcttactcctcatgtaccagcattcagctggaggatttccctggctgggagatccaagatggcatcactcatgtttggcagctagtgttggtggacatataggccttactctttgtgatcatttatgacacaggaatcttgggacagtattctaagagaagcttgtaagacctcttacaaccttgaaaatcttacagtgtcacagtccattctcttagtcacacaagactggggtggggaagtaagactgcctcatcctaggcagtgcagcaacgttgcattacaaagggggctaatactaggatgggggacatttgtagccatattttgtaatttaccataggttctttagaccactataagaatagatagcctcaaagatgtcatgcttgggattgctttaaaataatagagtgggtggtaaaataggttagggaggttgaatgtggataatagttgaagacttgattggtacatggaagctcattattggctgtacctttgtgtatgtttaaaatttttcatgataaaaactttaagtcatactcaggtaatctgaacttcattttgtgaagtattttaactttatctttcacttagtctttactagagttatttttgtggtaagtagctactaaggctgtaaaccagcaaattagaaagggaattattctccttaggacttctgtaatacaagttattttaaaaatgccttttcctctggcaaataattgttgccctcaattaacaaagtacattaaagaatttttttgaaaactaag

SEQ ID NO: 96834 - DNA, 1181 bp, Homo sapiens
gtagaggcggtttcgccatgttggccaggctggtcttgaactcctgactttgtgattcaccctcctcggctttccaaggtgctggtattacaggcatgagccaccacactgggcctaataccttaactcttaatctgaggttgtggtcttttggagtccaccttattgtgaggaggtggcctgttaagattccttaccttgtttatgtcctggatatcttcagagtttcttaggatgcccagaggaatggagtcactcatttaaaaaagcagttcatttttttcatagctaaagcaagcccacaggtttgtgagatatagacagactacataaattgttgaattggtatgaatacaggttttttactcttgttgctgtgtcagccactattaaaatgccttaaggtgaagacatacttaacagagtaaaagtatgtcttattaggtaaactagcagctgcattatcagcttcagagaatcttcatccagaaacttcatctcagaagtcaaaaagttcaataagtgaaaaatctcaaataccaatcgtacgatttttgtctgtgtgtgtgtggctttgtagctaattagattccttacacactcaataccagttctggagaatagaaagtgtagcctcttgtcagtgcctccccttcctcagtcatagacttgttgatgaggaacatgaggataaaattctagtggatctatcatgactgggacttcagtgaggcatacttcactgccctatctgactccacttataaaacacaaattcaaagatagaatttcaggatgtcagttgcaaaacttttaatgaagcttggagcccacacctacaaaatcagccctggtgataagtttcttatcaccaaacaggaagatagcctaactgtccagctctgaaatgaaatctgaattttaaaaagcatgacatagtgacagaaggaaaagaccatttcattgaccattgaggaaagattgtacatgtgaactttttttgcgctatttgtttttaagtcttggtttaaaacattaagcttcaaatgcctctttccagtagtctgctcttgcttatacctttttcttttttctttttttgtttttgagacagtctttctctgttgcccaggctggtgtgcagtggcccagtgttagctcactgcaacctccacctcccg

SEQ ID NO: 96835 - DNA, 1009 bp, Homo sapiens
cctttagtgtcttcatagctgccttgataaaataccacatctgctacttgttaaattgttcatgggcttttgcattgtcactgtttaaccattaatattcttttctctaatgaatgcctttaaaaaatttccagttcagaatttacctctttttaatgaaatattttgtatggacttaccaaatacgtatatagtttgtaaaaagccgatggtagaaaagatttctaagttaggtgaccatatgctttatcatccaaatgaggccacttttaagagacagcgtaggtactattaataattattctgggataataagcataaattagaatttttcagcacataaactgggactgttctgggcaagtggggaaatatggtcatcctgcttctaaggaaaagagcagtccttttccttaccctttaccccatctctagtcccactttgcaaaggcagtgcccctctgctatttagctatttcttttaggacttacatactttcatttttctaaacagtgtgcttatactgttatttcatggtttttcattgtttcctaccattcttatttccactgcccacttccatctcacaatatgtagcaaattgattcagtagtctatatttacattattaagactatgtaaatattaaagagctcacctaataacaatcatgcctttcatgaacagctaagtttttccaagttaaaaaattaatttttaaaattgccttttcttctatatacacagttttttcaagttgtaccaccatctctaccacatgccaatgagatgtagtttccatgtgatgctttttcttttcttacaacttctgctacctgaggtcctgctccagtccgaattgtttgcttgccatgctttctgcatagcatcccccttaagttcccctttatcgctgcttcctgggtttcatatcttgttatttcctgcctcacactcccatttttctaggacacgctgttcatttagcttcctctggtagtgtttttg

SEQ ID NO: 96836 - DNA, 3216 bp, Homo sapiens
cagcaacgggatcatgattcaaaaagacctaaactttcctgtacaaactgtactacctcagctgggagaaatgttggaaatggtttaaacacattatcaggtaagaatgagtttctgtaggtattttaagccgtttttctccaggtgtaacacagttgttcttagttttggaatgaggcaagtagattttatatgaagacagtgggtcagaaatgtagtggaatttccaaaatcttactttaaattaatgctagaactgatactcttctgcatttttcttgtaaaattgatatagatatcctaaacaggacattagcagattttaattagaatagctggtattttatgataatcaaattggtaaatgtatgtattcttttggttattatattttgtaattgttacaaggaaagctaaatctactgatatgtttaaaatattgcttaagcatgtcttatataaatgataaacattgtagtacataatatttattttcagaaaatacggaggctaaggcaggatgatcgcttgaggccaggagtttaaggccagcctagacaacatagtgagaccctgtttctaccaaaaaaaaaaaaagagagaattagctgggcatggtggtgcatgcctgtagtccccagccacttgaggggctgaggctggaggatcgcttggtcccaggagtttgaggttatggtgagctatgatcatgccaatgcactgtagcctggtagacagagcaagactctgtttcttaaacaaaaaacaaatacagaaactcttgagttacaaaaaaatggtggttattttagtaggagttcttttttttttttttttttttttttttttttggagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagccgggatggtctcgatctcctgacctcgtgatccgcccacctcggcctcccaaagcgctgggattacaggcgtgagccaccgcgcccggcctagtaggagttctatacaagggattagaaagtcatagttttagtcctctaactagatgagtggcattgggcaagatactaaccactctgggatttggatggtctatccataaagcttcatgcctggtattatgtactgagacacatatttttcacacacgttgaaaagatcttttgttgaaaggtcaggaggctaccgtctcactcatactcctcttccaatgaaatgttagccagtgccagtgtttaagaggagccaaaacttgtggtgacacaattggaggtaaaattctttaaatgtttgtgtattaccagttgaagtagtgtaagcagttcctgtctattttgataagctggaatgccatgggaaagacgtgcctatctgaaggatattaagaatgttgtgatagctaagagcagactgttaataactttgtagacaaacaccactgtgccagagatatttttgttctcttctgctatgtgaaaacgttataaatactctaggccatttctcttaataaagaggaattattaaggctactaagattagggaagaaagaatcaaaatttcaaggtaaatagtgaaggaaagaggtttgagacttaatgtttaatttacttttaaatcatatctaataaaattacgataactgtaacaatactttgattcttagaattaagaattctagaataaaaaatcaagcaactgtggtagcagtaaaaataattctgatgaaattgtgttgttcacatcttccctttccggatgcctttgattttgatactggcagttctccagcatcactttcattgactttttttgtgaaattctccatctttggcaagatttacatttttgttctgtaatcgttttacataatgtataggtagatgttgtgagaagtgattgagacattgacattgtgtatggggtagattttaatgttaggcagagaagaatatgtttagagtaggaaataattttataagtgattagttcatttgtgaatagttttatgttttactgaattgtgtttctgataacaactatataaccggggattctcatgataaacaacagtaaggccgggtgcggtggctcgtgctgtgatcccagcactttgggaggccggggtgggcggatcactagaggtcaggagtttgagaccagcctggccgacagggtgaaaccccatcttcactaaaaatacaaaaattagccgggcatggtggcacgcgccttgtagtcccagatattcaggaggctgaggcaggagaatcacttgaacccagaaggtggaggttgctgtgagctgagatcgtgccactacactccagcctgggtgacagagtgagactccgtctcaaataataataataataataaataacactaactttcctctctattactgaagattgtcatcatccaaagccttgaaagctttctctgaaataaaacttcttcatttattttaagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatgtatgtataaattacatcaagtataacttctcataatgttccattttcctctttatgcatgttactaaaacaacagtacaaaggagtaaagtgtatattttgtcttatgaagatttcagaataccttaatatttttttctagtacttgttttgaccttaaaaaataatttaaaatacagtcgatgaatatgagtatctagattccatctacctttacgttgtttaacttgcatttttccttttaagaacgtctgttagaaagtaacatactaaatcgtatatcctcaaatagaatttgcctgtaacagatgtagtttaataaataactacttctgattattcttctacttctgaaataactgaaagttgaaatcaccattttaaggcataatttgcaattactttagtataacatggatgtgcctctagttt

SEQ ID NO: 96837 - DNA, 2637 bp, Homo sapiens
gactgggtttcaccatgttggccaggctggtcttgaactcctgacctcaggtgatccaaccgcctcagcctcccaaagtgttgagattacaggtatgagccactgcacacagccacactttgtatcattgtacatagccttaaactatcatactaagtaactgaagaaaaaggtgctaattgaagttgacaaatatagtaggcagaaatggagtttgatttacatagtaggaaataatgttttgtttttaaaggtttaggttattttaatttatcttactgggggaaatctttatttatgacaaatgaaaacattttatctgcttggctttggatggtagagctttagtagacagtatcaatagcttttaggttttggagtataaaagtacaggatagaaatagatttagttcctaacatttaccctttcataaagctccatatatcagcagagtagtaatttagctcttacacaggttaatgggtagtttctttgcaaaggaatcctgtagtatttctcatcccatttgaagatttaaaccaccagttaaggaatcctttgaaaagtgcagatgtcatagccctattctgattcatagttcctagccagtattttagcaaatataacacacgtaattctaaatattggctaggaactataggataagaaccacagctgttaacctgaaagaaaaaaaaattggaaaaatttttagctattagcaagatttttcataaaattacaagggtttaaaacagctttttaatttattgcacagagtaaaaaaaaatctccaaaacagtctccctaggatggatttgcttttaatcattttaagagtcatttacattgtattatttggcctgttcaaaatcgtctcaatttaaatactagatattattgtatcataccaaataatttctgatcaataaattcagctgttttaattttatcaaataaaattttcataagctcataatacatttcttttttatatatttgtaatgttgactttacacagcagtactggattttaccagtaggaatagaaagagaaatacatttatgttttttctataataatagtaaactctgtagttacaatataacagtattaagtttgaatccagtgcttcgttttggcattcaacataataaatgcaaataataatgctcaaattatttcatgtaattggttatcttcctttcaaaaatagatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagaggtaaattcgaatacctgtcttaagcctataaatcaaaaatagagaaagaactcttcatttcttttttttcttttcttttttttttttttttttgagacggagtctcagtctgtcacccaggctggagtgtaatggcaccatctcggctcactgcagcctcggccttccaggttcaagcagttctcctgtttcagcctcccgagtagctgggactacaggtgcactccaccacacgtggctaattttagaattttagtagggacggggtttcaccatgttggtcaggctggtctcaaactcctgaccttaggtgatccacc

SEQ ID NO: 96838 - DNA, 1081 bp, Homo sapiens
ttgttgttgagatggagtctctgttgcccaggttggagtgcagtggcacagtcttggctcactgcaacctccgcctccctggttcaagcaattctcctgcctcagcctcccaagtagctgggattacaggcgcctgccaccatacctggctaatttttgtatttttagtagaggcagggtttcaccacattggccaggctggtctcgaactcctgacctcaaatgatccacctgcctccacctctcaaagtactgggattacaggcatgagtcactacttccagcaggaaatttcatccctttacatccagtaagatgtttcattcataggtaaatagataagaattaataactgaaggtaggcaatggttggggcggggggggcggttgtgaattgtgtcagaaagtaaaggttattttaaccgggttggaatacatatacatgcaaagacaaaaaccttaatgtcttacccaattccttagtagactaatgctaaatggggttagtaagaggaactggatgaccatggattaccaataaatctgtcttagcctttattaagatgatttattaaccatttatttacatttctcactgcaaatctttttttggaatttgatgcacaaaatttactttgattcacaagataaaatttgatgcacaaaataatttttgtgtttgaagtccaagtatatactgaatattctctttctttaaactttttgtagagacagggtctcgctttgcttcccatgctggtctcaaactcctggcttcaagcgatcctcatgcttcagcctccaaaagtgctgaaattacaggcatgagccaccatgcccagccagttctttagatattagtatttaacagagataccagtttaggccgggcgcagtggttcacgctgtaatcccagcactttgggaggccaaggtgggcagatcacaaggtcaggagattgagaccatcctggctaacatgctgaaaccctgtctctattaaaaatacaaaatttagctgggtgtggtggcatgcacctgtagtcgcagctactcaggaggctgaggcaggagaattgct

SEQ ID NO: 96839 - DNA, 1588 bp, Homo sapiens
tttttgtagaaagagatttactctaccctggtagtgtttgctttaatgtttgcttgttacagcagcttcctccaattgcaggctgtctgctgtctgctaagggatgtagtaacatattttcagcccttaaggttagattaatttaagtacagtagtgtaggcagagagcaaagcgttactttagttatcttcagagagaaatgattgagccagtaccactctatctggttaattaaaaagcagcatttggttattttgccagagagagtgtgtgtgtatgtttgtatttctgtattacatctttcctcatacctaaggattttaagacattctacaattaaaaatggtacagaaaaattgaatccaccaagtgaatagttgaaaccaggaagggaagaaagttaaaggtaaaatgtaaataccatgttttcaatctttaaaaataatttatgcttgaggttatgtctgattaacccagggcatgaaagtctcctagcggctgtatatccatctcttttcacaaatcttttgctaagttcatttaggaatccatgtattccaggttgtatttcagtaacagttcagcattctgtattaccaatttactgtatacctgtttcatgccaacagtggactaacgcagtaggaattttaacaactacttaccttattatataaaactattactctgcatttatatattaagcagtacacaatggcctgttaaatagaggacgtaggttaatggaatcttttataagattgctgcgccgagggggcagatggagaattttaaagcattctttcaaatttttttctgtaatacaaaagtttatcagtttaaacatggttctggtaacatgtaaatgagaatctacaagccagtatgtgtttaattcatggaagtagccctaaaatttgaggggaggcaaggggcaaaagtgataagtttatcttacctttatactgttggacttgaagtagtctggaatactacagaaattaaaatctcttaggggtacttgtaaagtcattgagaaaaatatagatcttaaactgtcatttgccaatgacaaaattacttaaatcatttgaaaataaatgataggttagcctattttacttacctttaaaatacttgttacaatttttattctcaatgagagagtttttcattttcaatcagagggttgctgatgaatataattgttattgttttgttgttgttactgtttgcttttttccacccagagacagtgtgagtagaaataacaaaaaagaaagcttgtgattatgtatgactgaagtaaccaaccaggatgagttatgatagctttgggaaatgtgccttcttttccagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggtaagatttacccttttgtgttttcacaatttttctaagagatgcatgtatgtatgcg

SEQ ID NO: 96840 - DNA, 1064 bp, Homo sapiens
atttatagattgttgaatttagacttttaacaagtgtcttaatcatttttgaagtctcagcagaagcattaaagagcattagtgtttctttgtaaatttttagtaatgtgtcttatgtttcatttcctaccaaactgtttactacttcatacatgtataatacagctgtaatttgtgatcactagtgtgtcccttaaatcatggaagatccttttgaatcaaggaaatagactcaccatttaccagctgtgtgtccttgagaaagatttatttctaatgttgctgttgtgtcacttggcaaattacgattataggctactgtggggatttatttgttcattgagtgcctgtaatggagcccaggcacagtagttctagatgttggttataggatggtaaaaagacaaggcacctgcttcttgtagtgatattgggtgttaaggaagtgcctttttgaggtgagaacatgtaaattgagagctgagctattccataattaggggaagagcactctagcatagggaacagcaagttcaaagactttagggtgggaatcaacttaggtctatttgaggagctgaattatgcatagtgtggctggtgtataattagtcttagtcggggaggggagataaagttgtgatgagaggccgggcgcggtggctcatgcctgtaatcccagcactttgggaggccgagacgggcggatcacgaggtcaggagatcgagaccatcctggctaacacggtgaaaccccatctctactaaaaataaaaaaaaattagccaacctggtggcgggcgcctgtagtcccagctagaatggcatgaacccaggaggcggagcttgcagtgagccgagattgcgccactgcactccagcctgggcaacagagcgagactccatgtcaaaaaaaaaaaaagttgagatgagaaagattagcagaagttagttcgtgcaagacttttaaaggcccaaatcttggatttaaatatgatgggaagctgctaaagaaaaagggaatgaaatgatcttattaatatttggctgctttgtggagaatg

SEQ ID NO: 96841 - DNA, 1530 bp, Homo sapiens
agacatccagttcagtaaattggatgtgatggaatgaaggagaaacaacaattagggaagctcgtatttttgccttgagcagttaagtgaatggcagttccttttactgaaataggaagctgaaaagggaaccaagtgttctgttttggacattatatttgagctacttattagataaccatttggaaatgtcatgtaggccgttagctagacaagcctggcatttcaggagatacactgaaagttagtttcagttatgaacacgagagtaataatgtttgaggttttggtattaaataaggtcagctagaggaagagcagatatcaaagaaataggcccaggacagagccctgggatacccagatgtttagtgagaacagaggagatttgaaaaagcagcctttaggaaggaagaaaaccaagaaaatgtgttgtgcaagccaaaagaagaatgctttaaggtatatgtgatcaaccctgcacttctgagaggtcaggtaaaatgagaagaaagaataattggatttgatagcatagatgttcttggtggtttcagtctctggaatggtgggttcctaagcctgattagattagactgagtagagaaaaggaggtaagaaaggatagacagcaacataggttcgatactttgaacaaatttactaccaaggagactggagatagggaacaggaattagagttacatgggatcacaagaagtgtttttgttttattttgaggtaggggattttaaggcatgtttttattttgagacttctaacagaaaaaaaagtacgaaaagaggagaaagaagatggggtccagagcacaagttgagtggttgtcctataatacgagaaaggatatttcctcttcagaaggctagtgttgatatgggtgttgatcagtttgttgctttgatgggaagatttatgactccctgtgttaattgcatctgttttcttagaggtaaggtctttagctgataaggagacaggttaggaggttttgaggtgtgaggaaaataacattttaaggatgtggatgtgtagtaggatttccagattgtattagtgtctataaaagtgattttaaagtgaggtacgtgtacaatttttttaaagcagttttcagatgcttgggatatagctatggactagagttcaatgctggtgggtcttttgccaggcaaatatgatgaagggagttaagggtatctataaggacataattgtggcaaccatagaaattaaaaccaggaggaaagtaaggacctcaggaagtgtatagtgagaaagaggtagagtatctttggattttattgacattgacgtaagtaggctaaaataagaattggtacacaggaggggacgcttaaaatggctatttaggggtagtgcagcaaattgtgatgaggtcaagggtatgaactgagttggtgactgaggtggggaagggtaatattggaagcaaagatattgagaaagttataatccagtgggtctggtcttggatgttgaaacaaccaa

SEQ ID NO: 96842 - DNA, 3344 bp, Homo sapiens
aagatataagagaatctgtagtaaattatctccaaggtccatattacattttcatgtatgctagactccaaaaagacgcttggtttcattcatatactcaaaatatagtgaaaactcagtgtaatttgactacagcccattttgagacagcatacttcttcagattagcactcactttcagctgttttctagaaaatgtacataagttactgctgtcttggaccttatgccaaattttactcttaaaaaattctgacactggttattagagttttatgagctccttgaaggcagggcctactacttaatcttttttgaatctccaaaacctctaattaattgcttgcacctaacaatcactcaacaaatgttagttgaattgaatttaaacctatctaccctaattttaaggccattttcccatttgaaaccctctctaaatataaacaaacaaaggaaaaggcagaaagaacctacaagtttaattacacaagactactacctaccaaattggaaccaaaaagcttaggaataatcaaatgttgaatgaatatggaagttttctttttctttttaaaaaaaggtttggtaaaaacaagtagataaataacataaaatatgccattttgaccatttttaagtatacagttggatccattcacagtgttgtgcaaccatcactcctatttccaaaattgtttatcattccagacagaaacgctaaccattaagcagtaactccttacttcctattcccttctctgccaaatccctagtaacttctggtctactttctgtctctgtgaatttgcatattccagatattttatgtaagtagaatcataaaatatttgtccttttgtatctgtcttatttcatttagcataatgtttttaaagttcatgttgcagcatatataaagactaattccttttatgactgaagggagctgtttttatttggacaagggtggggtcccttttttcccattctagcaagtaaggcagacatattccttaaactccaaaaggtcttaggtatgtgaggtatgtgttgtcacatcaaagatactggcttgggtgtgtaactaggtgtttgagatgttacatcactaaacattgttttcatggcatcacgtcaaagtacttaaggaggaagtaggaagtacagatgacattccattgcctctgtctgcttcccatgatcaaggatgtatgagtatctgggaggaagaaaacaaccaaggtatctaaataatggtggtggcttattatcatagggcaggacctgatgtgcacattggatattatagactgctgtattaggggacattactggtttactgcagaaatgtaatatttccttttcttcttctttcctttaaggttttatttattttaagcttaaaacttaacgaggaaaagtgttttatgaagacattataaaactaagctttatttgtaatttaatttttaccaggttcttcattagaagctgtaaccacctgtgaactatgtaaagagaagttggagcttaacctggaggattttgatattcatgaactacatagagctcatgcaaatgaacaagttagtatattttgcctaatttggtaagtgtctattctatgcttcaaggacagctcttgaagaaaagattaaatcatggtcagaaaccttgcattaaaataataataataacagtgataatgttcttaacataattctgttactgcattaggtgttagaatttcataatttttttttttttatttttcccttaagcttaggaaagttgttccaaaatagggatgccaaccttatttccccatagctgtaagttttttgagatgcataaatgatacagtttagaatgaagagctcaataatttcctcctttttctttactgaaggaaaattcgggaggtggggcagatgtgtatttaaggagattacaagggtgactttagagccaaattgttgaagtgtggttagcatatttgtttaaaaaaaacaaacaaagatatgctgtaaaaggaatgcatgaagtgcttgaaaaacactttttggccaggtactacaatggctcacacttatacctagcactttgggaggctaagacgggatgactgtttgaggccaggagtttgagaccagcctcagcaacatagcaagacccggtctctacaaaacagaaaacaaaaacactttttaaatgtaggggtaatgggcctcccctcttttattatattgaatgagatttacaaaacataaaaaccattttgtgcagccgccatctctgtttagttccaaaacattttcatcactccaaaagaaaaccctctacccattaaacagttgctccccattctgtgctctcagcccctggcaactaccagtctgtgttgttttatggatttacttatcctggatatttcatacaaatagaatcatacattaatatatgatattttctgaaccacttttttttaaatgtgggaataatagataccctttgaaaatctgattaaaactatgtacccttcttataaaatatatagacacaaattctgtctctaagggattcccagatcctttgaagctaattgcttggatccagataaagaatcactgatctaaagaatgaaaacattaagcagttaatgtagcacaggtgctactctaatgccagttatgttgttttattctctgatgcactagttgtccaaaaagaaaatcactttcagcaatgaaatgttttaaatccccagggagttctctgtagctggctgagcattggtatttaaaaaccaggggaaacatggaaaagtggaatcatggagagataaatataaatacataacttgtcttctcaaaatgagagtagctttcaaaaggtttgtttctcctgccatcttccttcctgagatgcttcatcctgtctctcaaaggcagttttttccttttttgtttttgtttttgtttttgttttttgtttttgactcgctctgtcatgccttttcctttttgatctcaggaatgtttttattttctaagcattttaatgacccatattctttagaagttttaggaaatattaggtggagtcattgtaaaaacagtgacagccttgattaaactttctggttttaacttgtttgttctgtatgaataatagattctagtggcctgatagctacactgattttaagtgattagtttaataagtctatttccacattaaccagtggcttgatcttttgcaaggtgataaccatttaatttttttttttttttttgagatggagccttccttgttgcccaggctggagtgcagtggtgcaa

SEQ ID NO: 96843 - DNA, 1476 bp, Homo sapiens
tctctggagcactctccccaaggcagcttggaagtgggagcctggcagcagtcctgaaccttgactaaaataaactctgttaaatttcgtctcagtttcttccttttaggttaacacaacagaacagttttgaattgaagaactgtttttaccaactacaaatttctgtgtgaatgattaatctcttacctttattaattcattcttttatttatgcctttatgttcatcatattacacagaaaaacacttgagctatcagaatagattttagttacagcagtatattggcatagctatagatgaaatgtaatttttaactaaatatatatagctatagccatttgtataatgaaatctatgagctttatagaaaaccaaagcattcattccaccatcaaattatttaaaagttccatttttatataaagtcattacactaaagaagactatgtgagaataaaaagtaaaattttatgaaattataaagatattctttttttctcaataaatggcattgtgtcccttattaggaactggatatgaatacatttcctctagtttatcagtgtactgtgagtatcaatctcaattctactaatttttcattctctgtatttttcttttctcctgtttgcttccctgttgaaggctgagtatgagtttatcagctctggtctctacctagtggtgttattgcacttgtgcgaacaaagcttttctgatatgatgggaaatacaaatgaaccaagcacacgtgtccgagtaagtaataatgaagttggggagagggagggtatgatgcagcaagtgtatgccttggaaagcagattgtttcatatgttgacatcttatttcctttgggaagcttttattttttaaatgtttcttaaaaataaagataccgtagatttaatggaaattgctgtcttctataacaagcagcctgattttctcataaagttattttagagaaagaagtaattttctagctctcaaaggtaattggaatgtatttcattgaaaaacagaattggaaacatcgagggaaaatgggctttttattattaaaacaaaacctcagtattatcacttagaaacctgaaattgaactccaaaagccaaagagtatgggaaattaacttcaatttatttgttactgttctacaaaagattaccagtgtactaatttttaagtgtccatattacaaagtattttagatatggaatagttggttgtttactgtgtgtgctattagccataatacaacattttggccagctgtatgttaggtatttataagtaaatgatgctctttgtgtcagtgtaccagaggaaactttatgctttgctgtctgggccattttgtgtagcaagggctagggtctctatgtatctgccattattgtagcattctgaacacttcatgtcttgaaatgtgttcataagtatatccttcaaactttcttacatgtt

SEQ ID NO: 96844 - DNA, 2644 bp, Homo sapiens
agtggaagtcattaggattttttttaatgtatagaactgtatacttttatcaaatttaggtaggaaaatattggttcttgggagttttgtgtgtgtgtgtgtgtgtgtgtgtgtgtgtgtgtgtgtgtgtgcgcgcgcccactgaaactgaatttatttgggtccaaatacaagggtggttttttgttttttgttttttttcctccatttcgtaattttttgaagtgtttataagaagacaatatcattggataaaattattgtatctgctcccaattttaaaaaactggtttctacatgattataaagattatataaaacatttaaaaattaatgccattaagcttgtgatttttgatgttagggggagaaaaacccctatttaaaggcttaaactgatgtttgactttttaagtagaaatgaatctcctatactgattctctctttagatccatttgcaacatttaaactactgtatttctttctgcattgtttctagtttattaaccttgcaagaactcttcaggcacatatggaagatctcgaaagtaggtggaatttcccctccccagacttgttgaatttacttttgcaaattaaacccaaagcaaaacctaagtatatactctgttctgccaaattagagctcatttataggcttagtaataccaaaatgattgatttgggaaatatgggttgggaaactgacattagttgtttttttttttaagcatattttaaggtatggaagcatgtaattttaactgcattttacttttttttttcaaagagaaatttattgttgatcaccttgatttcaggatttataataaaaaaggcataaatcttaactactaatcaaaccaacatttcttaatctgttaggattttgttttgtttcgtttctggtaagaaattttacctgttactcaggtttgttagatcataagagattattcctgggcttacctatgattccaggaaaatatgggacaaggagtcctaattctgaatccatatcagaagccatgaagggctttgttttgtgggttttttgttgttggtggtggtggtagtgggtttttttttggctttttgtaggtcctcatggacctttaataggtagccagctctgccaacagctcaaatctcttaagatcacattccagcatcaggatttctggctgggattataagtgaaggcacttaattctcaaatctctacaggcatctatacagcctaccctcttcttaatgtcctgtaacttccagtgtgcttcataccatgtgggcataggtattggtggctctggaatagtttctagaaattgaagattaccccacccaacccctacatattttactttttcaccctttgttgcccattccaaaacactatccaaagtgtctttttaaaatacgtattcttcagttgaatacttctatactcatcttcagactatttggagtgttatctatagtgtgcataacatttttacttttagagaaagctcagcatcctttgaagtaaggtttaaaaaggacttagtcctcataggaactttttaattctagataatctaaaacatagatttttgtcattgtctatactactttcaagtttttaaaggttttgagatgaaaccaggtaacatattttcacagttttaattaggatatgtgaaaagaaaggagtcagtgtgaattcacttggtataaaattttttccctttataccttctttcagatcccttaggttggcctaatacaaaggtctcttctttgtttttttaaattacaatttatactttgtccaacgtcatgatagtaatttgtttcagtgtatgttttccccagatttctccattttaaaaaactaacattctcgtttaaaatttagtttcttaaacatagtattgtctgctcctaacatgtgggaagaaaaagatggaggtgaaatatgtccatactcaaataagcatgaaagacaagggtgctgcaagttaacccctaaatatcagagtattagtacattctgaaatgggttctgactaaattatcctctcctgtggagtggagttaaatggaaaaacacaagaagttccttaataagctgtaattttttagtttggtatttctcagtgatagagcataaaacttaacagtagagtttattatcagtcatgacttagttatatgctttgtcatttattaaatggatttaaatctattagtgttgcatagtttttctgtgctttgccctaggttgattccatttgttggatgctcttaatttgtccaatgtaaatataaaaagagagggcattaaaccgttttgccctataatgggggaaagatgctggttagatgtttattttagtgagcttgcattttcttacacgtgcaaagcagttcatagaattcatagttttacacttactatgtctttcctaaagacacccaggatgctttatttttaactcttgagccactagtgactcttgaataaattgaggtcagaaatgttgcaaaagtggtaagtttctggcagtgtggagacaggggaataatctcaacagtaggtttttactgaatccaattattttaatttaggctgtgtctatatgaagcttttttgactta

SEQ ID NO: 96845 - DNA, 2031 bp, Homo sapiens
cagcggtaataagccagattttactcaggtgtgtgagagcacttgccttaagttgacttttttcctagtgtttatatatcattagctactatgaacacagattgatctcagaaacattttagaagatgctcttgaaccacatttttaagcactttcatttttataaaaattgatataacattacaaaacggtgtgggggcggggagaattgtggttgggtatcacccacaggcagaccaccctaaccctgtcatacaacttatcattttgatcaaacaatatactaaattgggatttttgtttttacaagtcattgctgttctggcttcatatttacacttcccattcttatcccccttaaaatcattcttgatcatcctgttttctttcaacagcttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttactgtttgaaatgtttccttttaaactggtgctcaaagaagacatcagacttcataaccaagaattttattacaatttcaaatctcattttaagcaataatataaatgttctaaaacatttgctcacctcttgccagttacctttgcattgtctgtcttaaagcaaaaatataaaatttaagggtggtagttttaatatattctgtgggtcctaagggatgctttgaatttgaagtatatatacttttaataaaattcagtatgacagttgtcttctgcttaacccataaaactttatttaaaaaatttaactagatggtacaaaacattcattggtatgca

SEQ ID NO: 96846 - DNA, 1082 bp, Homo sapiens
atcgtgaaagaaaaagaatgacagagaaccgtcctagattaaagggagactaaggagacacgacatgcaatgtatgatcctggattgaatcttggaacagaaaaggacccttagaggggcaattaatgaaatgtggtaagtgctgtagattagctaatcgcattatcccagtgcgagtgccctgtgtttgatcactgcactggcgttatatacaatgtcaatatttagagaagctggctgaagggttacggaaatctcttgtgctgtttttgcaacattttcgaaagtcctaaattatttcaattcaaatgaaaagtttaaaaaacaaaaattagaagttccagaaggccgcgcgccagccgctcctgcgggacgggacacccgggttctcctggtgggagcccccagtgccgttcacgttccgcccgggggggggattaaactcgcacgcgagaagcaccgcccccgctcccgccccgccccgctcctctccggccgcgcagccgctgccgcccacccgcacccgccgtcatgctccgggccgcgctgcccgcgctcctgctgccgttgctgggcctcgccgctgctgccgtcgcgggtaagcccttacgtagtccctcgccgggaccgtgcgcgaccgccttcgcccccttcccaacgcacgctcttcgtccccgcgcacccgagggcggcccgcagacgcaacacccggccggccatcccgcccttccctgcacgcccgtcccccgtgggtcctggctccgggtcacctctcacccgcctgccctcggggaggggaggtggccgagaataagggagggctctgtcttcctcggagtccacatcctcaccgcagaccccactccgcggggagggaacccccaaattaggccagttggccggagaactgagggacttggagtcgcacgacgggcgccgtttcagggcaatttcgggctgaaatgagaagcggggacgttggtggcgatttcccctgctggtgcgcggccggagtggggttgctgggatgggggtgggggccggaggaagtaggccctcttttgcaagcagcgctgtttgtc

SEQ ID NO: 96847 - DNA, 1444 bp, Homo sapiens
gcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcggcatttaacttacatttgtactttatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaagtgctggagttgatccttcttgaaaaaaaaaatctctagattgggttttttatgttaggcatatagtacaagaaataaattgaccacctattgtaaagcgaggcatttgctaagagattttgtgtgcattttttagagaataaataggcgggtagtggctcacacccgtaatccctcttgacactttgggaggccaaggcagggggatcatttgagcccaggaattcaagttcagcatgggcaacaaagcaagaccccatttctaaaaaaaaataaaataattagccaggtgtggtggcacccatgtgtagtgccagctactcaagaagccaaggcaggaggatcccatgagcccaggagtttgaggctacagtgagctatgaacgtgccactgaactccagtctgggtgacagagcaagaccctgttttgaaaaacaagtcgatattgatccaattgctgaatactggaaaggcaaagtcagataaaactggattctcggaattaggaaaccaatgaccatcttagccaatgcaaatgtagcagagtagtgaagccagaatc

SEQ ID NO: 96848 - DNA, 1073 bp, Homo sapiens
gataagggtcttggaacagcagctgcactaaatgaactcatctgagagacttaaatcattttgaagcaaataacactttatttagccccaggtaagtcaaaaacaaaaatttatagcttttagcaatttgctatcaaagtaggataatatacaagtagtgatgttcccaaattggtgttaggaagggggaatgtgagaataatcatagcgcattaatgtctttggaagaaaattcctatcacaatgaagaggatttgaatgaataggaaaacacttacatttgaaaagaaatcacttaagtgtttcttttgatctgacgatgagtttgaattctatgttagcgctatgaaacaatcagatttattatgtctgtatacagcttacaggtttacatgtgtgacacaacccataatgtataaaatcaataatgatcacttttgtattctctcctccaacatcaaaccttttcctgttccaggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacct

SEQ ID NO: 96849 - DNA, 1687 bp, Homo sapiens
aggtggtgccacttcagctggaaagcaaaaatggagtcctggtggtggtgtgggagaaaggtggggatggagattcctgcacccttcctcttccaccagcatatctttaatgatatgactttttacaattagagtaggggaaggatatgggtccttagaaatctctccctcacaaaataaatgtgcaagcattctgcactttaacggaaacaccacattctctatctgtgttgtccaatagaactttctacaaagacagaaatgttctatatctgcactgtccaatatagtagtcactggccacatgtggctcttgagcacttgaaatgtgactagtgcaactgaagaactgattttatttttttcatttttaatgcattttattttaacaagtggctctcatattggacagcacagttctgatgagttacatgaacccatgcttgtaacttactagtttagtggcagtagacatagttgtatttaatttctttcttcagaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggtaagtatggaacctgtccttaggagactttttgcagaacagtcaggaaataaatgtacaatccaattatgtacaaaattctgtatttagtcttgaagtatttagtccttaaagtatatccaactatcttgattaagtcatagagatttccccctgaaaaatagattacaagggacgataactgcacaagatgtccaggactccagtctacattttatataattctttcctaagaaaaacagaagttgccagggtattagggaagtaatttcttttaaaatgttcttgagatgtattttattctatagtttgattatataaaagcttaaaggtctatttctgcagttaatttgcttcctttcttcctaatcccataaaactcatggttaattttaaaacaatgcaaaactggatttagttattgaaaacattcagggtatctataaaaaatcataatttgaacttacatttcattatgaattgatacataaaattaccattaaaatgttatattaacttcatttctggagaaagagctccaaatttttcacagtaacatttttaaagatcttgcataaaacttttgcttcttgtatataaatattaaagataaaacctcaattctaggtaatcagtatccatgtatacacacactgagacagtaaatagagtgtctactatatgccatgccctgttttgcacactgggatgcacctgagaacaagacagataaggtacctgttctcacagagattacaatctggtgaagaaagataagtaaacaggtcaattttttaaagagaggaaaatatcaaatagttataaactctatgtgatggagactcagtggatagctactctagattaggaaaccagggaagaagcctagaagcaggagacaccgaagctaagatctaaaaaatcaagccaagcaaacttcaagggaaagggcataacagacagaggtaccagttggagcaaagagcctaaggcagaacaagttggctgagcgctcaggg

SEQ ID NO: 96850 - DNA, 1364 bp, Homo sapiens
cccgtgacaaatttgatccatagtcaaactgtaaaatgacttctaggggaactacctagagtatttcaaagaccaaaacttgtttacctgcttccttgggtagcaaattagccaggtagatggatggcatttatctaatttattctgataaccgttgtggagacacttgactgattgaaaaatcttgtagttaccgggaacttttgtgtgggaaccattcggttttatacctgaatacacatgatggaaactgttgtaagatatatgtatgttttgaaagtcataaacctttttctcctaaaggagaaaacagaatggtttactgtaaaactaatatgtaggttaagcacttaagacttggaggcatgagggtctgggttcaaatcccagttcccacatatcctagctaagtggcattgggaggttacacaactctttctcttttctcatctgaacagtcagagaggtctcaggggtaggcagttccagggccaaaaaaatattgccagataaatattttgaagaaacacaaaatttctttatacgtgtttggaagtaatttttttgaagtacttataaaattttgacctaaataccagtttttaaaaactgtctctgtgtaaggcttgaatttatcaatgatcttgttaataatatatgtatttttcaaatggctagttgagaataaactacttctctagtttccataaagctaattgagaatgtgttttctttcaacagatcactctgcaactatcgtttccataaaagatgaagatgagaataaatttgtgagcagactgatgagggaaaataataacattaccatgagagtttggcttggattatctcaacattctgttggtaagtgaaataattgtatgtgtagtgtgcaaagagagttctaactcatcctaaataacaagtcgtccttgctaaagaatgttaagtagtggctaattcagatgcctcttctggataaataagctaggtcgctggctgttctggatggttataaattttgaatgaatccatgagttaacttagcaatgacggaaaccactaatgacacagaaaatcctgttaaataaagtggaatctttctagaggcttatttctgggatccttggatcaacatcaggacattttcttctccacaggaatgtctgtgtccccacaaggaacccatgcctgccttctcttagagttctagtgcctgtcaccgcatggatttgcagcttataacttcgttattcagaaagttatcttcttgttattcccttctctctaagaatatttttaccactggttaaaattatgtcttaatagtaatctttaaaaactgtcttagtgttaggttggtg

SEQ ID NO: 96851 - DNA, 1049 bp, Homo sapiens
gccagagacacaaaacacaaaactataaaacacagaaaacaatattcagaacaatatgaaggttgggattgtaaatttgtaattatgacaaatggaagccatttgcatgttgtttaatttcgagtgtcacataaactcatccttcaaaaaaatctgaagaccaggtgtagtaactctgtctgtaagtttaaagttctccataaactgtatcagagcaaatgtcccaaatcaatgcatcagaagtaaatcagacctacaataatagtaggttcagacctacaatactgtaagcaaataattaatattccattataatatttcttaaagtatgtatgttgttctttgtattctttttgaagtcaaacatctggattcaggttatctctattgttcttacaacagggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatgtaagacttcaatttcagtaacagtacatttatgaaaatgtgacataatttatgcacataattaaaagctcagtggaatttttatttaaagatttattcacaagggccgggcgcagtggctcgcgcctgtaatcccagcactttgggaggccgaggcgtgcggatcacgaggtcaggagatggagatcatcctggctaacaaggtgaaaccccttctctactaaaaatgcaaaaaaaatagctgggcatggtggcgggcgcctgtagtcccagctagtcaggaggctgaggcgggagaatggcgtgaacccgggaggcggagcttgcagtgagccgagattgcgccactgcagtccagcctgggagacagagcaagactccgtctcaaaaaaaaaaaaaaaaaaaaagatgtattcacaaataatttttgtgaaaataattttgatactttgtaaatggaaacaaatacagtataagc

SEQ ID NO: 96852 - DNA, 1135 bp, Homo sapiens
atatccctcgcatgcatagttcacaagagggtttgcactcctctgtcaatctaatgccacagtgctctaacaggaggcagagctcaagcggtgatgctcgcttgcctgctgctcacctcctgctgtatggcccggttcctaacaggcccggttcctaacaggcctggttcctaacagtaccagtgtgtggcccgggggttgggaacccctgttatagttcatctaagaggttctaattattatagcgtaatctttgacagtatatcattactatgggtggatttataccaactgaaaaattacctttaaataggggaaagtgaagtgaatcaatgttttaaattctctactcagctactagttttctattataccataagaccaaatttaacatcaaaacatttgaaaactccttaacctattaattttagtacaatgggataattttattttacatatgtttctaattgtccaatattgtttatattttgaagtatattaaactgagaactaaaatgttttaaacttatcaaatagaagtgtactagataagtaattgttaaaattattgattattttttattcaacagatccaaaatcacatattctgagtattcgagatgaaaaggagaataactttgttcttgagcaactgctgtacttcaattatatggcttcatgggtcatgttaggaataacttatagaagtaagttgtaaatctgccaactttctctatttgtttttgtacttcattataacataattatcaagccatagttcttcaaagtacatgtctatcaatacgtgaaagtataattatgtacttagcataacttacataaataccaagacagtttttatgtctctgctctgcctttatcatcgagtttaaagttaaatggcggaaaataattttctgaattagtttgttcccgcactgctaaaaagaactacccgaacctgggtaatttatgaagaaaagagctttaattgagtcacggttccacaggctttacagaaagcatggctgggcagcctcaggaaacttacaatcatgtcagaggcgaatgggaaacaagcaggttttactatggtggagcaggagagagagtgaaggaggaggtgctacacact

SEQ ID NO: 96853 - DNA, 1027 bp, Homo sapiens
tatatggagatttttatagtgactagtataggatcagagctttaaggtatattctgttatgtggtacacaacttgttacaaaaagtctataaaaatctaataagttgaattaataatcattatgttttgcttatactgtagtcgagtgttaaatattgctggaggtgttttatcttatttctaatagtttatctctttaaaaatatgtttatcaagattgccactattttgttttttataaagttaattgccctttatccatgctttgaaagtttttaaagattttctaggaaatgtcatggtcaggtccttcatggaattcttttatagggggacaaattcaatctagaatctaaacttttcttgctaggagcttcagaccattgttacatgattgcatgtatgtatttgcctttttgtttagttttttgaggaagagtctcgctaccactgtgccctaatactcaacctccaaaaatcaccgtttactgggacgtggaattttacatcctgcagtgaacgccactttgtgtctctctgtcagaaatattcaggtaacaattattatctagataactatggtactttatgctattacatatatatatatagagagagagagagtcactttctatagggagggaggggaacataggttgaaaaattacctattgggtagtatgcttaccacctgggtccaatacaccatgtaacaatcctacacatgtaccccctgtatctaaaataaaagccgaaaaaattttttaatactataaaagaatttatattaatttataatcatatggcttaaaatttcagcatggctaaatccatattgggttagtgagtcagagtttatcaaatggaatgtgatttttttaaaggatcattgccataattaattaaattaattaattgtatctgatggaatttgttaatagtagttatcccattatagtaattgaattttgttcttttttctactctggcatttttcagattttacattttattatgggaaaaggag

SEQ ID NO: 96854 - DNA, 1166 bp, Homo sapiens
gtgcagcatttctattttgttgctactaacacttaaattgcttaagttgatctgttgagggattgggatgcattgaatagtcaggactgtctctatggccttataggaaactgacttaatttctggcttgtgttttctttttcccctcaaggagagcatccaagcagcatctgccaatcaaattagaccagcatttcacaaactactttttggggactacacacatgctacaaaatgttaatcattgatcttgcctccaaatgggggttttatgattaaataggtttgagaaatgctgcattctgtatctgcctctttgagatgcataatccatgttggtatatgtatgtattaggaaatgcatttggcttctgaaaagaggttgctacagtatgagaaaagatttattctgtcacattaaagacatttgaagataagcaggtttgtgtggaaacaccatgaagtcttcaaaatcaggcttcttttggttttgctctgccatccttaatataaggcttccgagcttaaattcagggtgttctctctagggtcttttctagaagttacccgatgagtttgtccacattgggtagcttggctcattggccactccagtctataagaaagctgaaaaaaaaattttttttgtaagatatttcaaggaacacaatttgggacataccactctacactaaagtgatcataatgtgaaaaagggaaaaaagagatgtgtctgacagctgaaagcatctgtagtaaagctaggggtacattttaactttttaaaattaggacaatctttttaattcctcaaggtaatagtactgtgttaatttgcatagctgatataaatttgaattaaaatatcctgccaagaaagagatgaatttttcaacagtgtttcttgacataaggagatgatgattaaggacacagattttgaaattaggtggaacagagtacagatactgaccttactattgtgtggctatttcacttatggatgaagttatttaatgtccctgtgcctcagtttctgtctccattgtgagaattaaatgagataatactacacaaactgcttaacacataggaagcactcaataaatgagagatctttaaatatataaagatataatataaaatatatattaaagatataatat

SEQ ID NO: 96855 - DNA, 1166 bp, Homo sapiens; identical to SEQ ID NO: 96854

SEQ ID NO: 96856 - DNA, 1166 bp, Homo sapiens; identical to SEQ ID NO: 96854

SEQ ID NO: 96857 - DNA, 1166 bp, Homo sapiens; identical to SEQ ID NO: 96854

SEQ ID NO: 96858 - DNA, 1166 bp, Homo sapiens; identical to SEQ ID NO: 96854

SEQ ID NO: 96859 - DNA, 1051 bp, Homo sapiens
aattttagtggttagtgattatagtaagacaatgtattcgaatcaaaaccctcaagaaagctcagcacatataaggatggatgtttggcttgtttttcagatatctggtgatggacagaagtggtggataagaattagcgagtggccaatagatgatcattttacatagtaggtgacatcattgattctacctttgtaaagttatcacttaaaagaagcagttccttttactaaatggatttctatttataagtagtttgaatattaatccataaactgcctaaattagagaaaccaagcccttttgcatgttagcatcaagaaaaaaggggtatagagtaatggtattaacattaaatttagaaataaaataacttacagtaaaaagaaaaaaatggaacacctaattacattacgagttgtcaaatctgtcattttcttttagctcacgatatccatggcaccgctttcctgtgacatttggagaggaatgcttgtacatgtctgccaagacttggcttatcggtaaagttaattctaaatcctttaatgctgattatgtaatatgtgaagttcaggttcagtttctagcttaatcttgttttccttttaattatatgtttggtaatttcatcttattctgatttattattagcaacaatagctcaaattcccaatgcaaataaaggtacttttcactgtgaatattttaacttcctttatcctaaagcagttacttagtaataaacttaccactttcctaactgataagtgtctaagcaaattttcaaagataagcaggcagcagttctaaaatatagtttaagtcccctccccctgattacattgccccttcaactctcttcctacctcctgccttcaccctgggatggtatggtagtcacacaaaatgtgtgctgtttcatagacagtattggtatgctgtaacctactgataaaaataatcatagaagacagaaatggctagagaagaaagggaatatattttaagcatttaggaaagattgatttcaagagcctttctttacta

SEQ ID NO: 96860 - DNA, 1088 bp, Homo sapiens
ttcctcatacaggccgtactccaaaaacaccagactggtacaatccaggtgagttaagaaaactgaaatttaaccaaagctgcttttaccttgtcactaatgcatttagttaattatttaagtgccagcttcttctctatacatcttcaagtgagacaaaatttctccaggcaaggaaggtgagcgactggtatgggatgaggtgatgagggtgactttttccttccctgtgagtgtaggggagtggcagagtcactggctcaggaatctcttgttccttgtagtcagtactgccccagccagagagggccggtaatctgaattactatttatagttttgaacattaactcatgcttagaggacacagtttgctttgcatagtcataattctaatctttttcttcttcttctttagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatgtaatttaaaagaatatattttaaatatatttcttatttttgtatttattccatttaaaaatattacaaaaattttgccaaaatctacaaaagttaaatttttctttaatgtaaaatctgcctcacagcatccaaatttgtttcatgttagaaaaattaagtagaattgcttatgttttaaaatatacaagattaataataaatgtcactttataaggtaaacatcagtagataatatagatcattctaatttcctgtcacattttttactaaaagtcaactttatagttaacttgagtttctgtttctactaataagtaactttgcaaaataatttttgggaagaaaaataatttctgtatttttaaatttataatcaattgcaataggatactgtatgcccacttaaagtattagtctaattaatatatgcccataattacagctaccatatttcctgtacccacaataggatctgtaaatatactgagaaatt

SEQ ID NO: 96861 - DNA, 1022 bp, Homo sapiens
aattattctcagatattcaatatttactccaatttttgtcaccaaaaattggtgactccaatgtcacctccttttttattctttctaaatgtaaaactccttgagtttattttcaaattggagcatatctgagattagttaatcaaataatgagcatttcaacacatgcaaaaaaagaaaaaagtattttgcaaacctgattctctatgactccagcggcgaacttaatacactattaacttccacttctgaaactgtggcttcctttgtttggaaacttatgacattatgacatttgctaagtcctctcatgatttagcatcatgatataaaaaagagatggaaaagttttctttctgtggcatatcaacgcacttgagtgattaaggctgcctaaattacatctaaattgcaaatatttatacatcagtcttaaattctcaagcctctcttgtcttttcaggtgtctactattatcatgccaaatgagtttcagcaggattatgacatcagagactgtgctgctgtcaaggtcagtacaatgctggaaaatctgcatatttaaaacataagtccatcatcatatgcagtcaagtaacagatccatggagtgtctttttatgtgaagcatgatgttagatgcagtgagagataagcacacccatggcctggccctcagcagcctaacttacacttcatttgagaggataaaattcatattcaagaaaacctctctcattaccacgcagtaatatgctccaaatgagggggctgaggaaggctaatgaaattcagaggagaaagtgagtcccatggccatttcccaggaagaggtgggacttgaactgggactttaaggatggatagagtttctacaaatgggatagggtaaggttttttcatgaggggatggtatgagaaagtggtataaaataaggtggaagtggaagagggcagtggagaacagaatacagatcaagaagtttcattggtgctgtccttgataacagtattaggaaatc

SEQ ID NO: 96862 - DNA, 1282 bp, Homo sapiens
ctgtgggctgagttcttctctcttcaacttttatactaagtgtgctttgatggttttattgctactcttataagaaaatgaaatttatccacactgtgacctggaggtgatgctgaggtaactggctgtgagccatcactttgcaggcctgttgagtagcattttctaggagtgtgttctcacatttgataattcacttatattcatttctctctctctgtctctgtcatagtttttgtgagttcagttctgaatatgcggtaaataatttcctttccaagcaaatgtttttgtctcctttcaaagctaggtcagtggaaagtccaatcatgtgaggagaaactaaaatatgtatgcaagagaaagggagaaaaactgaatgacgcaagttctgataagatgtgtcctccagatgaggtaggtaaaatccctatgtaaattttctcaagcagtattacaacttcttggttagaaatggtagctgagacttaaataactcagacttataaaatagaggaaactactagcttctgttcatttaagttagaacaagccagaaggcagtgagtcatagcatattggccttcttacagaagcagaaacttgaaaatttctataaatatttgtagaattactatcctcaaggctgatgtctttacttcccccactaatatcaatattcaaaaataattcatccagtgaatattatactcttatgatgagccagccacccatatgagaagtaacccatactttttgtctgacacaggcccacagtcttgtggaggttatctgtgaaattgcatcccaccctcatcacatgtatgatttcaatagccatgtcctcaatttccacaagttctaagacgttatcaatgtagcagaaacatgcttgccagacgggacaccatcaagtctggaaaagagtttgacaatatttttcctctgacttagggctggaagagacatggagaaacctgttacaagatttatgaggatgaggtcccttttggaacaaactgcaatctgactatcactagcaggtgtgaccatcagtaaacttgtactcataaactttcaactctgaattcttttgccaaacagtcttcctaagtaaaaggtgcatcttcaaatagagtcaatcattgtgaaacacttgccaatttgattctccttttgtagatttgagcaagaatacctaaatgatttgatgaaaaagtatgataaatctctaagaaaatacttctggactggcctgagagatgtagattcttgtggagag

SEQ ID NO: 96863 - DNA, 1040 bp, Homo sapiens
ttatgatctcttcctagaatagaactcttagctagaatagctaagagtaggtacctactcagtgccagcctggtgctccttgtttcacttgtgaaggcagcagagtcataccagggcagcagtggacagtatttctattcaaattgggatatgtatgattgtatttatagaatttcattcaccccacaaagcaaagtttatctacaccagatatcaggaacacccagcctgcagatgttctacctgtgtactttacttgcataagttacttgaaaagccttcattacccaacctgcctgtcgtatcaacatattaataaccgaattaagaatactacaaaggctcttaaaactccatatcagaatataaaaatttgtataacaatgtacatattacagtatttaattgagcaaaaccaaacaaataatacatttttcttttagatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagaggtacgaaacctcctgtggtttctttatattcttcctgttttacctaatgataatattaagacttctttggttgggaagtttgcgtataagctggaaaataaaaggtaagagcactctggatcagggtacagagccacggaccattacctgttaagaattgggccgcacagcaggaggtgagcggcgggtaagcaagcattactgcctgaactccgcctcctgtcagattggcagcagcattagattctcctaggagggtgaaccctattatgaactgcacatgcaagggatctaggttgcacttccttgtggaacagtttcatcccaaaactatcctcttccccaccctctgtggaaaaaattgtcttccacaaaactggtccctggtgtcaaaggttggcaacaaataatctaaagtctagactgtctttctggtagc

SEQ ID NO: 96864 - DNA, 1052 bp, Homo sapiens
gaggaccatctgtctagcagaggggaggaaagaagtccaggggtaacctttgccctctcatctcttggatgcgaagtgtataaatgtcttattctgtcccttaaatctctgcctgtcctttgttcaacggtgagcgttaatctacatccccttgctaagctggccatacaagaaaaggaggcttgccctcttataatcttctcaaggacagagactggagggaaacctaacaaattccatatccaggaaaaaatttgtcagaaaatgacttaaggcacatctttctactgtctacttggactaagggcaatctcccttgactgtgtccaagcccttaatagtctgtgctcagccatatagcacattgaagcatgttaaagtcacatcattttctgaatcccagcgggaattcctatgatgctatatatacctcatttatgtggtaggcaccacatgaattcatgtcaccgtagcatctgacatcacgtccccagttttccaggactctcattattcaagaaaaaagaatttgcaatgttattgattcacaatagatgtatctttactggaatataaatagctgcttttcccccagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgagggtaagtttttaaaaataccctatttgagaggcttaagccattttaaagtatccctggttttagactctttgtgggaatgaaaagcttacagtttgatcccacagatcagccctgtcagataggattgtctctggtgatggaactgttctacaattggtctagtatggtggtcactagcaacatgcagcttctgagcagttggcatgtagccagggcaactgaggaactgaattattacttttatttcatcttaattaatttaagt

SEQ ID NO: 96865 - DNA, 1041 bp, Homo sapiens
agtaatacttttattatttcagtaaatagaatatttaaagataatttaatctttaactcaaggccttaatggcatgacaatgataaattaatatttttattttatggagtagcagattaagagctactaagcatagaatatggcctggaagtcatttgaggaaaaagtttggtttttgtttttaaaattaactacaacatatcatgatgttttccctttagattctatattttagaagaaagacatatttaagcacataattattcattgaggcttatacgtttcaatttagttaagttttaactataatatgagttcccataaaagcataaaattaggaatacaaattattctttctgacaccatcctggccctaactttctcattctaatgctttgaaaaatgttcccttttaagacaggcccagtgcacctactataggtggctccagctgtgcaagaatggatgctgagtctggtctgtggcagagcttttcctgtgaagctcaactgccctatgtctgcaggaaaccattaaataatacagtggagttaacaggtatctttctcacatactcatacaaatagacaaataggtcttaaaatcatagttttgtgaaaacaagtaaatcttttccaacatccgtttccacctttccttctcctgatactgacagtacagaaaagtacttgatttttaaccctgtggttagatattatcaaccatatatgaataaagctttatttgaggtaatgaagaatattaaatataaatatgtatgcgcccagaagaaggcagagatattcgagataggaaatatacttctgttcgtgtgtggctcttttttctccagagcagtggttctccaggggtggtccccagaccaacagcatcagcatcacctcttcctgttagaaatgcaagctctcaggacccaccccagatttgctacatcagaaactacaggatggggtccagcaatctgtattttaagaaactttccaggtggttctgatgcgtattcaagtctgagaaccactg

SEQ ID NO: 96866 - DNA, 1111 bp, Homo sapiens
taaggagaaatttggacatagtttcccaaataaggtagtcacttgggctcaatatcttggccatttaagcagcatgtctgtgcacacacataaacatacagtggtttttatgcaggctgtgggcaaaccctctgtcatctgccactatgttcaaatgagcttgttttccattagctcagtgttcacaacatgtgcacactgagacccatatctcaggcagagggcagtcagggacatgggcgaaaacacagcattgtaattgatagggataaaaggagaatggaaaataagaaagagtggaagcttcaaccagcctgagtcatttggtgtgtcatgattccaattttattgtgatcaaaatatggtctaaatgagtgatggcagtctccctttgggcatatcctaagagtatgcaaattgacttgcagtatttctaagcattctaagtaatagaaaacattatgtccttactttatgatcactaacgtgtctttatcaacagaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaaggtagattttatttgcatgtgatagagcaaattggctaaaattgtaaaggtacttcttcttctgttttcatatccagatgtgtttctttgtatgtaacttttctgacctctcttgggatttaaacttctacactgaaacccataagcaaaaaagtactgaatgtaatcatatttcaccattgagaaatgtatcttgtgatggaaactaaagagagattgatgttcagaaaacaaggttgggtagcaagattaaactgctaccctaatcctaaatgaaaggattttcaaaaagcgaataattaaactctttgaacattgaaaaatagagaattaaaggaagggaaggaagatggttaagttacactagatggcctcagtaaacatccttacattgagtgaaagggtacagtcctcaggggcaaggagtgttttactaaatcttaaa

SEQ ID NO: 96867 - DNA, 1060 bp, Homo sapiens
ttatccccattttacagatgatcacagtgaggcacaagggagatatgtaacttgcctaagatcacacagctaataaatatcagaactagaattcaaacccaggaagtctggctatgaagtccttgtcccaaacagctacactaggctgactcattgagtagctagccaggtggtattagtaatgctgatccctccttcgggaatgtgagcttcagaatgcagaagctcttggagagcttggagagattatactgggttaagacttaagatttcagggtgcaacagaatcacatggagagtttgttagaacacagatatctagggcccagagattctgattcagtagatttttggtgggccccccaaatttggcaagtttccaggtagtgctgataatgctggtctgggaaccacacttggaggattacatatctaattagaggcccaggcttctcaacacctgtaacctacctactaaaatagaaaaagccagtattttcttcagctataattgataataagcagagtttggtcagccaggtatcaacttcatttaactctccttatcatttggatcagaaatttagatgtgaaagtttgcttagaggtaatccaatgtaaacccctgtttctcaggtgagaggcagaaggcccagatcagtgaaatgacctgtcagggtcagaccacatttttgtggacactagtgaaggattctttatcctccttccccactgtacatatttacccccactgtaccttgctgccttgacaggaatgtatcttggtgcctttagcctcctgtgggtgttgtgtgtgtgctggggctttgggggtgtgacacatacagtggtgttaatgcatgcatatgcttcctagagttactttttatggaagaagcaagagaaagtttctcaaacctgagggctgctaaatcatggaggtcatgttgtatagcaaacacactgccatcccactcctggaagcttctggatttacaagtgtagggcctcagtggtaataatgaacctttagacaatgtgctttcaaatccaccctatt

SEQ ID NO: 96868 - DNA, 1060 bp, Homo sapiens; identical to SEQ ID NO: 96867

SEQ ID NO: 96869 - DNA, 1060 bp, Homo sapiens; identical to SEQ ID NO: 96867

SEQ ID NO: 96870 - DNA, 1060 bp, Homo sapiens; identical to SEQ ID NO: 96867

SEQ ID NO: 96871 - DNA, 1060 bp, Homo sapiens; identical to SEQ ID NO: 96867

SEQ ID NO: 96872 - DNA, 1030 bp, Homo sapiens
gggagggaggagagccgggagctcaggatttgaggaaggccaggcagtctctgcccctcgaatagcaacgcgatgagctcagccccctcagtccaggccgagagccagatgggggtcacgtggccgcggggccccccgggcgcagggtcctcggcacagctgacgggtgcgcgccgagctccgccgggcgaaggaattccagccccgcaaaatggctccagagtgtctcccgtgactcgctcggtggctgcggaaggcaagagggtgtgtgcgcttgagccgctagagggagggtgttttgttcctcagccgtcagacgcgagctctgcaggccgaaaacccagacccgctgcagccgacatcgggaagcccctgggcggaggtttagcctgtcggggcacacaggcctgggtcacaggggtcttgaatttggggttcctcgtaagactggagcgcaggccgtcgcctgtgctggcagcgccctcattgtgagcgttgttggtcagactggggagtgactgaaatgtgactttgaaggttcagggcagctgggggcggctagggaggaaaccgcgcgccttgccagaccacgtgactcggcgcgagaaagcgatggcaggtctctgggctgctcagaattgaaaacgtggctttgaattaaagaattcggttgttttatgcgactctgagagacttaagatttgatgtaggctattccagtgctcacacaggacccagaccataaaccagactgcagggatttcctatcctctagtatccttgaagccacctgccctacttgaacacctccagggaccaggcactgcctgcctcacagggcatcaggtagctttagggaacagctctcaaacttgtttgcagaggagtccaaattgtggctttgaaattcccacttaccggccttagtgctgccaaccgggatgccacagagtcagtcagtcatacttcaagtgtggaaacgtgactccatggctctgctcttctctgggttgagcattccttccagctt

SEQ ID NO: 96873 - DNA, 3664 bp, Homo sapiens
gtttagcaacatcttgattatgaatttagataaatgtcaatatccttagattgaaagattatattcccaactctcacttgaaccacaaatttcaaaacttttcactttaccatgcagactgtaataaaatagctgtgtagaacttagaataccctggtttctgcattgccctggtgatatagaataccttggtttctggattgccctggtgataacatgtatttttgatttcataaagtcactctttagagacccaaatgaatttggctctaaattagaaaagaaagtattttgcaagtcctggatgtgacaggcattgaaagtaaccatcagttccagagtctgcatttatcagtctaccatcagtgatgagcataacctttttcaaacacatatctctttaaaacaagaaacagattacaaagctctgtagtgtttcacaccaaatctacaaaagcatttgtcttttatttttctcttccagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaattttatttttcctgtcaattttttttaagtcgattaagtgtatatcagaatttcatttcatttctgatctctttcttcagctcagtagattggtttgaaagtgagttgaaagttatgtcagattcaatatatcctcaaaatacatttccttgaaaacaattggaaaaacctttccaccccacttttgctggttatttaaatctgtgtaatgaccagagacgtcaaccctcagctcagcacgtcaaccgtcagctcagcacgtcaacggtcggctcagcaaatatccagcccaaaatacaccactagtggtctgttcttaaagaccaaaaaaccaggccctttttcttcctcctttcttgctgctacgcctcaactatttcattgcttgtcaatgctcagcaaggaagacagcctaacagcagccctcccacctgtggtaaggaagcatgtgggcgagaacctcgggataatcttatctatgcgtttatgaccaaggtcctctttcagagctacctgttcagctgttcccgactggaggctcccgtgcagcattcacggaggagcgagaact

SEQ ID NO: 96874 - DNA, 1052 bp, Homo sapiens
gtagtaccctgacattgctaacagtggttgtattagactggctgagttagaagcaattgttttttttttccctcctattttcctaaatatatttaatttgattttaatgactaacattttttcaaattaaataaaagaatctggactcagattattaatcatatctgaattgccttccctcccaggcaccaaaatgtaacttaaagttctgagaaacactgagtgaatgaagaaatgtgctcttgatcctaacaacctgatcttgaaccagacgattatctggatagaacattgttaaacaaaatactatattgatcttattaaatataatacattgtttggtgactggagaaaacatcaactgccttttttttccagatttttttttaagaaagcgttttgtaaccctaggcaggcagtgataatcagtttgtttttcctatgatagctcctcctgctggactagcttgcttccagttactggaagtgaagggaaagggaaggagaagagggacactggctttaatacagggattgttgtgaagtgaatgccaagatatcatttcccctaacgctcttaaaaaactctcaggaagagcaatttagaagatttttaggaaactgtttatgatgccatttgcaagattgaggaaggttgtttttgcttcacattcttaaacaaactaaggtatttcctttgtaaaaagtaattacaggatcttaactcttgcctcagtttgtctaattttgctcctgtctccaactccccagggtgccgtgttaactccctcaatggagcacaccatgtcactacagcccgcatcaatgatcagccctctggcccagcagatgagtcatctgtcactaggcagcaccggaacagtaggtggcaaataattatcatgtgtctctgtaaacagaggagggtaaattaatgcagcctgtatcttccctatcaaatgacagcctctatgataacagattatgtctaatcccctctcttccccccacatgaccttccataaagtaaatactcagctatttcttaatta

SEQ ID NO: 96875 - DNA, 3732 bp, Homo sapiens
ggattggaatgaacccaaacacttccttcaccaaggggccctgcttttggacaccatgtgtcccaaaaattgaaacttaagataattgccgttagatataatacagaataggtgtgtacccttgcttttgtttattcttcagcaggaactgataaaagaacaagtataaacatggtaatacataaagatgtgtctctagtaggtagcattaagtgagcaatgcagctgacatttgaggtaaaaatataaaagcaaaaaggtgacttcctgtttaggttaagtgaggaggctttaccttaaaataaattcccaacttagcaacaaaaactcttgaaatgtcttgtatttcaagatttgatttgattttaatgcaaaggtagctcctgtccgccatgaacccagtagtgtacatgcatttctcctcctgtgtcagaaaacctctaacaggattacttcctggacccagataggaaccttataatggagttcagttgcagacatgtgggagcagagttcccttttgttgaccatcaggatcctgtgtgactaaatttttgtgtattcttgattttaaaacaattgaattagatgttgtagtcctaatttctggggttagaggactacaatatgtaatctaatagttgtgttattttaacttctataagcctcagtttcctcatctttaaaatggggataataatagtttctatctcataggcttgagagaattatgaaaaccaaatgagactgtataaagagcccagccaaggacctcacatatcattatcactcagttaatgttagctatgattattatcattaatatgcatgattaggtggctgataataagagtatattagttatacgtttaaataatgaattggccaacataagcaatgtcatataactaattctgcctaaaaacataaaaatggttttgaataacagaagtgattagatacgctaaaactgaggattggcattatcattcacagtctcctatgcttctaggctcttacagcctcctttccctgagttgtcactcgttttcttttcttttttctctctgggttcttatgttacttattctggtgcttcattctgctgggcgtagtattgactaatttaatgcctctttagttgttttggatttaggattcctatcctttctttgactgtataagactcagtgagatctgctctagtgcacttccctaattaacaattcatgtgtctgctatgaaaaggtagtctttcttaactgtctgaacttggaaacctctgtcatttatatgtcactgaaaataggggcaagtgtaagttattctcaggcaaatgaaaggttgtaagtattaatttgaatttatgttgctatagatattacagctattaacacatttctccaacacctctttttccctcttataatataaaaccagtgtgcatttggccacagaaccattttgtacaataaaaattaggagatctgtgtcagtaatagatttgatatagctaactagaaataacatattatttcagaggccttatttcctctcctgggcattctgtatttctctaagatacatatggaatttcattgcattgcctgacactcggtgccatagcctcaaagactgatttttaactacataagttcagggacctagtagggtcagtggatgagctttaagtgatctgtgactccttaagttgtttgcaaaatgttgcttgtgtgtgtgcaattaagtggggaaaaatgttctatttccctaattaggttttcagagggctccatgaccctaaagaggttaagaaccaatagtaaagagtttacaaaacattattattcccattttataattagaaaattgaggaatagaaattgacagcagctgatttgctgcttaagaaagaaaattagatgtcatagttccctaatcctgtaatgctataagctattagattattaagaccactgaagcatataaaaaatgggggcatctggcccaaattagggtctgtagggagttgtttgccttcccatcatatatccagtgagggccctgcactcatgttggagtgggcctttctccactaaaccaccataagcttatgcaattggatttgagaaattggcagctgcaagaaaccaccaaccccaatggggaaaggctacagtccagataactgaaatgttaacaaggcagaagcacttaactttggtctgccttaggtggcaaaggaaaccagagaaaacaagtatcggggctctgctatcaaggtaaatcgcaatacattcttcccccatgactcttccccatatcctctctgttgaacctctgaagttaacaataggggataaaatgcaggagggttttgttgttaagaattggaaactgaaacttaataaaattacttagactctggaaagctctgggcatcaagaaatgggctgatatgtttttctcttgagtggcagactacacatgctttctttcctgccacaaaacctgactctcacatctatttctcaattcagagggtctactgtgtggatgcccatttgactgtagatgtcaaaatctagttactgaagtttaatttccttaatctgaatttcagatttttattttctgcactaagtagaaattgttgaccacaatacaagatttctaaaattaatgtcctagatatgaaagagaaattgaatttggttttttgtattaaataagcacatactttaagggttagcttctaataagatgtgctggaattaatcgtcattcatctgtaattctaaagcacctagttcataccttgattgttaacacttttcactatttgagttgttgctgtgtttatctcccttgcatagatagtaaatttcttgagggtggggcccagtctgtttcgcctttttctctttgttgcctgatactcaacaattacttcttgagtgggcaaatagaaattgtttctaaataatcatttcatcctgttcagagtgaccagtttgccaagaattctaactgccttaatctttttaatcattgatagtattgtttccttgttttctttctgtagatttttaacatgattaaaaagagttctaaagaaataggtaagctttacaatgaaaatcaatatttctttcaaaatcctcccttttctaggtgcaaagtccttcgtggatgcaacctcaaccatatattctacagcaccctgtaagttttttatcttaatgactttgtgttttacaagtaagttatgtgtatattctctctaggttaaaaccatttgccaagggtggtataggatttgggaaattttaaacatggaatatgagaatgtacaatttcattataaaacttcttctcatccttataaaacaacttggtagaagatattaagttacattttctataagaacttaaaatatatcatatttgaggcagggcaccattttcttattcataccagctctttagagatcattcaaatgagaggctacatttttaatagtacttgggataaaaccgctctcattttttacattctgtttaatgcagatataaagttcaaaaccgagatgaagattttcatcagtgttacttggcctttctatggagattataaatactaaagtggtagcacattatttggtaaataacaaatgtgatttcttaatgacgtgagcattcatatatattacatttttttaaattgaatga

SEQ ID NO: 96876 - DNA, 1051 bp, Homo sapiens
tggcacgatctccgctcactgcaagctctgcctcctgggttcatgccattctcctgcctcagcctcccaagtagctgggactacaggcacccaccaccatgcgcggctaattttttgtatttttactagagatggggtttcaccgtgttagtcgggatggtctcaatctcctggcctcatgatccacccacctcagcctcccaaagtgctgggattacaggcgtgaaccatcgtgctcggcctaattttttaaaatttttatagagataggatctaactatgttgcccaggctagcatggtttcttagaggggtttatatttataatatttagaagttatcctaaatagtaatctaaatatttatatataaatagtacatttatcactgagttggggtttttttcacctctcttttgaatagttttttttttaattaaaactctcaatttcgtaataaaatgttggacgtccatttccctgtattgactttccatgaattattattttaaaaacaataacatattgatccaagaatgtctagggaaaatgttctagaatctgcactgtccaataacagccaccagccacaggtggctctctgagcacttgaaacgtagctagtatgctagagagattgattttttatgtagttttaaatagctgcatgtggcttatgactatcacatgggacagtgcaggtccagagattaattttcatatttatagtcattttgactaacagaaactcccaattttatcaaatgctactagactctaagtacaaattcccctccctcccctttttttttaagagacaggggtctccttctgttgcccaggctggagtgcagtgatgtaatcatagctaactacagcctcgaactcctgggcttcaaaaggatcttcccacctcagcctccccagcagctgggactacaggtgcacaccaccacacctggctaaaaatagaatttttaaatcatgcctttctagatgaatgtttatatttctttctctttcccataggctggaatgacacttacttacgac

SEQ ID NO: 96877 - DNA, 2066 bp, Homo sapiens
agttgtcattcagaagtgagttggcattccaacccatccctccagagtggttcacaccagggaaagaagaaaggagtgccaggcagcagcccagacagctcacccagaaggagttacagttgggctttttgttttcttttgttttgttttttggcagagaagtgttgaaagacactactgcttccaccctgtcattagtgggtgggtaatcatgaaataaaataagagatgaattaggataataagaggcacaggagaaaggagtaaattttccacaagtaatatttttctcttcgtggttatttaactttgaaacagaacttgaaagtagtaatcatggttctacagtagacaaaggacagaatgtgggaaccagacaggaaggtgtgattgcctttattacattaactagaaacacagaaaaatgcacaactttctggaatacactgctatttccattgcagaaaagcaaagaaaaggaaaagttactggtgccctattgtgctgtctgtagacttttttttttttttaactctaatgagtatatatctttgaaaatattctctacatcttctgcttttctgttttggcctcatggattctgtaagaagaatttatataaatgtataggtatatagtaatatatattataagtaatatagtaataatatacagatctatatatagtggtatatagatatatagtaaagcaatacccagttgtatgattaaaggcacagaaaaacctttaaatagggtggacaagtatttttagctttctcacaacagccatcttcactgacgtatcccaaaaataaacatatgagacctatttctattcattcactgatgcaaccaagatgtaataagcaactacaaagtccagacacttaggcactggggatacagtgatagacaaaacagacaatgttactgcccccatggggcgtatagcctagaaggggaaacagacaccaagcaagtaaacatactcaccaattgttacaaattgtgaataaaaatatatgtgcgagcagtgtagaggtggcttgttttctactgggagaagtgaagggtccctcttaggaattataatgggacgctaagggaccattttaagttgggggaggggaggatggcacaatcctattgaatttgaagattattttggtgacggtccagaggtggaattggagagggcccaaaaccaaaagaaatgtgtctactcttaagtgtgaaagtgaatcgaaagattcctttgcttcctcagaatagttatttaaatgttcagaaataataactagtatgtttttctgcactatgtttttcatcgtggacagttttacaaaggtctgagtaaactgcttttgccttaaagtgttgtatgaattttctaatagcgtgaacactattcctatttttgtaatacattttgtcatccacatacacgtatcattgtggtttcattttatttttctctgtttacttagcccccacagaacctttattgtgtaagtttgctgatggaggacagaaaaagagacagaacccaaacaaatacatccctaatggaagaccatggcatagagaaggagaggtgagacttgtaagtcctttcttgaaactttgcggggtgggggagggggtgtgatcttgaatgcccacatgaaaagtaacacaaaaaggcatcttgacttggctgcacacttctgaaataggtgccaggattaaatcttcctttcggtacattataattcaagtgatgccaaattaaaattcttttcattatatatggtgataacagagtgattctccagatggaccgataggtggtggaagcagctgtgtttaccagctagctacacatgaagtaaaagagcattctaaattgccataagaaaaacacaagtgatttgggtttgtttttggtttttttcagaaacagggtttctgtaggctaggcgcggtggctcacacctataatcctagcactttgggaggccaaggcaggcagatcacctgagatcaggagttagagatcagcctggccaacatggcgaaacccc

SEQ ID NO: 96878 - DNA, 1697 bp, Homo sapiens
atgctcaaggtaacactgcagttgtcaagctgttggagatgcatgttcctgttggttctgatgaacaggaaaataactctttagttttgggtgatgagaatgagaatccctttacaaacccaaaagatcacaactaattaaggggaaatttaacctagaatgctctgcatatttggcaaaatcagttgatttaagggtaggttatatcatttttatagtactttaacacaggaatacatcttaaatcacaaatcatttgtcagaattatttgtaatcactgctttgcagaataaggtaaaaagttgctaatctggaaaagtaaccatgcatatagaagattgacagttacatattaatttttatattaatttggccaaacttacatatcactcaaagtcatatgactagtatttatggcacttccttttctgcatgtcagtcttccggtatctctcccttgtaaaaaacaattggagttcagctgaaaggtacgctctatagaacaagctactgtcacataggatctcctgattcttcaacctgtaacctgtatattcagctccaaaaggcaaactagggactaccgctggtttggtagaagccacaggagatgctggccaaatgaggatctctcattttgtaacacgctcacacacacttaaaaataagtgggtcatgacatcagtgtgttttgtttgtttttcctacccaaaaatctaacagatcatctaacccttgctcaacatcatggtaagaccacatatcaattacaataagtcaggcccttttgccaccctaaaatacctaaaaatttcttaaatcttgatgtaatttgctttcctagggcacatggacaatctttgtaatgaataaaacattaagaacttatagggagaagctgtttctaataatgtccttcaaataaatggaacagcaattgtcaaagaaatacagctgtttctgcatcaaaagtattttgcttctggttagcatttttattgaaaacaaatacctctaaaaacaatgctctgttccataaatgactaaatgggttttcatgagattaggtacactcttttctccattaaactgcaagccccagggaggcaaggaccctgttttatctaccactgtatccccagctcttgtgtacttggcacatagtggacattaagttaaaattttgatggttaaatagaccaaagagaattttaaagaggaaagctgttagaattttatattgcttcacatggaatattggggtactcccatttccctgaaacaagcagccagcaactatctcagaaatgtgtcatttttactggttataattcttaaaaagcttgttttcctaagatatgaaatgcctgccagtatacaaactgttgtaactacttccctttttgcttttagcggggaaaaaatagcttaatgacagcatagaatcatgtagtaaatataattcattttttgaaaggttcagctatatcctcttccatttgtttattttaaatgatctaattgcaaacatgtcatcactcccttgatgtttacctccttgttatgcatttttagcaggctttattgtcacctgagattttttttttctttgacaggctggagtctagatgaaggaaaatgtgttagaagcaccttatccacagatggggacacttggtcattcagcacatgttga

SEQ ID NO: 96879 - DNA, 1100 bp, Homo sapiens
ccactctggcctggggcatggcacataataaagcacatggttacagttttgtaaaaatctaatgtaccacatcacaatttctagtgccgtctgctttctgaaatgctcttttaaaatcttgtgcttttgtgtctgatgtcactatattttaaaagaggctttatcttttcttatagcagatgtttctttaaatgtatattatagtttgttgggggaaaaaataattgcttatgtggcctttccttctgtctttccccacccagtcctgcattttttcctgaaatattggaggtggcttgtttgtattaagtcagatttacatggaatgtccccaaccagggtaaaagaacccatggcttcttcatgacacagctaggtgaattccatcgagtttttccacaaccacttaatacttgcttgataaaaattccattatgcagaaatagtatggtggcagttttctacacaatgaatgttagaaacagagatgggaagttttagttatctagaaccagtgtccaaattaggagacatgcctcaggcaaaaacactgaaacacatgatcatgattcagtgatttgtctaaaaatgctcttctaggaccttcctggaagagagtacagtctttgagaagactaatgcgtatggcatgtgagctggaactatcctagagctgagaacagctctggcgccctgactccctgcacaaacacctctccccctcgccaccaccaccacctctcaaagacaaaggctaactgtgtgttcagtgctgcaggagacagtatgatttcccatctcgctttctgaacctctccatgacattaatggagtgtgaataagtccctgtgtgctaagggcagggaatgcctgttagattctcagtgttgcactgttatcattctgccacatcgctcacagcttcatcttgtcacagaggagcctcaatgaagtgcatatgtgtctgctggcagactcccttcaaaggcttcagcttgttttacatctgctttctgtgttactctgacttttccaattggttatgtgtccagtggggcttgaaaaccgctcttgcccacatttcataactctgtgtgtat

SEQ ID NO: 96880 - DNA, 1048 bp, Homo sapiens
gggggtttgcagactattggtcacatccattcaagggaaataaaagccctagatttccaaaccacatgtaaatgatcgtaggatcctcttcaccttcacagctagtaaagagtaatttcttccaagctgtgccaagttacaaatggagcacaagaaacagattagttccttttacattgagagcgttactgcaggggtacagtttttcagtcaagctgttcactttgttctgaattagcacttaattttgtgccattttgaatgtgtaatgatcttttgagtgtgtaagtcttggttgacaattagattgcatgttctttgggggcaggagctatgttttctttttaattttgtgctagactcagggaacttgtgcatcaccctaccaccagaagttaccaacaggtttctaagagcatttttcatgcagagctcttcccaagaattattgctaatttgagggcctttttggataccacctttttgcacaggaggttaaattgcctttaggcatgaatgttaaatgtataatgccagacttggaagcacactggcacagtgaattcagctttttccaaaacaagtccccagtagacttgaaaacccacaaagaatgtgaaagagttttcaacttctctagacttcttttttcttttttttttttttcttgtatacatggtgacttcagaattcttttgagtaccagtttgtgtattagatactgttctttctttatatcccctgaatggttactccatagcatcagtttctctgtggagggcatatgattattatcagaagaaccagataaaaaacaaaaatattgtcaggcaggggtcagttgaatgagcctccacttgaatgtttgcataatgtagtctcattgataggtagacataacatttcataaatacagtcagaagacggtttatttaatgatgcaagttgtttagctggcgtaagcagaattatctgggatgattcctgtcagaatacttggattcttgcatggctggcagtttgcccatgacattggagccaagtacag

SEQ ID NO: 96881 - DNA, 1348 bp, Homo sapiens
tttggctcaggattctgataatttcatctactctcaaggttttaactactacttatattcatagtcattgactctcattcatctctcatcctggctgttccccagagtttcagactgcctgacctcagttaccttatattcatcctctccagaactacactagtcccccttacctcacttcccatctaattctgctcttcctcctgttttcctgctctcagttagtggaaccagtatctacccagactcccaagctagaaacccaggactggactcccctacctcccctgtgctttgtatctcacatacaaataatcattcaagtccccaaatttttctttctgattatttctagaatctaccttctccctccctttcttctgccactgcctagtttaatttctgatcatctctcatctgcaccattgcatcagccctatttcttcttacctctctaaggtattctccctgactgtagccagagagacttagataaaatatatacctatgtgtcactttattgttaaaaatcgaccccctctcagttagaaggaaagattgaggattcctggaatggcatggaaagccaaaggtgacaggagcccttgcctacttctgcagtcctgtctccctccatcctctgccttcctgcttatcctcctccaacattgaactacaaatggtattcccaacacagcgtgctgcatcatttttcttggctttctctcatggtttccaatgacccagatccctttggttccctttagcctggctgtctcttcctcagctttcaagactgtgttcagggcttgccttctccctgcaaggacctcctctgacccagttgggttatgctgtgtctgcagatcatcaccttgaggacacctccgtgtgtgctgtggcacttaacatgtttacatgtgtcagtcccactaaactagaagctccttgaaagtagaaactgtatcttcagctttttattttcatgcccaccacaacttttgagccatactatgcaacaacaaatatttggtggttttgaataaattttactacactgtaacaccaggccaataccatgttcttaacaagctaccatgtggggggaaattgaaatgtcttctgatctgatttgcagccagccactagcatgccacctgccagaaaggagaaagtttcaaaatttagaaaccacatcaccttgctttgagggggaggtaatgaaattgttaaaatggggaaaaagaaaaaaagccacatacaccctcctccatctttctcccctgtaattttagtcatcttatgtttagctggcataatgcatctgtaattctacttcccaatctgt

SEQ ID NO: 96882 - DNA, 1056 bp, Homo sapiens
gcttcagaatatactctattgttatcagttgtcattttactatagaagtacaaaagcagcagttagataaaaggtagaatagaccctttatcatattcacatttttactaggtttcatttatatccaaaaaacctataagaatgtttatgcatgcaccgaacaagatgaaagttaagaaacctttaaatatttatgtattctatttttattataaataggatggaatcaacagaaaaatgtgaagctgttattggtcattttaatggaaaatttattaagacaccaccaggagtttctggtatgttgtttgtctgaaacttcatcagtagtcttctatatgatgtatgtttaactttagcacatgatgactcttcaatagaacaaaaacccctcatttcactctttaagatgcattttgttggatttagaaataagacttaaaaattcacctctccctaggcataggcattggatgtttaaatgttaatggaagcagtggtaaggagctgacttgtaaagcattgtgcaattcactcctcttttgatgcagcagccagcttctgaaccaccttatcaccatcctcagtgaacctcccttcatttgatcatatccgttgagcactgtggtacctttctatcccagcagtgcctagacctcagttcctatggcctttatgtccactccactttagccactttctcccatggttttacattgtgttgtcattaccaagaacaccacacttcatgggtttttcattccaatgtcacacttactctaactcccacaaaccctgatctgaaatacaaagggatccttctcttttcactgtttattcatcctcctttacctgtttctctttcctactaagtctggtctccatttttgagtgttaaaatcatttcttaagtggcattctcctttttcttgcaccccatcccttgttcacactgtcatgacagaatgctgaacctgaattaatcctgctgtaattcacgcacaccactcctgttatatccatgcagccaaagattggcactaccacaaattaaat

SEQ ID NO: 96883 - DNA, 1043 bp, Homo sapiens
atatactccatatatatgtgtatacacacacacacacacacacacacgagagaaacaatcttgctcttgcccaggctggaatgcagtagcatgatcacaactcattacaaccttgaactcctgggcttaagcagtcctcctgcctcagcctcccaaatagctgggactacagatgggcaccactacatctcgctgacttttttttaagagatgaggtctcactgtgttgtctaggctggtctcaaactcttggtcccaaatgatcctcccaccttggcctatactgggattgcaagtgtgagccactgtgcctggcctcacaatattttgatatgtgtttcttctgtaacattttttataccatatctctgtccaaagagtgttttagtgccctttaattaaggggtccccatctttattaaaagatagaacctaaaatcaaaactaagatgggtttgatcatatcattcccctgcttccatgccgccaaaaccgccctatttttcaagatgtagctttcaaactgcagtttcttcttcctcctgtttccccgtcacctaccagtgtgcaatcatgtgttgcttaatgacggggatatattctggtgaatgcattgttaggtgattttgtcatcatgtgcacatcatagagtgtacttacacaaacccagatggtgtagcttgctgtacacctaggctatgtggtatagcctcttgctcttaggctactaacctgtacaacatcttactgtactgaatactgttagcagttataatacaatgataagtatttgtgtatctaaatatagaaaaggtacagtaaaaatatggtataaaagataaaaatggtgcacccttatagggcacttaccatgactggagcttagaggactggaagttgctctggatgagtcagtgagtgagtggtgagtgaatgggaaggcctaagacattacactgctgtagactttataaacactgtatacttagactacattaaatttattttaaaaaatttctttctggccaggcacagtggcctac

SEQ ID NO: 96884 - DNA, 1033 bp, Homo sapiens
cgacaggtctgctttttctatctgcatctgtaatctccccttcatcccactcagcacagcgccttctggacacttgtcctgtgcctccgcagcctccacagtcactattgtgcaaaggactgttccttgtaacttaatctatgaaggaggatttataaatatataaaatttacatagtaaattatgtaaccccataagtaaattgagaaatagcagcatattttctcaggtaatcaggtatttgtgagtctttaagatctgtactgttttttttttttttaaatttaaatgtcaatgcccagggaatgaatacacttctagacatgtttcaaaagataattatgtatagcatatagcatattctatttcaaaaatatatataactggcacatacattatacaaataataaaacaagtagttttaatgcacatgtgggctacagatgctatttttactgtgcaatagtgagacatttttaggtattgattattaatggtatataaatctactttttagtagttctataatgactttattcaaaatttatttctgatgaacttttagcatattttagatgagcaatattgttgaaaatttcttcaagtgagtaacttgcttgaatgttaggggattataaaatgggagaccatgtttcatgcttaatatatattttagcacagtacacatggatgttaattatgataaggtacattttttttttcttgaaaactttcatattatggtagtttccctctacggttttgacttagaatatcacagtttctggatgtaaatggagttgatcagccagtcattgtgtccttctctttgcattaggttcatcctgaaagttagtttaagatgctcagaccctcttccaaaagtaatgatgccttagatagacttgatggccttgaaaaagttggccttacatgatctaaatccctagttcaggtgcagtcataattctaaagctggagggaccttagattgtcttgtgcatctccccccaaccccactttcaaacgggca

SEQ ID NO: 96885 - DNA, 2651 bp, Homo sapiens
tctgtcacccagactggagtgcagtgacgagatcatggctcactgcaacctctgcctcccaggctaaagcgaccctcccacctcagcctcctaagtagcagggacaataggccccgcaccaccatgcccagacaatttttgtgctttgggagggtagagacggggttttgccgtgttgcccagcctggtctcgaactctagggctcaagccatccgccggctttggccttccaaagtgctggtattacaggcatgagccaccatgctcagctgggaatcatattccaacatgagatttggatgggtgaaatattcaaacgataggagctggtaaatatcaagcatgtaacctaggtagatagatggttgctgaaaggttgtctttagatcacttatttttttctcatttgtagatttttatagattatttctttgtaagcctagtgatctgtgttaatattgttaaaatgctcagaatctcaacagggaattgaaggtgtttgtgcagcattatgcctcttagatgtaattgtcatttgaacctgaaattatctttactttcatgcctagttagtaatcatttgattacatgattacacagagtgaacataaggaagattaactgaaggagagaagtggctcaagccatttttttttcttctagataaatatatttcagcttgtttcagtgcataaaatacaagtgtgtaatattcacaatggtttaaaatgctacaaaatacttccatttcctaaaaattttaatatgctttttgtcctcaaaatcattcatgagaaaattaaagtagagcaaatgtggaatttttgaagtaaatgtctaggaaagtagactgtaaatgaggaaacgtgagactcagatgcatcgagtaagttaaatgcatttcccagagtcttactttgatttgatttgttttgttttgtttttgagatggagtcttgctctgtcgcccagggtggagtgcagtggtgcaatctcggctcactgcaatctccgcctccccggttcatgcgattctcctgtctcagcctcccaagtagctggtactacaggcatgcactaccatacccagctaatttttgtatttttagtagagacagggttttgccatgttggccaagctggtctcgaactcctggccacaagtgatccatccgcctcaccctcccaaagtgctgggattacaggtgtgagccaccgtgcccagccttactttgatttttaagaaacaattttaaaagttatctttcaaaactttttttcctcaatttttagaaggcaagcatagataacagtgcttttccttatagtatggccactatggagagagtgtggggttcggttcatatttacattatactgtcgcttcgttttcagtagcagtatgctaaattttaatgttcttaatttttcctatattccccagcatctatggcacataaaggaatttgaacatatttctcatagaaacttcataaaattaatgattaatccctgattaattcttatattcttcttcattatattcttgattgtccgtttcttagacacatgtgcatgcacacaaagtgagtttactgtataattattattactgagttacaagtggtgtaaataagtgtatttatgaacagttataaaagtcctcagtaaaaaggatctgtttgacaccattaagtgtgctaaacataaacatgcgcacacacctgcccttctgtggcgatatggagccttgcaatggtgtccacagaaccaaaatgaatagaataatgcaagcagctttccgctgttactatttcataaaagctgtatggatcataggacagtactttcctgttagaattctataaccttgcatttggctttgtattttaccactgatatactgttattagaagaaaatatttggtatagagcccacatcccatgtttctgtcctaagattgtcaggtaagtacttgatttcttcagagttgaacttcaaactgcaatcccacaattcaaacaagaggcctagccattccctttttttcagttttgagttcagaattctcatttcctgtctcttagtaaagaaaattttgtactctaaagtttgcagatgtttgaaaagaatgtgtgttctttggatttaggcattaataagggttccttataacttctttttctttcttttctttttttcctttttttttttttttttttttttagatatgggaaaatagtctccacaaaggcaattttggataagacaacgaacaaatgcaaaggtatgttttcttggctggttatttggtaaatgatagctttagaaaaatgatggaatttaaaacctgatctttggtttcaaaaccaccttcgttttattaaaaaccagatcttatatatcacccagtttctgtcttgcacagtgtcagcatattacttacatttgtccctggttgggttttggctacaaacccaacagcagctagcagtttgccagaattccagatttgacgccagtagagttaacatgcaaaatacgggttggcatttagcccttgcttttaaaaggggagtagagttagaaaatagcttttctttcctgagcctgaggagattagagctgcttactgaagaccattggact

SEQ ID NO: 96886 - DNA, 2616 bp, Homo sapiens
aaagtgctgggattacaggcgtgagccaccgtgcctggctgatgatttaaaaaaaaaaaaaaaattaagctacagataggagcaaggggaggtgaagatctggttgctttatgaatttgtacccagatgtctgttactcttacaggcattggtgattgacaacagaattagattaaatgttaactgtctataacagctccccctcacccctcactttaaatcttactgcaagtaaaatgagtagagagagatgatgactactgtgaaccctcccactccttatcccagtccctgaggtgccatttgatatatggctcctcctcatattctagatctggacctttcctggctcttttgtcatgacatcaaaaactactggttctatactgcattgccacaataagatatccaagttgcccactgaggagctaacttagctagggcctgacggatttcaagggttgcatcttctagttctggggtctgtattttaatgggagcctcttgtgctggaagtggtataattgagtggacagcccaaaagaagaatattttaggaaagggaagcccttcagcaccttaggtaaatccaaataagcagcttcctgtgccacttgtttgcagaaggccagtatgcagctgccccacagacagagtggaatccgtttctgatgttctgtgaaatcacagtctttcagtcttactccacaacttgcaaggaaaaccacaatagaaagtaaaactgataaatgtcagaaatcactctttttctactcaccatcctctgtcttgttatccctctttcaaccataagccacgtgtttatttcttatgtttaaaacaaatgagtaaaaaatgtcctgtgcttggaaaatgaatatttgagtaccgtacagaccttccattacccttcttcttccatactcagagggcattgtttctcaaaatcatttcattgataagttgccatgaaaatttactcatttgtgagctctgggatttcaggcaaggtgtaatgctcaaaacttgtatgagctttttgttttctcatatgcacaaatgggaataataacacctacctcataagattgttgtgaagttaattaaataaaagcatacatgcaaagtacctggcacagtgtctaggacataagtaggaagtcaacaaatgtaatgccctttctagtttcttagaaaatagccaactaaatagttgaagagattagtgatagtttcatggaaaagataatgtttgaacaagttcttcaagttcaagcatgggtagaataggtaatggagagatgtttaaaggggtatttaaggtaaattaatgcaacagacagggttgaaaagctggatgcagggagaactattatgtgttttttgcatgtgtctaggaacagtgaagggagaaagtaaagattggaaacatatcaaagacaaaatttggaagagttattgatcacctgggttcaggaattactgagttagtggtggcacgaggaccccgagcttggtaggagattgggagagtgagtgctagtgaatgaaaagagatatggagagagacagggaaagccatgtttgagataatattgaagatgagatttagaaagtcgtgggcttgatatttcactacttaaatatttcactggatatttaagaatcctaataaaatattaaggtatttaagtagaaagaggaagagagaaaaaccaaagctttggtgagttttaaaaaaaacacatacacacacaaggaagaactgagcagcatcagaggagattcattaattaaaaacatggcactgaatgaatttcctaagagaagaaacagttgaagaccaaatattaaacttgatgaaagtacttagttaaggagggagaagaggaagctgaatgggcaaagaacccctgaaagagggctgtgaaagatggaatgagatgggggagtacctgccacagagaagggaggtgcactggcagagcggactcatgccagatgtagcaaacaagctgagagagggtgtggcatggcttgcattcagcactactgagccttttctctttgcctacttcctcattcccctttctccatgcattttcctgtctttcccatcattaaatgttgaaagcagaactagaagtgtcgaaggccaaccctttaccttccttctcctaaatgagcctttcttctgtttggtttacaaaatgccctgaactctgagagcttgagcagtctcttaatcactgtgactctcaatctccttaccccaaattggagtcatacctaccgtccccccgcttttggaaaagtatgaaacagggatacagtctaaaagtgcttttgtcaaggacttgtacacacgagagagtcctggtgcctttgtccatttttcgtgttcctgtaaaggaatacttatgctaggtagtttgttaaaagaaaaggtttatttggttcgtagttctgccggttgtacaagaagcacagcatcagcgcttgctgcttgttgagggcctcaggaagcttccactcctggcagaaggcaaaggggagaaggtgtgtgcagagatcacatagagaaagaaaacagaggaggaggtaccaggctctttg

SEQ ID NO: 96887 - DNA, 1047 bp, Homo sapiens
gagctttggcttataacctggactcttcaaaagctgcacgttccctagcacacaggaaaattgtgtgtgtgtgtgtgtgcacgcgcacgcatgcttgcacgcacacacatacgtttatacatttgtacgtgccagtggataaagtctataatgatatgcaccaataatcatatccaggacttcaggtgattttaatttttcaacctacttttctttgtcttctaagtgtacaataagcttgtgtttcttttgtaatataaattaccaaaaaggtagaatttaggagtaactaagtgatagaggcagaggagaaaattaagctttatatactaagtgcaaactgagatatacctacattttatattgtagcagatgaaagaggagatctaaatggaaagaaagaaatgagtaaaactgtggtgtaaactaaagaagttttagtaaattctaagtaaaaggttttattagccaagctcacttgggccaagaggtttgaacatgagcttttacctgttatcctctccctttgaaattcatattattatatagtcatgtctcttaattactcttcatctttttactgtcagagcttgctctggagtggattatctactctagcaaagaatattataatctgggtagctggggctgtggtctaacccagttactttgaagccagatgaaatccaaagaatcttcatagtcacagtttttttttttttttttttctttcatgaaattctacatcatgctgtttggtcgtgcactttcttagtgtccttagagtgtgaattccgccagtcaggagacctgtttctcctagtacatcatatgtccctattccgtaacagtgattttttttttaaacagggggtctcactctgtcacccaggctggagtgcagtgacgcagtcctggctcattgcaacctctgcctcccaggcccaagtgatcctcccacctcagcttcctaagtagctgggactacaggcgtgcaccaccacgtccagctaatttttgtattgtttgtcgagagggtgttttgcc

SEQ ID NO: 96888 - DNA, 5831 bp, Homo sapiens
tcttacattcaccatccccctgagctttgggacatttatatatttgataagtgtgccaccaatgacctgatttatgtcattgtttaaaatgtcttttacaagtgctggccaagaacagagctatatggcatatccccagatgcctcccttcgtgttcaccatgaccgctaaccaacagttgacaactcaatcactcgttcatccagttacccactcactcaagccacatttcatcttcccaggtttcttcatctgatgtatgagcaaataatgatttttttatttaactcaaatcagaatacattatgtaacattcctaagcagccctgattttctcaccactccccaaagtagaaatagcaaaagtttaatgttcttacagttctggaggttacaagtctaaaattaaggtgtcatgacttgctcttaaggactttgctagtacttgttcttttcataagtgtctctgaccttctatttactaatccaatctagaattttgcctcagatcaacattggtcttatctgcctttagtttctagaatctagtttttttgttttttaaggaatctgaatagcattttgccatcctatcaacagctctcctattatgcaaggtttctcaaaacaagattggtaaatgcttactgacaatcatatagataagaagcacttttagccctgatctccatacccagaccctacacttgccaactacaagcagaagaacatcattatctggaaaacagtggattcaagctctattgagggtgaggcatgtttaccttcatttgggatatggtaattgtgagaaactgatactaaagtaattttacagcatttggtgctctttatagttacgtgttttcatataaagataattcctctctgattttcttgagtttcaagattctgaatttttggagccgtactatcctacctccgcaatgattgctcatctttatctgcagtatctaaggacagggtagtttgcagacaaaccagtaagaaatcaatacggggggctatgtatccttttccatcagatccgctcttacagctgtaaccattgtcacaagtgacctttgagccaaacgtctaagtttagaaacgtcaactctgctggcaggctgtggtagcattcccttgcttatacagtccaagtgtgtcttttactagggatatgtttatatcctatccccaaattttttagagctgaagtgagtaaaatagatatcattttccttgtcagtctgttcttcagactggcttttcaaggtcacagggcagtcaggatttattacttgagaaaaggatggactacgtttgaaaatcaatatgctggtggagtgttttggatcaaagccagcgttagtgttcagtcgaagaaatgtccaatttgactcttgcctttttagcttgtatcagaatcaagagaaatttctaggtaattttgcacactgttttaatagcttcagataactctgttttgcttcagagaggatgtttacttttactgtctgtcatgctgttcttgttttgaatgaagcagtcatttatggttttcagtgatggagtttaatgcattcactttctacagattctgacacagttatctggttgtgtatgtgtgtgtaagatttccagttgtgtgatttactttaaaaggagtgacaaatttagagacacttgaaaaacagtttagaaacgaaagcttttctgggttttttgcacacgttccgccccaccccagccccttatagttttgtttccgtggtgttgggggcggggggagggtgctaatttttaattccattttaagttcctaaattgccttgcttccctcctgtgattttttgagctaaattggcataaactataaggtcatattcattttctaaggcaaaatgtatttcccttctcctcactgctgccaattccccacaccaaacactttttgggggaaaatcatattacatgtttatattttattcactcaaaccaatgtatgttgagaggttacaatatgaaaaaaaaaaaaactgtgctgaaaagttacaaaaaagttgtgtctctcttttctcaatattttgccacattggatcacattgatattagggtaagaaggtagtctaggtaaatgctctcaagtctcaagtaattagaagtgcccttaattgaagggtatgggagaaaagaataacacttattagtcattgaatattcattatatgtcaggcaccatagtggtcatttataacagtgctgtgagggagacattatcatacaactttacagatgaggatcctgaggccaggcaactaactacaccagagtcacagggctgcccattggccatatcagcacttgatatggtctctctggtggcaactctctcttctttccattataacattgtcttccttatgtttcagtaaagttaagtagtatataaacacaagggtgacactgtcaaagcaaagaaaatacattacaggttttggtgggagaggaagaaaatttaagaaataattattgtcagttcataaattcaattcagaaatagaaggccactttctatgatcaaattgcctttgctttaaaagttggacattcatcagtgtttgagacatttagggattcatttttatgatagataatatacattttacttgcaaaattctgggtttcattttcggcacatattattttcctctgacatgttagtactcgggagcactaatttgggtctggccatctgtgactacatccttaagtgctgtagtacagtgacttctggtaaaaatattgtcataagataatgtaaatgaccttttgtgtgcaatgtgctcttaaaagaccataaaataatgtaaagctacgttaccttgattgcagatcataatagacttgatactaaactataatagcaagtctgtgtaataaatcaaatgctttataatatgctcttttatttagaagagaggttatacatttttcatagtctatggcaaaaaaatgcatcttagcgatttttaatgagatagttttagtgttttatatgaattttttagtccaagttatacatacagtaaacagcatcaattgttaccttcatatactatttataatggattcacccaggcatgttggtaagacattaacaggaatgattctcaatttagtgagaaaaggttattagtctcaaaatctgggtagagatgaccagtttcatttgtactctcaaaggatgtgttgatctgaaaatttcaaagttatgaaaaatcaggtatgtagatgtctgtatcttctcttgaaaaaatgtgataactgtcccaatgcttctgtaattcagtcttcatcagctcacatgctgtaaggcagctaggctagctgagagttagaccacatgaggattgtctgaacttctgctaaatcacctcaaatctgcaggctttgcatctgtggctggagctgaaattgttttcctttccaggacagttcagaaaagtgaactttgtgattctttttccccatcttctaaattcacagagacaagccactggctttccattgcacagataccatggattatttttctcagatgtcaagttaagcatttaagacttcttcaaagaaatcctttgtctttaatctctcctgccctgtagagcctttccattcaccccctccgtctcgtcatccctcattgtaatttcttgaacttaagtgttattgccaaagtacaaaaagcaagaaaataaataaaatgtggcatctctctctgctaatcctggacaaaaattttcgttaatcttactaaaataattgctcttgtgatttcattctacagttccaaatcctccagtctcattctgttctctctgtccttttcttagaatgcagagtcctccaagacttttggagacttaagtttccataactcactacataggtttgcattagattctttattgtcctacagagcccacctagatttttgttttctccagtttttcttactcaacttgaccttccctctatgtttatgcctcctttatttagcatacatcatacagggtctcatatttttagttattttttagtattaaaagttttttacataccccaaaggactgtcctccttaatggtaggtgtggcatctgctgtatttttcacaggccttgaaagggcatactgtaaacatgctataaatatttttgagttgatttcttggtttgatctctcctttcttgactgtacttatctttcccgtaatcccttcaccttcagcgcctggttttcagttgtttctgacctttaggtctgcagtagcttttcttgccaagcattctcctttaaaccctggcttcaattccagctacatacaccaggaatcttttattcataaaggtacactcagccatataacacaagtggaaggggcagctatctaatgtaagagttaggccagaacaaccaaatgaaatggggaatatctttctatacccttaatttttgtgtcttggaagtagaaacattgaaaatcatcagggcaaaagaggtaaatgtcatataaaatttacttgattttgattgcctaataaatttttacatcttctatctcatctccaaataccactttacatgccaagtaaataaaggaaatataaccagctgaattattccaggtagtgagaattcagaataacatgggtaatgaccctttctactatttttaggcctcattctccaaaaaactttatttgctaaacagacgtaatgtatactttgtgttccttcccctatccaaccactgttgaaagagctaaagcaagttttaggaaatcccctttgtctgggaggccattgaaaaaacaaagcagccaaaaaagtgagttagaaaactgcattcatctgtgtgtacatgtgtgaggacgtgtattgtattttttcttttttcccagcaactccaaaataacaagagggggtttcctcaaatagatttgtagtcctcaaattcatttccctcaaatagataccttagttattccttttaagctttaaagccagtcctgccgaccccctcactgaggtatatgctctactgggcatgttattccaagatagaccaatgtcatgtatccagaaggtctttagtcaggtaacttcttcctgaatgtcatcagcatctgtcttaaggaccttagcaattacggagtccacccctcatctccttactcttttggagctgtgtgcagagtcaaactgggaattactttcaatctgtggcacagtctgtggttggtgacccaagtttccatagctgtcaacatgcttggcctttaaactccaaagcaaacattctacctcccatctttgctacttagttgtgtaaccttgaatacgtcccttactgactctgctcctgagtttcacatctacaaagtaggagtaatactccacctccccaaaagattaagaagattaaaataattggcgcatatatatgtgtgtgtgtgtgtgtgtgtgtgtgtgtgtatatatatatatatatatatatatacacacacacacacacatctcgcttagaatagtgcctggcatagagtaggagctgtatacctgtaagtaattacttttattattcccctgaattaactcacgaggtcataagttttctgatgttgatgttttatttttctcttctttttctcatttcaatcccctgtccctcctacttgctaattatggtcatatacataggcacagcgtcttttacgggatgtgtgaatccctgtttgtccttcaggagcagctattatgaaaa

SEQ ID NO: 96889 - DNA, 1745 bp, Homo sapiens
aacattaaaaagtatatagaagaaagtaagaatcaaaaagtaataccattggtgaagaagccctctcaacagttgattggctaatactgaaattaatctaaactgatcctttaaggtctacacaacagagcaacagatttgtacatgttatgtgtgtgtctaagagtgagaatgactgagacatcagaacctgaacagtacaggcttctaaaggatgaggacatagagttacatagcactctgagtattgtgaacatttgatgagcagtaatgatctaaacatcaatgcaaagataaatacctttaaaacatgttgctgtgtgtttactcacagtagcttataacggtttactttggttgcaaaggctgttttttatatatacgtgtatgtatgtgtatgtgtgtgtatatatatatatattttaattgcatctctcacacacacgtatgtaaagatgtatgtcagtatggggaagatatagactatattcattttgctgttttggacctttcaataagaacctttttaaaagacacatcatggtgtgtaataaatacactcttgtgttttacttcctggcaccgtggcaaaaattaatttacagatgcttttcccagaacttttagatcaccacaaatgatttagagcatcaccatggctttgacatctgtttgtttccaactacatccaaaacacaggaaaaacgagtaacaagtcattgttaccataaacttcaaaggaataagagctcaaaatatttttttcctggaattttatcttgaatgttattaaaataacttgttcatcaatttagaatttgtgctgagatggtcatgttattcaaaatgaaaacatttgtttcagtggactggaaggagttgtgttacaggtaaaggaaaaagggaaaatgtaactctctcgttagatgacatgcaatagaatttttcttcagagtctgtgcagctggcttcttggctttttcttcagcagctcctcccaccatgcctggcctccagtgctgagggcgctggggagagagatgtgatttggctcaggcaggcctaatgaaaccctgcttgcctgtgtaataggtggatgatcctggacaacttgcttttgcttcctggcctcagtgttctctgttcataaagtagggattataatgcctgtgatgaggattaagtaaggtaacatatgtaaagctccttggccagtgcctggcacaaatagggcctggaaccaatagtgtttgcttcattctctttcctcaactctcctcttctgcctattgagtgggtgattatcagaggctcctctgtgcacaccctgtcttctctgtcttatggccactaccttttcttttttgaacttttaagtcttttaaattaaaaaatcaattcaaccaccatttatttagcaccaattatgtcaaaggtgttgtggtagatagcatagcacataaaaatgaataaaacagtttctatccttaacaagattaaaatatatgtgagaaaaagatatatagatagcaagcaggatatgatgactgctttcccaatgtataaggaataccagatttggttggggagatgagcttgacatgccattattgtgcactttcatctagaccttatttagatagacaatagaatgtactgtaacttttttctagtatacataaaattgagtactctatagtctctcgtcactacagtaaaggaggagtgaaaaagtgtgcaatcaa

SEQ ID NO: 96890 - DNA, 1031 bp, Homo sapiens
agagcctaatttggtagccactgttccaaggaatgtgccatttatccctggatgcagcaatattatcagaaagccttgtgcattaaccacatagctatttgcccttgtagaattccagtacttgggccccaggtgatcccttgaccgtgcattgcacatagagtatggcttttaggaggaaccacaggaagacgctccttccggcattagagctgggaaaaacagaacttctcttaagcccaggacctggttttactctaatgaatactcaatttcgtaatgttgtatttccctatgttcactactaagaagttatgagtcagctttgcatccaacattagcagctctgcaggatctcactttcaggttcatgtgtctgtggaaaaactactcctgggttgattttttcttcacttaccttgaactttatatctatttttgtcttgtggtgttgcatatatttttgccagcagcctcaaactttttggggaaagaggtagaagcaaatgtttctcatgctctctgtttgactacccttaaaatcacagaaggaacattgcttagtcaccttcttttttcagtttgtatagcaatcgttatttttattatcaaagtggctcacttgggaatgctgatattttggatatctaatgcatttccattggaaaggagaatctggtcccttctcttaatggccctgcaaagaaattagtggatgcacaacagtttcctggactgtcagtaaacattaaagtcagcaaatactcaaaatcatgatttctagcaacttttagcttgattgacatctttgttgaaagttttttaaaatgtgatttttcttatacccattcttggtaggaatttactttggcattgaattaattgccccgcctttaattatttgaagacaggaaacattcagcaacttgcctggatatgtgtttcatatgcagaggtttgtattacctgtattttgcctgcttaataaatcacaatttaaaagtattggttctgacttttaaacctcctgt

SEQ ID NO: 96891 - DNA, 1023 bp, Homo sapiens
tattgcaatactcgctgtatggcagcggtctggaaccaaacctgcaatgtctctgagatatgcctgtgtttgcagaagaattgttgcagccacatgctacccacccctgattattgctcatcataataattactgtggcatgtgaaatattccattatgtccagccttttttaaagatttacaaatagcataggtgtgcaagatttggtaatggctctccctgatttgtagtggagtaaatgtctgagagtctctgttggccaaggccgggtatcttaaaggttgctgtggtattgacatcatatgcagagttctagataactcagtgtagcagtaacttattttaatggaaaaaccagtgacttgatattaaaagaaaaatctctactctttgcgtcttttacagacagcccttccttcattcctaaaccaattcttgattcagtaaatttttaacttgtttccaagtgcagtaaaacatatgactttaatagaaatgtgaaattaaatctagcttatgatatgatagcctgttactatttaaaatgaaatatttttgaaatgtaatctgtttcctcatttataatattcaatacatatttattttctgtccctatgttttattttctctgtaagttttccttgtgcttttgaacacagcacagatcttaaaaggtgaaacagtaaagcaagacaggtcagcagagagacaggatagtattatcatcaatgtggtgtactgggagaagccagaagaaagctaaccttgatgtgaaggaattggggtagctttcaggaaggagatgacatctcagtcttaaaggacaacaaaaatttcatgaagggtgaaagcaatagtatcctccaggcatcaagaagtgcccaagaggtgtgagaacccttggatgtttaaaaaggcacagaaagggcttcttggtgcagagctggcactcggcagttgttagttacccggggttcccatgacggggtgtcagtgggtgtaaaggaatatgaggctggagg

SEQ ID NO: 96892 - DNA, 1009 bp, Homo sapiens
aacaggaaaaattaggctagagaaggctgagagactactaggctcttttgggatgagtgggcacttagcatgcttatccagccaccaggtcccctaattagattgaatgtgtgtaaatagttgcaagcttcatccatagagggtcttttcacgttccaaggcagcttccgggttttgagaggcaaaatgtagaaggactaccagtgatgaaaatggaactggctaaaatattgtccctttttgtccctttgtaagctttttaaaaatttgtttatcatttgtgctgccaagacacctaatctaacgcaaagtgtaattgctgtaaatttatcagagttctgaagctgtaattaaaggcttgtcagtatttgcattttaatctatgaatgagggtttaatttttcactgttttaagtcacgtcatcctaaaatgttgactctaatgtttagcagtaatatgctgaagctttcagaagttgtttgtagaatttattctttaatgaaaagatttttataaagtagaatttttaaaactgatttttttaagagctaatctttgtttttttaatacttaacagactgtgtgttaattaagtcaacttaaaggcaccttttactttcttaaaaaacattaaaggcaccttttactttcttaaaaaacatatctgccaatggtattaagtatcaaatttcagagaagctggaatttggtaattagtcagcaaaaatgatgggcacagaaaatgaaagaatacaaatagagcattcaggacatagaaagtgttttggggtcccacgtagagtactgtttgaaggctctgctctggctttgttttctagcagacctgcgttcaaattctagccctgccaccttctaaatgtgtggccctggcacatggcctaaccttttttgagactcggtttcctaatctgcacaatgggagaacaataacctacctgcctgtctgattgaattaagtatggtaatgtatgtaaagtactcagcaga

SEQ ID NO: 96893 - DNA, 1922 bp, Homo sapiens
ttcatttaatttgctttgtgatggaagttcttctaaaggtaggatgatgttttaatttgagcaatttttatgtaactggagcaactactgggttgcggggaagagcagagtggctgccaccgttccctgccacgagggtgtgggtggacttccccagcttcctggccgcagtggagaaaaggaagcttgtctattccttcctaaattgttttccatactagaagttatcatgcttggttccgatctttaccagaaacaaaacaacaacaacaacaaaccaccatttctcttaatgcattctttttgctctgctctaagatttaaactgttagatccgaagacttgaattttaggaatatgtgaagttgtctttttaaagaaatataaattttaaaactgtttgtgtatcctcttcctgcattttttcttttttagcaaaatgatttgatatcgtacggggcgctctgaagtttccatgctactgcttttttctgtttacttcgctttgaggtcctggcgtagctgcaggccacacctagaatgctgttcctgtctgccctgtcctctgggcaggggtccaccatagtgtttctccatgtttgggctctagtctgtttttccctttcctgttctggaaagcccactggtggctttggcttaggtgggggtgggcagagagctgctccccgtcactagtcattgagtgtgaggctcctgaagccagtttccacttaggcatcattttcttcataaatgtgtttctctgtggtgagtgaggagagatggtgtcattttcttattttgtgcatttagaaaggctgagatttacaaaactcattttgggtactcgtcactaattagtttaatctgggataacaatggaaaatgaaagattgcatgtttgatcatgcacagcaaagaaaaaagatttataatgaaactaaatatcatgaaagaagagaaggatcagaaaactcaagtgtaggaactgagttctgtgttgcccactgatctccacacccagcccccaaacacacagaggtcctgggtctctgttctagaggccagaactttatgttgtccgaggttctttggaaaagaaattttctttgacattttcaataactagcaatgtgcacattttggtaaaagagatgaaatgatgctttatgattagctttagcaacagaaaagtaaaaaggtgcagagaaagactaatatcttcactttttttcttgttgagcaataacttcctactccaaatagaatattgtgaaataattttaaaacgaaaagaaaaaatgttgcatccgatttctgtaaacattgaaagcatttcccagatcctgcttaccacagaatgacgttctacttcaatttatctgcttcagaagagatgaagagaggaatgaggcttgccagcatttggtttggttagctcccagggcacctatgtattcccaggttgataccatcaccactaaagtgattagacaatagtgcatgggctgactccataaaacagaggaaagtctcagggctgttgttagcagtagatactcagtccaaatatgcagtatcattaaatagaaatttcacctgaaataaactttgtccctgtaaaaatgggaaaatgcttaggtcaaattagaaacagcccttcagagtataatggtgggctgctggaagcaaggttcacattaacttttttttttttttttaagacaggttcttcctctattgccccccaagctggggtgcaatggtgcacactctgatcactgcaacctctgccaactgggctcaagtgatcctctggccacagccaccagagtagctgggactacaggcatgcaccaccatgcccagctgatttttgtgtttttgtagagatagggttttgccatgttgcccatgctggt

SEQ ID NO: 96894 - DNA, 1075 bp, Homo sapiens
tgtatttcatgcatattttgcagggcacagcattttctggtatttttctcaggctttctttaaaaattgtgtttcctcatcacatttaaaacatggatttgctcatatcaaatttttccagaacacatccagggtgtgaagttaggtatacttatcggtcattatctcagcaagaattgtcagtgtgtgacagtgctctgtgtcagggatgcgcctagaggtgctccaccctttctgattaaaatgaggtcgttgggttgaccaggacagctgttttctgaaatttttgccacaaacaatcacgtcaactaaagtaaggatggagacagtttgtgagatgagcacatgtggaaattactctatgcctgaataggaacagaaagatctggcctgtcactgtgtgggtgtatgctgtggaaggcctccccccagggggattcatcccagcaatttgtttatcccaataaagtttgtagacctgttaacctaggaactccctacatgtcaattagaggagccatgaaaacctctcgcatcgcagggagggttggttagaagtgtcagttcagggaaccggaaattgcttggctcagctgacacaaaagaggatctgaagggtgcgggcagagagcaggcagttttagaaccaggagacgccttttcctgctggggagtgacaagtcaagtgtcatttggaagagttgaaaggtggactctgtgtggagcaagggacaagatggggctgctttgggagtgacacggacccagagctagagtgcccagaagattccgattagctgtggaatcccgtggagtagcccttccagcttagcaggggcactgggtctctgaatttcaaagacttgctgtcttggttttacccctcaccgtaccacctgcatcagaaactcttggggtgctcattaaaaatgtaaaccattgggtccctctgtcgccggcaaaaacaatgtggggggcattttaggctatctgggttacctggaatctcactgaaggctaaggaccactgggtgaattattcctcaaagagcggttgctctgtgtgtttgaacct

SEQ ID NO: 96895 - DNA, 1046 bp, Homo sapiens
tgaatacatatgattgtcttcattgcaaacttgctttttggctcttagcttcttttttttttttcctcatatatatgtttgtatttttcattttgtttctttcgttttttaaatttaatttaatttaatttccagttccgagatacatgtgcaagcttttccctttttgaaagggccgtgcagtgggaggtgtggcttctttagaggtttctttaatgtataatggaagagtaaggatttctgtaagaagtacaaggtacagataatgtcagcattgtagaagcagctgttagtgtataacccaggggagttttcagtgtgtctggggagttttaggtgtgcactgcagaggctgcaaagctccagagcaagatggggaggagcagggagtgctgaagagagggaaggggaagtaggggctaagagagaagaaagcactcttaccttgtttgtttcttactttgctagttgatgtatcactttgcaaaattggttccagtctcattgttttggtgctgtgtaggttgggagcaaatatgtagcctcattgttttgaattgtcttagattcttaaatctccccctttttttcttagttatcggtcctatcgtccagcattttctttctctgttctaagacaaaatctctttgtctctctcctctttggagaactgcctataaatcctttttggaagaccatttgtgatcaacccaaccctgccaattcagatattctagaaagtactttggctctattttgtattctcagttttatatgttaaatgtatcagaccaattctaagacagtgaatagttcttttgtttaaactgaaagtttaagaggggctcagaaacattgagttataattaattgagttgtaggtgtaagtgatttaaaaaaaaaaaaagcatacaggaatctttgcgaagtaaactggtggcatgcaggagataatactggtgcacattaggggagaaactgggcagggaaaccagctagctagttgttaaaactgctgagagctagtgaggacccaaaagaagtc

SEQ ID NO: 96896 - DNA, 1029 bp, Homo sapiens
ctagattacttataatacctgatactatgtagatgctatgtaaataattgttatactgtattattttcaaattgttttattgctatttttattgcttttccctgaaatatttttaatccacagtaggcggatgcagaacctctttatacggagggtcgactgtgtaggagtgagctagtttcagttaaagcagcggtggttggtactcatctctcacctgcccccacgtagtgtagctagggcatcagggagtactgatctctggcatcatctgggatcaacaggattttcctgcctcacaggcctgtgagcacattagaaatacacctgctcagctcaagtcaaagtgagaagcttttgaatggagtgataaccgagtaggcagtatctaaataaagatgattggttcaagtctcagtggacaaatgtgtacgttctattactgttgactgtgactttgaagtatatggtgttcattaagcaaatccaatctgatcgtatgaaaagagcaccccaaaaaccaaaatgaaaccatttatcaggacttttgtagctatgaaaatattttagtgtgttttgaaacaaaaaaagtgatttatactcaaaggcttttagatatagaaaattggtattttcatttttcctttgtgttgtttcttgaattcttttattagctactcctcttcctgtttccttccattttggaactgctttcttgaggtagctaagttacaaaccaaccatactttggtttctgcacatcgtggcatgtaggaaggccttttttgctaagcagtatgttgtcctagtggtttccagtagggttttggaggtaggggagtgaatgcaaaatttttctgcatgtgtgtatgtgtgtgtttatatctgtgtgtgtttaatggtcttgccctccaatagttgtacttgttaaatgttgctaacttttgatgagggaagtacttatcttcccagtttaagtagatttacatagtttactgccttcttcaagattaactgggtgtagctgca

SEQ ID NO: 96897 - DNA, 1030 bp, Homo sapiens
gatgtggaagtccatggaacttttacctgggttaagaagttctttcctttaattaattaaataaataaaatctgcatttatgactcggctgaaggatatgctaagatagtcaagattcagaagcaggcatctcgaagtcatttcatgtggcttcatttaaaagaaatgctctcggatccagtacacttacatcaacttcataaatgcagccaatttacaataaacattccccttgcaacccctcctcccccacccacctcactctacctgaaaagatggctaattatgttagggccttgtgtattcatttatttgttgtcaaaacccggcggggtgttagctctgaaatggggaaaaggctctgagggcgaggcctttggctgtgaggggctggaggttttgtgtgtgaaggggggtagcctgctggtctggagcacgctgataagatgctcttcttttcacagggctctccttagattcaaagactaaaagggctgactgaatcagaaaaacaaacagactttcttttttctataggcaaagaaagaaatgaatgtgtaggcattatacagacacaagaccccgggtaccagtggtatttgagtcaaaggtttcttttgttagtatttagccattcactgggaaagcacacttccagcgcggggacctggttaccatgagtgactttgtgatctcatcctggcttagcctaaatgggaagtctaattaatgctttttataagattttgtgatgttaagcttcaaccttgcagttcatattagtttgttcattttgatgaaagaattggcagattttaggtatatgatgcagtttgattttagtctagaaatacataatcagctgttagagctgatctcagctaatttgccagaaaaaaaaaaaatggaatgtaaggaatactttacagtcacctttggaaaaaacaccgtaatggtttggaatcacacttgcattatacatacatagtagtagtagctaactttcattgagtacttcactacctgctga

SEQ ID NO: 96898 - DNA, 1083 bp, Homo sapiens
tctattcttatctcttggacatcttctctgcccccattttttttccttctttcaaagcttagcttcgccaccatactttctttgtagtaatttcattcaaagcttactcttttatgtggggctcggtaatatgtgtattagggtgttgggtcctctaggacgcctcaccttccccttttaggaagttcatcaattagcaatgatttcagcagtgattaccccaagtctgcattgtccctcatgctagccttctatctgtagttctgtttttctgatcatctgcacaatgcttctttctgagtatccttctaacaaaacatttatacagttgagcttcccacgcccatgttatatccaatattgatctctccctgctgtggactcccatagcacacgattgtctagaacacttgcctggcacttatcacttaatgtcttgcattattagtgtacagcaagcaatttgggcgctctatggtttacaagtactcacctaggaattgaagcatcatcatctataaggctttttttgagatgcggcgttacagagttttagagagcataagacttagtaaatcttttaaccctagccaggtctagattttaatcctagtttgctacttgcttactagctttgtggataggtcacccagccttaactttttttctttcatctgtacattgaggcttataacccttccaacctcaaaggttgttgtgaaagttaaatgagacgtgaaaggtttaaaaatgaaactttcattttaaaattgttgctttgggacaaatgtctttcaaattcaattctctaatttcaggtatatgagctcttttaagtggcagaaggcattattacctatgtgtgtcatctcctattttagattgcaggcttctgcatgtactggtggctgcatccttattattctagttggtatacacctcctggcttatgagagtgatctctgatactgctcacagtcttccaattcattcaaaaatggctcttctccaacacctaacttctttaaaggaaactggacaaaaacagatgaagaaaaacttcagtgcacctaggctcttgaa

SEQ ID NO: 96899 - DNA, 1033 bp, Homo sapiens
attctgctctgttctgggtagttgggcaggctatgtagtatatccgaattccaaaccattaagtgaaatgcttgttattagtgatacccaatcattgtttcatgacacaccagtgtgtcacaaagatttcctgcagtgttggcagtgagcctcacttttcccaaagctctggctccttctctgacacattgccaccaggtggcctgcgtgacctttactcccttttccccgcccaaacatcttacattccttataccttatatctggatttaagaaaagacttcttttggacaattgatttgcagttcctaatctgagttcttacacagttgccaagctattattgctgcaaggagttaaatcggttttcacacagttctaatagtttattgtcaaaatgtcatttatttgagttaagcattgccaatgcccccattaaaccactgtttcttttatttcctggagtttggaaggcattcgggaataccaagtgaaaaggaagagtgaagaacagaaaaatgttagtgggatggcaaacactgtgaacattgctgtttctagtgggccagaaaaatgtatgtataaatcttccctgttcttagaggcgctttcagattctcctccacaaagcttcctatggtcaccatttagagtcaatccccttttccctgttctccatggtatgttatttagttctcttcatattactggatcagagtctgctttaccacttggtcatttgtgcatgtctttttcttactgaaactgtcagattcttctttgtatcttcagaagtacatataatataatgtaacatatgcaagtttatatgtagacatacatttttaaattctttaaatataatagattcatgttcaataaatagtattgaatacctattctgtactatacaaaacactggtgataaaacaatgagcaaaacaggcacaaccccgtttctcaaagagcttttataatgaggcagaaaggatggacattaaataataatttagattgcagctttgtgagtcca

SEQ ID NO: 96900 - DNA, 1048 bp, Homo sapiens
ccacttgacacttaatacattttttttttttggagctgatggatatgcatttaatccagttaacatagccagatgggccttgcagtgatatcactgaacagtatctccaagagaatgtcagacctcagcaacaaggcagtggggtgaatgaaaaggcagatactatcttcctctgagatactgggagaagaaactttcccttaactcccttatttataaaaaccagatagcttagttgttcctctgaaactgtcagaatttctctcatcaccgcctctgaactgatggatggggattggtcttgcttactaaatgtgcattgtagcaagacacaactttatttaaaataccattaagatgcaagcacattgtggctactctgaaggccttcacttacaacatgaattattcaaatagcttcttaataactgtattgatttccacagttaaaagcagatcagattatggaatctgctcaataccacttaaatgtttatagatgttagagttgacaaagaccttttagacactgataattcctttcactgatcagaatgctagagatttggcattgctagtaatgctttgtgattatttttaataaatcaggaacactgtaacagcaatcatttaaggtcttcattcttattccattttagtcccagagtctttgcctgaaaatctagttatgctaaaaatctgaccagaaacttttacatttatattgatcagaagcttttatgtttcttttgcaaagatcaatgtagtaaacatgtcttaacctgcatgtattgatgtgaatattaaaaaatatctatgaatatttataatgataaaatccaataaggtttcagtttctcagttgcttttagtaccctgtgaaaaggtaaaagggggcaagtgtactagtatgagaagaaattataggtggagtaaaaattagatcttttattctttctgattctccccttatttggaagtctctgggaagggaaatttccagagtggattgattagtctgctcgggctgccataacaagataccata

SEQ ID NO: 96901 - DNA, 1024 bp, Homo sapiens
aatgcaatacttatattgtttgcaactgagcttaagcactcaccttatttggacttttatttaagcttgtataaaaaagggagattgtatttaattacaaagtgaattttatttgtttgaaaataacactagaaattaatacaaaatgcatttcctgatttcctctttcagacattttcaaaaaatagcacatgcaaagaggcaacaatattatcgattaaaatgaaacaaaacacaagctaacttttaagttcacatcatattttgttaaagttagttaggctaattttatagttatagctcggccagaatgttttatccttcggtgttgttagcaacagtaaaagggaatgacacacaactgaagcaattttttttgaggaaaatagaaatatttaagagattgatttatagttctatcactcagaaatacaaatatatatatttttaatgtaggtattgggtttttattgaagttttctttctctgcctgtttcccagaaatgtttggctttgtaattctgagaaatagtttacatcaacaccagaataaaatatagttatgtcaactgacacaaaaatgcctgactcaaaacgaggaggaagatttgggctcaatttaggtcactgaagccagtgacgccagctgtttttgcttctgttttctagtctgttgtctgaaatttggaaatttgttaagcatgtttctagagagaggatttaactgcttcatacaagtttacctgttatttagcaaaacataaataactgtcagcccgataaatagatttacagcaggatacttgaatgattgagtgctagtgtacctcaaaatatcaaaacagttcctaaaatgtaatttttcaatgagaaatgaaatgtttgcctccctctaaccctggcctgaaacttgtagtttagagcccttaatacaaacaactttttgtcctttactttctcttagagtataaatcctcttcacttcttctaatacctagtggacttctacttataatcagaatgt

SEQ ID NO: 96902 - DNA, 1091 bp, Homo sapiens
aaaggagagagaaaaaatcaacatctgaacctcctaggggagaaaagtgtataaaattaagcattgttattctctccccatgttgtctcttaactaattcttaaatggatgcattttagaagattgagaatatgttggacattgaatatgaaaacctagattctaaaagtgaggttggatgctgatatgaacagttagcttgcatgtagatctggcactgtaaacatgctaaatcaatgttggtgggtgatttcctacattcactataatatctgtgttttggattaggtaaagatttaagctggtagttgttgtaaaattgctgaggctcatgatgaaggactaaaacactagccaatcaattgtatttactgagtgaccccagtacatcattctttgcacttgacattgggaaagtttaaagagttgaatatctggtacctgctctccagcacctcacaagctaccagggaggacagaatagacacaaggcaagaaataagcacagaatatttacaaagtagtgcacccacgaaagcagcacaccagctgatgtcctgggttttagtgactgagaaggcactaagatatatgtaggattaaacactttgccatgtcttttgcaagaaagtgaaaagtgctaataaaagctacaataaatctgggaattttagaaagacataaggctttaaatgaataaatgaatttttttacttaccagcattgttttgcattttttctgctgtataaattcttttaagagtacttagaattttaaacgaataatttttttgtactttatgttaacttctccttaaagtttcatattcaattaatttatttcaccctattatttttctagttttatgcttacaaatgtgctgttaagccaacctattagaggtgtggcaggttggaaatgtactccttaaatgatggcatagtggttatacagaaatataactttgattgttttgagccatttggaatgatgtttatttctcctaactgattagctttgcttccggcaaaggggaggaaataagtttggggtttgtaatgctgctaattagatcattgcttgcctgcaa

SEQ ID NO: 96903 - DNA, 1019 bp, Homo sapiens
ttataaacataaccacatattgtcctaaataattttctcaattttaaaatgacctatgctgtattatattaaatttaatatccatcttttagctacacagaaaaaagatgttgataatctaacatattttaacttaaagatttgtatgtacacattttcaaccagtggctgcattaatttcacttattgtaaaagcaacccttgaattatggtctgtttatttcaaagatactacaacatacattattgccagtgcatgtatgtaaatagttatggggattgaaatattctgtttcttttgaagaaagggaagtacaaaattttctttccatgattagttagctacatattttgtaccaactgaaagcaatttgggacagttgtaatctttattcacatagttctaagaatatatttctataaaattaatggaaagcttgatttttttaagtttttgtgtatgaagaagtattgttttccatgctgaagaaatgtctatacgaaagatacgtttctttctaaaacaaaacaattttgtttttacgccatttttacatacgcttatgacacagaatatatctgaacctagcttcagaatctgaaaataataaatgatataatttattctattaataaaggctagtagaacaaagcagtttttctgcattgaacttttgcatgcattttttattgaattccttaactcttacttacttctagccaaatgaatattgtatcaatctgtttctccagaaattagtagtcctgatttgatacataaaactgttgcatctaatgaagtggaagtacacaggcataatattcagacatggggcgctttgtgtcataagaagtaaccacatttatgatgtaaataaagtttgcttaaaatatgtcagtttggtaatgcagtattttacactgatgaatcaaccttatttccttaagtgagtggggtattatgtatgactatctggaagtggtattgaaaggctgaaggacatgtaactattaaaatg

SEQ ID NO: 96904 - DNA, 1016 bp, Homo sapiens
acaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtgaaagtcttgccatatgtagctctattttattgtaatgttggcgtggtactgcattgtgtagatgtaccaaattatagttaactgtcacttactatgtcctgtccgtatatattgcccagtattcttcaaaattatctgtttctcattagactacagatttcattaatcctttgtgaaatatatggcaaatattttcaagaattatcaatgctttggtttaaaatgcccaggctttttatctcaggtaagaaggtagtccccactcaaaaattcttaaaatcttctcctatattgcctgttaattctctttttatgatttactcattaaaacatctgaaaatgatttttgtatgctaagataaggatttaatttttttctttgtttttatgactaggcagccattttttcctgaaatcatttgttgaaatcatttctctcccaactgactagaaatacctccttaatatagtaaattctcaagtgtacatgcatcttttctttagactcatctgttgctttgatctttttgtctcttcctttaaaaataccaatctgctttgatattacgttttctagtaattcataggacaagtccctcttcatttttccttttcaaaattttcttgaatataattgcattatctttgagataaaatttaacataaactgttcatgcttcattaaaatactctttttgggatttaaccattatattttcttatattttgtgactggtatgtagatgagtgtttatgtatctggccaactttctaaatttattaattttaataaattgtttcacttgaattttctaggaaaacaatcatctaattataattca

SEQ ID NO: 96905 - DNA, 1024 bp, Homo sapiens
ttctggcctccttcaaagaaataataagtgggcctgtcctcttttttggtttatatttggtaggaaaaacatgtacatcttgtgctataaggtggtacaataatgcgtattgcttttctctattgttttcttttcaaaaatgtagtttttttcggctttttttttttttttttttgggggtaaaacgattttggcctaattggccatccaaggatgtactagtatcaggagacattaaaaacaggacttcaagaatacaaacaatagtgaaggcatagttatcttcatttttttcctatagataattatgcaggtgatgctttcttcctctttattatgatgtcttttctagcactgttgtccaaaattagattcagtatcttccctctcctcctgaaaattttctttctgtcactttatgtctggctatcaccactttctactgggtgttttgaaaaccagtggctggtgaaccatctgcaacaaaatcacctgaggcgctttgctaactagaatgtagattctgaggtcccatttcaggccaactgatttgcagtcacaggtacctgaattgctgccctcttgtctattgtgcacatccagtcggccaccaaatcctgttgattctactcttgaaatgcctcttgaatccactcatctttatttcccctgctctagttcaagccctcatcttttacctagaatacagcattagttgcctgtggtatagcctcactttgtctccctcgctagtttgtagtccatgctgttatctgttctgtctaaaatatgtccatcatctccttgaaaatctctcattactccttgtgtcaacatgttaaagtctaaatttcttagagtgacattcgaggtctactatagtctagccataactgagtctgctgcatgtggtttatgcagccagtgtactctacagctctataggatgccattccaatcatggtctttatgtatggtcttccctagaatttttgtagtacagcacagtcatacatgctgaccc

SEQ ID NO: 96906 - DNA, 1095 bp, Homo sapiens
tagcttcttccttaaatacaggagctacacaatttccttctcctttctaattgataaatctataaaactagctgtcattcataactccctccattcttcagaaatcattgttattctttgtgagtctcctcttggtttacaaaagaatactccattatggaatacctatgaatacttatggactgtaagtcttcattaggggtggataggaggaaagagcgcacagtatgagagagggctttctaagattattgaaatgaagtttagaatttgaatttattttttttttcagttcaggtttaagacataactacttttgtagaaagcaaaaaactcaacgttcttcttaggttcattaagaaaccgtgacaattctatatttcttctagaggagtattaagatatcttttggataagacagaaacaggaattcctgttaactcctatattttttgcactagccattggtaagcaattgggagtttaaccccttatctgctgtggaagaagcctttgctcacattagcatatattccaaagaaggaaaaaggaaaatttttttacatttagttttcaaagctaatatttgttaagtactcaagaatggatgaagaaaaaatgtataatatatattcttgtatgttaaaatcaaaatattctggtagatttatttaagaaacatttattgagtacctcctaagtactgggcccttcatgaagttttgagaatactgaaataaataaaatatcatttatatcattaaggaactttaaaaagttcaaataaatcataaataaaatagatattttactatatagtagaataaaaaaagtagttattactatagtgtattttgtactataatagagatcagtataggataatacatgagcacagagaagagacacttggtctatgagaatcagttaataagctcaatgtgagtcgatacttgagctaaggttaggaagaagcaggaggagcactatatattaaaaaaaactcagaagtgagagagtatatgatacatttcatgtaccacaaggaatcatatagcttcaaagagaatgatgggacattccaggaaaagaacc

SEQ ID NO: 96907 - DNA, 1044 bp, Homo sapiens
gatcttggctcactgcaagctccgcctcccgggttcacatcattctcctgcctcagcctcccaagtagctgggactacaggtgcctgccaccacgcctggctaattttttgtatttttagtggagatggggtttcactgtgttaaccaggatggtctcaatctcctgacctcgtgatccacctacctcagcctcccaagctttaatttcttaagctaatttatatttgctaatctatgaacagctatgtaatttattaaaatttttaagtttattggtctctgaaaataatagagcttcactaattttgaactttaagaatcagtttaaagtgaaatatctagtatctactgaagatcattctgagattattagaacttcattttcattttatatttcaaggaatttgcaacttagtcattatttatttatccctccagggatagaaattggttaaaaaaagagttctctgctattgtttggtgatacgcttttaagactgtactaatttggtaattgtgatacaacagtttcaaatttgcttgaatgtttgcagcatctgtattcctcagtacaaacttgtgtcttttttcattgctttattctcacagtcactgcaataacatagcaaaattaatggattaacaatataagggaaactggcatttaagacaccaaaggtcaactatattctcttaatttcttaaaacttagtggagaagtttctggtcagtataattttataatttgcatttgtccctttgatttgtatcaacacttccttagtgtttgtgtactctaaaaataaatttagaagtgtgtttatttgaaagacacaaaatcttaattttttaagttagtatgtatttttaaagaatcactttaatatagcatctgttgtatcatttgtgcttttttttttccattaaggaataaatgctaaattacagttttgatccttactgaaggatcaggaaatcatagattgaatccttgactgaaatgtctttaaataagttaatctttaaaacttctgcggtgcttt

SEQ ID NO: 96908 - DNA, 1032 bp, Homo sapiens
agctattttggagaactatacaaagttcattatagccagagtatggagtgaaagatgagcatggagagatgaccaggggccagtcatgaacagtctaataagccttttctgagatctgaggggcttgtagagccatcaaaagattttattaggaaggtaacttggtcagattagtattttagaaaaactactctgagaatgaagggatggaggggaagttgcagtgaagagaacagattggatatgagacaaattcagaggcaaggaagcagtttaaaggctgttataataatccaataagaaaggatggtatgaagagaggtataaagagaggcagtaggtatataacaaaatgaaccaaagaagttggttgcattttactacacatacccaaacagaaaaaaatatattggaatgtgctgtggcaaaagacagagaggtgtcatgagactgccaagaccaaaggaatataaaggaactgacatttgttaagtgcctactaacctgtacagatactttgtataccttgtgttctgtataccctgtctacctagatttgcatcattggtaatgtctccatttgtgaatgttcaacagtgctgatgacaatccttaaaatacatacattaccaacttcagtgccttctttaagggacattgtggagcttaatttggctttttctagtgtctcagaatcatcaacatggagagtactttgatgattgtttttttgtattgagcactcattggccctatactagactgtagtgttttctaagttcttatatcagcttctttgtctttcttatctcttcctatgcttttagctcttgttgatatctatgtctgcctttagcaactcatactcccttttaatttgctgtttcaaaccagctatgagctgtggaaataccaccaagtttgttagaataaatctaaaatgacaataggaacaaaattcatctatctatgaaccttgtggctctaattctggctcctcagaagctctgttttctttctagcttttgactg

SEQ ID NO: 96909 - DNA, 1147 bp, Homo sapiens
ttcaagatctttcataagtaaataattgcatcttacatttctatttatcaaaataagtgaactatctttcagtgaatacttctactacatcttcagttatatagtacacagatctgtagggtttagtttggttttggttgctaatctggaaatgaacatgtagcctagtatattttttaaatagtctctgcatgtgtatgatatcaaatattttatttaatgtttctaaagctcacagactaatatcccccaaaccactcctgccctcccttttagattcaaattctatcacagaatgattcttttagttaaaaaaaagtttaatgtctgaaagcaaatgaaaactatataatttttacaaaaaacagaagcttatgaaaatacagattgatgtaaatgtctatgtaacttgcaaacatttgtctgatttctctttgccttgagatatttaatttttttaaaaaagttattaatacccttttgctttaagtacacatataggttatagacttaaatcagcacgcaaagaaggcagttgtcaagctgtggtatattttagtagtgggaagaactaggcatggctgacaataagttttaattataacctcacttatgttcttgttcattgtactttatttcacatcatagtctcagttatagttgctactaaatgaaacaaattaaacaatttcatttattgcaagtagaattcctgtggagctgtgaagtgcatcagttctaatgcttgttacttttttctctattatatgtcttgcttgttcttttactagtctgtgcattcatgtttcagtagatggcaccctgcattgtacatttgctttctatactacagcaagggaaacagctggtatgtgattacaacttgatggaaaagtattcagcttaaaaaattcaggagaattagtgttgagttgtcacaagacatggggcataaggttagataattgatattttggcagaaaaagcaaagaaattagtttgttttgaagaccatgttacagtttaggatggaaagaatatttcttaaaatgagttttttaaaaaaaaccttttaagctattttattagtattaataaagctagtattatgcaagctagtataagtacaaagctagtataagtacaa

SEQ ID NO: 96910 - DNA, 1028 bp, Homo sapiens
aaaataaaaacttcccagcgtgtaccagccagaatataccactgtacctatctggtgaaaggggattctttttttcccctgtccttttctagatgggaagactttctctcaacacagttgacatctactagcttgctgacaaccagaggaaactccgtgtcccagaaggtgactcaaattaaagtgtaccattgaccttcctccccagcccatcctttccccgcccccaccacttttagcaggactagcaaactcggttttcttctggattccagcggcaccctaagctccacgtggtgagggacatagaccctttggggccacaggaaaggcagcctggagagcagccccctgccctgctctacagagggagcgcgggtcaccgctctaaaggtggagtgggcacccgccaggtctctccctctgtctcatgactgagtcgtgcagggtctggcttttggcatctgctaagcgtggccgggtaagaacagctcccaggtaaaaaagctgcacacgcgaaacgccgagtctgaaaaaaccacccccgccgaggcgaggcagttgtgagcgggatgcctgagaagtgggaggtgaatgtcctcgggagggcccccccggtgcagctttccccggaggctgaggctgctgccagcggggacatctgctttcttacactccagcctggctcaccccgccccctcagccccgggttgcgtggttattttaccaacacggggggagggagagctcgaggaggtagaaaaggggtggatagaagcttagaagattttcttcccactccccccacgtcccctcctttcgtcacatcttttaaccttcaaggtaaagacttaaggaaacaataagcgtgtccgctggctcgcaggcccgccggggttctcgggcgcggggccttgcccctctccatcctccctgagtccttccccgagtcgggccgtgcttcggcggttcggctgggcgcaggggccggccgggcgcgcccagcctgtggcgcctcctctcccggg

SEQ ID NO: 96911 - DNA, 1948 bp, Homo sapiens
cggaagccgaagcaaactagtgaacccggaagtgcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggtaagacccagaaggcaggcctgggaggtctggggaggcagccgtgctaggccgccgccagccccgtgctttcctgagtcacgttgcccagctgagttgccacaggaggcctgggccgcgagggaggagcccggcctccttcattctcttcgcctgctctcagggctctctggcagggtcaggtctggatgtcgcctcctttctccattcttttctgtttggccgaattcacatcatgggaacctcttccatctatatagagagaatccttgtttatggcctgtttgtctgtgctctatccatagttgttaaccggtctgctttgaagtttttcaaagcagaccgggaaaacaagggagagagagtagaattaactttcccattgaatacgtttgttttatctcttgtccttcctgtaagccttaaccctttttctgttagtgttaggttttcagctccctccaaaaagtaaacaaaagtcctgcagatacactgcttttggaccttgaatatcttaaaaacaaagtgtgctactatggctgttaacttactttcaatatcatactaattgagtaattgttggtaaattgattacatttctcgttttaagtaaagtagaaatctgctaccgtatgttacatcttgcaacttaattttcctggggatgtagctctgtgtctgtcaaaagaaaaagaatgtaaacttttgagtctataaacctagtgactgaaggaaaaattctcgagaaaataaatggtaatataagttgataaaatattatggaaaggcaggggaaagggtttaaaaatgagcataaaatagagttatagtgtgaaagtgattttgttccactggtcacaagtgtttttttagtgcttctgacttaatgtgtttgagaaaagcagcaagacatgcactgatactgtagaaataacaaaaacatgaacacagttttagtggagatgattaatataatggtggccttcctgtcacgtaaggctacctaccagctgactcatttgaagtttagaggttaagatatatagtggttctgaattaactacagttaaggtgtgtttagtgaagtgctatttagtgaaaaaggctaaatgttgtcttgaatttgtccctaaatcttgccaagggaagaaagttttcaagtgatgatcttttattgatgcttcacctgttgactttgggagtttttggttttttgtttttttttcagcctaaagtgcttggtaaataatacattgccattttaatttaggccgggtgcggtggctcacacctgtaatcccagcactttgggaggctgaggtgggcagatcatgagatgatccagcctggccaagactagcctggctaacatagtgaaaacccgtctctactaaaagtataaaaaaatcagccgggcatggtggcacgtgcctgtattcccagctacctcaggaggctggaggtggaacctgggaggtggaggttgcagtgagccaagatcgcgcaactgcactccagcttgggcaacagagtgagactttgtctcaaaaaaaagagaaaaagctgaattttaatctgtttgacatgggttcatcttattttcatactggccatgtaaaccatgtgcttgttaatatatagtttgtgaaccatatgtatgaaagtcaataaatattattgctgttgttattgttattatcttagaagtggaagagattaatctagtcctcttatttcag

SEQ ID NO: 96912 - DNA, 1062 bp, Homo sapiens
ttctaaatattattgtatgtatgacattatgttaggtataaacactttattcatattgtctgataatattttccataaagttaattatatcatgaatgagcttttgagtcttctactttttgatagctgtaaaaacttggtttagatccatcgacctttttattgcttttatttctaagaattgaaagtgttcccttttatgttaagtataacacattcactttgtgagtctttctgctaaattctgcgaaatgcaagtccctatctccagtgtgatttagtaatgtgaaatatgcccagcattttgaaacccagtaagtggcaaactatgtgaggaagaaggatctgtgttggtagccatgctcaggatggggttgccaatgacagtagctagtgtttattatatgcttactatatgataagcattgtgttaaatgtttttttttgtgtccattgtttttgttaatctaaacggctctgtgagatagatctccattttgcagatgaggaaactgaggaggagagaggtaatttactcaaggacagggaacttgtaagtgtcagagccagtatttgaatctggcactctgactgtagagtcatagtacttgactctcatgtaccaggcaaaatagtcattagtcatcgccatttaccatctaggtccagtagaccataaaaggatagtgaaaaaacaactgtattagaaatgttagtaaagcttaaacatagcaaatacaaatttttattttaattaattaattaatttatttatttttgagatggagtcttgctgtgtcgcccaggctggagtgcagtggtaccaccttggctcactgcaacctccacctcctgggttcaagtggtcctcctacctcagcctccccagtagctgggattacaggcgtatgccactatgtctggctaatttttgtatttttagtagagacagggttttgccatgttggccaggctggtctcgagcttctgacctcaagtgatctgcctgcgttggcctcccaaattgctgggattacaggcatgagccaccacgcccagcct

SEQ ID NO: 96913 - DNA, 1037 bp, Homo sapiens
tctattaaggggaaattcacataatataaaactaaccattttaaagtgaacagtttagtatcattttgtccattcgcagtgtgccattaccacctcagtttagttccagaacatttctgtcattccaaggtaaaaaaatatcttagcaatttagcactttctccattttcctcccttccccacccactgataaccaccagtctgcattctgtctctatggatttattggatatttcatatacatggaatcacataacatgtgagcttttgtgcctggcttcttttacatagtgtgatgttttgaggttcagctaacttgtaacatgtaccagtaagtagtacttcattcctttttatagctgaacagtatttcatattacaatattcctatatgtgtttatagtagaatttgtttatccattcattttttggtggacatttggactgtttccaccttttggctattgtgaatagtgatggtgtaaacatgcatgtacatgaacttattttgagtatttgttttcagttttatggggcatataccaatgagtggagttgctggatcgagtggtaattctatgtttaactttttgaggaactgccaaactgttcccagcactcattggttcttaagtttgagaaaattaatctagggtattatcatctcaagatacatagtctgaaattttgtttatatcagtggttctcaattgagagtgatttttgagacaatcaagaatggcttcaaacatttatcccccggggacgtttggtaaagcttggagacatttttgattgtcacagctggataggtgctgctgttgtctagtggagctagggatgatgttaaacatcctatgatgcgcaagacagccccacgaacaacaaaaaattatctggtcctgaatatcagtagtactgaagttagtaaatcctggctaattttattgtcatcattagagactagagtgctataatctgtctccttcccattcatctttgattttgtagtaatgtgaaacattttctttgttgct

SEQ ID NO: 96914 - DNA, 1632 bp, Homo sapiens
aaatatacaggattccccccgccccgtttttagcctttaaaaagtgctgtgtgttgaatgccatatttgatttgaggaatttcaatgagtatttgatggagattttatttgtaaatgttgctattaggaggatgagttaagatcgtgaagtggaaattttgtctgtattaccacgttttcttatatgccttttcattttaaaaaaggaatttttaaaattgtgagtcttataaacatgttacatgaaacaagccagatacgaaaaatatatgattccgtttatgtaaaattcaaaagcagccaaactaatctgtgctgttgaaagttgaattttacctttgcagggtggaatagactggaagcggggcttgggtggcgtttctgaggtgccaataatgttctgtttcttgaactaggtgatggttacatggatgtgttcacttttgaagattccatggccatatcgtttgttttcttttctgtatgtgcacttgagtgaagttcttttctgtatgtggacttgaataaagtttgcgatattaacattgttaaattgttaccaggattcaacaaaggtgattggtgggggataatatataagtacattattgagttttagtttatatagcaatttgaactcgtaaaacaacatggacgaaggatgaaatgaatcttagcatttaatttagaatataatttgtaataataccattttcttaagcatacacttaggaagaagaggaatttcatttaggacatagcgattttcaagtagaaaaaattgctttgttgtcatttttaaattacttagttgtactgttattaacttttaaaatttgattacttctttttgttatttaaggccatataagtacacttgatatttcttaacttcttctgtgaggttttcaagcttgtaagagtatcttctgtagttactctaaacgttaaaactaaatcagattgatatagtaaatccactttgtattggttaactctgaagttataattgagaagcacagttgaatttccttagtgaaaaaggtgtatatatctctacaacatctgaaacaacacaaaatatctgtgtaggttctagaacactatcttaatatgtttaatgtttatgctatagtatttcttttagtataatgagttcagtttttaaaagcctttgatgctaattcagagatccataatctgctcacaatgtctttcacatgtagttttgatggtaactgacaagctgtaagttaattagcacagaacttactaatgaggatgttaaaatttaatttaaaagtgaggatttttatttgtacactctggaccaattgaaggaaattcaatcatacatatgataagcatttcaggcactttttctacattcaggtactttattagataacaataagaaaatataattaacttaatgatagcaaagttttgaaagtatgctaagattgcttgtctttaaaactggggataacccaaaaccaaagcagtaaaataaggtctgttaattagcatggaagacagcttcttgaattaatatgtggtgttaattaacaggaagtctgatgttgtgttgtaattaccaccaatatttttgacatactgagtgactgaagg

SEQ ID NO: 96915 - DNA, 1009 bp, Homo sapiens
ttcatctttcttcaaagtaatctgtgtttactataagaagcagtttttgtttcagacttcatgaaattttcagtgttttagaagaactttcataagaactgtttgattaggtctatcatggtttatgacttttataaagttgaaatctttttgtgattctgtattgcattcttggatggatttcagttgtttttcgtttacttttgttagttttgatgatttctcatgtttctttgttgtcagcctatttcttcatgattcttcatttttataacacctgtataactcattctctcaagaggcctaagcctctttgaacttgatcctgaacctgtttccattcttttgtaaacattctagagagcttctagaatttctctaatttattctgaaattagtagtaatagtgttcaggcatgtgaaaatgtgagaagtgagcagaggtggtatgtagatagtgcagatttacctgcaaattataggtgaagatgttgccttagaattcttaaggaaagttgtatcaaatttaaatataaaaataactttccttaagcatagatacaataaattacccatcttggaaatccatgctggaaaacccctggacatgaaataatggttttactgaccacaaattgagctacattatatgtcaatggcgacttcaaagctttatatcaagtgaaaaacttaatgttttttcagtaaccttattggtttctgattaatcagccattgtgtccttagtttgtactcttttttgaagttaaaaatctgcttaagaatcatttcatctcaattagatgataaactctaatttgtggaactcttatttttatggtatctcccttatcctatactaggtgtaattttctttttctctaaaattttattttatcttgttataggaataatttgacaaatacttatgatgttacttttgtaacatgaaacgttaagtgtatttttttgcctaataagaatgttgtttattatttatttatttatt

SEQ ID NO: 96916 - DNA, 1072 bp, Homo sapiens
tttccaagagacatgaccccaccttgagtcccagtgcctttaatataacccagtagtagtaaaaaggtctttgggctttgctctatatgctaattggtcatgttattgttattattattattttgagtcagagacttgctttgttgcccagtctggagtacagtggtatgatctcagctcactgcagtctcgccctcctggattcaagtgattctcctgcctcagcctcgcaagtagctgggattacaggcatgagcctccacgcccagctaatttttttatttttagtagaggtggggtttcaccaagttggccgggctggtcttgaactcctgacctcaagtgatctgcccactgcagcctcccaaagtgcttggattacagatgtgaaccattgcgcccggcctggtcatgtttttttaatggaggaattcacagtaataatataggaatatcagtattataatcacagttgatactgatatttcattgtttttgaggccacttggtcttagttgttttatttgggagttgtagtagggctagtaggtaaaaaaggaacttgtaaataatcaaagtccccattcattctagtttcttaattttctctaaataggaggtgacttttctcttttccaaggctattccttccttgttcttggatctcgttctcttgacacactgcagatctccattgacccctttctctgcctacaaagatgtttaagtctcctgtatccaaaaaccaaaactctactgcatactgccattaaaccttttcttctatttatttctagaattcctgaaataatagcttaaactccataatctacttaattacctctgttcactcacatgagaatgcattctggccaactcctgtattactgtactggaattttttaaactgccaagtctattggcctatttttagttctcttttaactaaacttcaatattccacacttactatcttaaacctttcttttccattagtttttatcatgctgtcttttcctgtttctcattacggtgtccattcctacaaaacaactaagttttatttttttta

SEQ ID NO: 96917 - DNA, 1087 bp, Homo sapiens
ttgggaagttctctaattatcagattcatttaaaacccaagcaggtaggactgattctcttacaacacagactcaaggtggttctctgtgggatgttgtctgggttgagtgccctgaaagtatgccaccagagcagggcagtggtctccactgggcagcctctcagtgctgctttttaagctgttgcccgtgattgcacaggctcttcccttcagcagactgaatgcctgtgaagggcataatggcttagggacaatagagtaaataataaaaataataaaaattatgatagttgtacttttctcttactcattgtacattttcccctctttttactcagttacattcttacctgcctgtggtaattttctattccctagtgttgtaaacggagcctgagttattagaaggaaaatgcttatcaaaagtagacagtagaatgacaaaacctagtttttgaaaagttcaccattctgttttatagaaaaggaaaactttcacttcataggaaacaacatatttcactacctagtagaatacatttttgttgtcattgtatagctatatcactatagggagatgattttgattttgctttaatttgtacctggtttcacggtttctggttatttctctcccatttgtgatttctggttattgtattcatttcctgatttctactgtatagactagatgatgtctttggaattttttttttttttttatttttaagacggagtctcactctgttgctcgggctagagtgcggtggtgcgatctcggctcagtgcaacctccgcctcccaggttcaagcggttctcctgcctcagcctcctgagtagctgggactacaggcacatgccaccagggctaattttttgtatttttagtagagacggggtttcaccatgctgaccaggctggtctcgaactcctgacctggtgatctgcctgcctcggcctaccaaagtgctgggattacaggcgtgagccaccgcgcctggcctctttggatattttatagctcagccattctataaggcttttgccttgggagctttcaacttgaaatggtatgaaaattgt

SEQ ID NO: 96918 - DNA, 1732 bp, Homo sapiens
agaggttacaaatagtacaacttttaaaagaaggtttacatttcttacttttttacgtctttaaaacgttttccttacagtccagaaactgattagtgcttctaattgccaaaatatgttgttttatttaaaaaaattattttgggaaaaaggcttctcttgttaagctaatttcaatgaccaatcttgttgtaccttgacttgtaataatgaaaaaagaggtacagagagctgttttatttgaataatagacttgccaattagccatcaagtgcttccatctgtgaaattgttgatcagatgggttagctgggatgtttccagactagggcatcataaatggcacttgaaaactctcactttaatgatgaggtttcaagtattacactgcttaatgctgtggaacctttttctccttttgcagtaccatgtttttttagaacatactgatcccatttatgaattctgtggcatcaagagaatttgggagacctgccactgatgaaaagttctgcctaatctgctgctctggcctgtgctgggattacaccagagtgctaacagcttctttcatagcctttccagtaattttggttggggatctgactggcacaggcaggtgatgctcattgcttatgggccatggagctggcacactttggcaagtttctttgcactttcccattaatgtaaactcattttcaaatatctcacccccttaaataagtgtataagagcatagtagcctaaggccacattagtgttgagatttctacgtgtaccccttgtgtgaaatgactttagcatctgtcttgtacatttttgaaggatttaaattgcttattggtaattattacattttaaaatttgtttaataatagcatagaaatataaatttctggaaataattgttgtatgtctttccttactgttccatatcttcattgctcatccttatattttataggaagtttccttttttagtaagttgacttcctcaaatgcctgtgcatgtgattagatgttagagtctctgagtgacattttcccttggtaggactgtactgtgcttttcttttcctgtaaatccaaattcctgaaatttggccagacttctgggttaccagtctgtgtggggtcaaattcatggcccatgtcactttttggacagtagcatggccttctgcctgtcctggcacaggtttcggacctaccaactcactatgaaaggcagtatatattgggcagtggtaaaaacccagggctctggagttaggccagatctagacactagctgagatccatggaagaggaagagagaatgagaatgcagtgtaaatgttcaagaaagcagatagtttaggatcttgttcctattcttcttccagagtagatcacaatttagcatcattcccagacccttcaacctcctcaagtggacaagctcccaatgagagaaaggtatcaatttttaaaaagattatgttattttgccaggtgtggtggctcacgcctgtaatcccagcactttgggaggccaaggcaggcggatcaccaggtcaggagttcgagaccagcctggtcagcatggtgaaaccccatctctactaaaaatacaaaaattagccaggcatggtggcatgcacctgtaatcacagctacttggtaggctgaggcaggagaatggcctgcacctgggaggtggaggttgcagtgagctgagatggcgcca

SEQ ID NO: 96919 - DNA, 1033 bp, Homo sapiens
cacctgtaatcctagcactttgggaggctgaggtgggcggatcatctgaggttgggggttcgagaccagcttgaccaacatggagaaagaaaccctatctctactaaaaatacaaaattaagtgggtatggtgttgcatgcctgtaatcccaactactcaggaggctgaggcaggagaatcactttaacccaggaggtggaggttgtgttgagccaagatggcaccattgcactccagcctaagcaacaagagtgaaactccatttcaattaaaattttaaaaattatgtaattttttttgactgcctggccacagtgtcttttttgttcgctaaggtttgtgtgttgttctctctccacagcaaaaatgtccagtagttaatagataaccttgattaatcaataggtttccctttacaggtgaggaaattgaggcatgtagaaattaagtaaattattcagtatattaagacattttttaaaaagtgccttcagagcagaactggaagactgtctttttaaagtgctcctctgtagagcattaaaggaagtataagaaagagaaaatgggaacagatgtgaccatgttgatggaagaatagaattttcccttctttgaccactgccactttttcatgctctttaagtatttttcttctgatgtgttttctttttttgaaaatagagacagggtctcactatatcgcccaggcgaactcctgagctcaagtgattctccctcctcagcctcccaaagtgctgggattatacaggcatgagccatcacgcctgccgtttgatgtgtgtttttctatctgttcccttaattcctcagaaacaggcactgtgtcatcttttgtgtggtatctcaaatagcattgtgaatagatgaatgcttagtgaaattagggtagtggtcagcagtatttctaggaagcctcagagattacttctgtcccttaacctctaccatgcctcagaacttctgagccttttatgcttctaattaacagaattcagggagtttttatga

SEQ ID NO: 96920 - DNA, 1982 bp, Homo sapiens
cacctatacctttttggcatgatcaggatcatctgggagctttctaaaatgattggtatggtagtgtgtcattgttgctggtgaaggtggtcttatcacttagcttatactagggcagaaagaaggttgcagagtagtatcacagaatggcccctttggcccttttatgagttgttctagaatttctatccttcatgatttgtctctgtctacattcatcttttgctctgaccttctcatatctcaaagtagccatattatactctgtaagtcctcaagtttcccataccattctgctcatccattatattactttttgtagggtgttctctgtaaaggaaagccctttgcccccattgtgtattaatgaatttactactttctttctagactgcttaaatgatcccttaccctcctctttcccctggaagtcttctatggtgtgctagtcaggaaaggttgattatgtttcaggaataacctccaaatctcaatggtttaaaaccagaaagctttctttttcactcatactgtatgtctacatgggtcgtctgggtgctctgttccgtggtatcattactgtgggactcaagctgatacagcgctatcattgaacactgactccttaaaaagctttgattgaaagtgacatggccactctgcttacattttattggctgaagagggtcacatgttcatacctaacctcaagaggttagggaagtgcagtcgtactatgtgcctgagagagcggaaccagaaatatttcagggagagcagcaattagtgtctctagcctgattagtctctctacttcatatatctatgataatttgtaaacctctgtatctcactaaattgaaattataataaacgctgtagtaattcagaatttgatgcatttggtgattggctcaagacctctgaaattcctagacaactggctggacaaactaaccatagccatttcattaacctcacaataatgaaatccttgttttataagtttatatcagtgattttcaaccttggctgtactttagaataacttggggagctaaataaaaaaagattcctgagcctcaatccagagcaattaaatcagagtctctgagggtgggcccaggcatcagaattttttaagctctccttgtaattctgagctataaatacagttaagaacctctggcttacattcattgcttatttactttctggggaggcgctttgaaatagggccttgcttttattatattaccaagacttactctctttccttttattttgccactagaataataaactacaccaagttacaatcaagtattgatttttatatatactgtgtattttctgtctcctatattacattttaaggactaggaccacatctaactggtttgtcatatacccagtgcatgtcatactatctgccatccagtttcccaagtctattttttcttcctttttttcaaatagtcgtgcccacattcacccatttttttggattccctctcctctgtgtggtgctttctttttcttgtattgttcctttgtctttctcttctttcattagatgaggtaaataacatttgagaaataaagcaaaatgtaattatatttgaaaaatgtaaagcaagatacacacaaacaggaaggttatttgtattctgtgttaacacctccagggcccagcttttatgactgcttagtggctctaacagctgatcacagtagcatccacttaaccttcagctcctttgatcagtgatccagctaatcccagacttgaactctgtgtcttctcatccagtggtgtccattgcttggatgtcagataatcagctctttataattttattaaaagaatattttgttctgagaactgtatattaaagagaaaataatctggctttaagactatgagtcagatgtaaaatttatacaaattctataaactgaaaagatactctatatcataa

SEQ ID NO: 96921 - DNA, 1047 bp, Homo sapiens
ttcgccatgttggccaggctggttttgaactcctgacctcaggtgatccgcttgcctctgcctcccaaagtgctgggattacaggcatgagctactgtgcccagccctattctgggtagttgggattgcaagtacatgccaccacacctagctaattttttgtatttttagtagagacggggtttcaccgtgttagccaggatggtctccatctcctgacctcatgatccgcctgccttggcctcccaaagtgctaggattacaggcgtgagccaccacgcctggccttcgtatttatttcatcatgtatttctgatgtaattagtctctattattctttgcccatgtttccattatggttttagtatttttaatttgcttgtgtactgacttcttgtcataaatgggaaaactattttttcagggtgttttgttttaaagtctttaggtatttagaaatttagattatgttggcaattttatgttcctttatttgttcagttgagtttctacctaaaatgtgcttcttcacccagatcaaataggcattcaccaatatttttggcatagcatttgttacactttaattttttaaaaaaacatgtaactctttaatccatctgggtggtggtataacatgatataggaaaggaaatttagttttaaatgcttccagtactaagaaaaaatgaaaaattaaaatagaatatgttcaattctatggtgataactttgaaatctaaatgaaatgaaactttctgcaacactgtaatagttcatctagtctcaagatatagataacctgaatttatcaatacaactgaaaagattataacaattagccacagaacagcctcagagccaaatgttttaataatgaacacttccaaaattgaaaaacacggatagattttttttttcacatacatattattggaaaatagaaaatggaaaactttgtaattgggaaacttgtaaatttttcagtttgttttataactctaacataatgatatcaaaacctggcaaatttcacacacacaaaaa

SEQ ID NO: 96922 - DNA, 1046 bp, Homo sapiens
acaaattacctgtatagaatacattattctttctagagatgtttgttttgttttgcctttttgtttgatgcattagacttgtgttgatagatgtgcattttgactgaaagaaaatagccaaaaaacaataaccattccatctaccttccaaaaaaagcacatatatccttctcacctgtttgcttagaaaaatatgcatgtatttttccaagcgatatttcttctttgctaggcaatatttctcttactgagccttgtaaaagaaggattaaagaaattgttgttataaagctgttagttctattcgaagttctgtaagtttactttgataaggtagatgctggagaacaaattacaattttaagtactgtaatatatatagtatgtatattaaaaataagcatttaaaatagaatatttgctacagaatgcaatatatttaaaataatgtaaagttttctctaaatagatgaatttgttgaggtaaactaatttggatctactgattttatccatcttgatatccattatatttattttatacatttggaaatagagaaacactctacatgttaaccaaaggtttagatttaaatcttagactatttattacttgtatctgtctttttatattaggctacatgaaacacataaaactaacttatatatgttatgggtacttatgtagatacccattataatacattgttcttaggctttaatatcattacttccatgtaaatgcttgtttgacaatataaaataaaagattttgatccctatattcactctaattctattttctagtgtcatagaattagaaagtttttcttctgaccccagagtcagtaaactttttctataaagacatatgtctctgttgcatattcttcttcttttttaagacagtccttttaaagtatatatatgaaaagaaagaaaaaaaccgaaaacattcttagcctataagcagcagattgcatacccctgttcttgaggatgtactctctgttggaattcaatatgcatactgtttgttttggtgg

SEQ ID NO: 96923 - DNA, 1049 bp, Homo sapiens
ggagagtaagctcacagaagttaccagtgagttctgctctaatcagtgaaatagtttataaggtccgcttgcagcatttagttcatttgtaaaatatacatatttacatattttaaactttagttctcaagtggcacagtggggacctcctgctgaatgttgtattatcttgtatactcagcccataaccagatccagcagcaaatttagaagttaattcaacttgtaatgtgactatacttctttcttgaggcaaaaagaatggtcactttgggcaaaatcataaaactagcatacaacttaattaggatattgtaatatatttattaaaaagcattactgctttagagaactcattttccttgatgggttcctgttagtaaaatgctcagttattaccagctaactaactcctaacaatcattgtgtctgttctctgttttgaaaacataaaaaaaggaatgactaattatgtccaaatgtgtcttccactggttaggttttcttgaagcatttttatttaatctgatcaaaacactcaatggactttaaaaaatgtgatgtttatctaactgcaggtcagcttatctgcaggtatttcttaagtgtacctgatctgtatgctaatgattctaagatgcaaaatgaattttaaaaaatggtctttgtgttctttgagaagataaattatatacatttagtgttagtagtgagcaagatcttattctgccaattatatactgataacctacattgcatactgatacaaaatatactgaaattgcttgtttctgtaagtattaagttggttgctagagacagaaataattcaacaaatacttattcagaattttgtatatgccagtatacaataaagtattacttgtataacaaacacagtaaatgcaaattaaaattagaacaagggagaaatcagttgtaggttgcacaaagtagataaagcttgggctgagctttgaggggtaggcaggacatcactgagaaaagaagagcttgtacctcatgggaagaatgtagaaacaatatca

SEQ ID NO: 96924 - DNA, 2665 bp, Homo sapiens
gagtaataaagaacacagacttaggggtcaggcctgcattaaaatcccatttttatctcctctttacagtgtgaccttgaacaagccttacctaattttcttgagcttcagatttttcatctatataacaggaatcttagtacctatttcatagcattatgactatcatgaggtaatatatgtagagattagagtacacatgtcatattaggaggtgtgcaataaatgatactttattctgaagattaacataattcatacttaaaaggatcaagaactagaatattaaaaaaatagaatgtgaatgtttctgcaagttttgataagaacaagcccataaattaatctctaatttgctacatttaggaatatggtaatgactacaaaagaaatgaagacttcccttcttatattttgtgcatgctaactaatctaggaatactcttctgattggcctacttttatttagcacttaccattttctaagatattttccttgggcatgctgatgaaaaggaagtgaatatattactttgaaacttgggcctatgaggtgattaatgtattgcacttaaccattttgtattttattcatctgtctgtgttgtcttccccacaagactgagacttctttgaggagagataccaattcatatcttggaattcagtgcgttgcaatagttttttaataaatgtttataaaataaaatcgaggaatgaatttgcatcagtgttcagccactaccaaatctattttttttagtttttagcatatccaaaaaactgcagttaattttgtgacatttattaattttttatatgtcagcatagagtcgtttattaaatgactggaacgtgtgattgacaaggtcagttagccagtttactcatggacattatccttgatcaatttgaaccctgtaaaattagagctagagttcaagtttaatagtcatttgtctactaaaagtaggaaaagatatttagcatagctgctatatttataagataattttttgatcagtatcccacgactatcagctagggctgggtagtcctaatcataaattatacacacctcttttctttgtctagttttccaggtggaaagagaaaaataggaaatcgaatacataaagaaatctatttccattcctgacatagctctatgagcatacccttccaaggtattcttggaacaagttttgttactgtattatcttttgtttgcttcctgtctttcactcttattatcagtttgaagttttataacactctcagatcttgtgaggacagctaagaaaatattataggtactaatttgcctatactatttatgatagaataacatgtaatagtttatcacatttatttagctgatataagaaattgtctgctaggaatgtagaaataattttacttttaaaattctaagagcataagtcgtatatagaggtaagagttcctatggagttcttttaacctagagcttctatattaataatataatctctgatctaatttgttatgctttactacttgctgtgcattttgaatgatgtaaatgtgcttcaaattagtttgaatccaactgtttcagtaaaaatacatcattcattacctgtaagaatattatttattgactctcacttcttgaatgcttttctctctgtagtcatctaattatccctggtcattggttcaacagacacttgttgatcactactttgtgccaagagtacattggaattatagagaagaatacgatctactccctgtccttaatgccagttttgtaccagcaagtggaaacgtggaaactatgactttgattgagaggcgttttcagagcccatatattttaatttttaaagatcacattctagatgtgacattagccattgttatttgtgaggatatttctggacctgggacttagttttgtcaggtttaatgtcttcttgtcattgtaattttctaaagagggtaaaaatgaagtggtaaattttcttcagtcataattgatccctcagttgtgatttttaggctactagtaagctgattaatagatgtttacagccacttttcactttccatatagctttaccatatgcagttttaaatccaaattaaatacatgtcagtgctctatgagtttctcagtttagcatgtcacaaaaaagtatttcatgaactcagaactgagcagtgataagtaaagactatattgttaacaagctactgattagattttgtttatagataatggatatttttcttttcctttaaggaaaaataaacataagtggtaaaaatttctatagcatagtaaccaaaagtgctctttttttttgaggttttcatttcaatagatatttattttgcactgtattttgtgtgccacttactctgttacagaatggatattcagtgacgaatgagacacaaaccttgctgttgagtataactgaacctagtagtagtcctttcttggttttgtgtcaggacagctattataacaaacagctttatgatgaagagtactggctttggcatgctgtataggtacagatcatagtgataacatttactggttgtgtcatttcatttaattgatttaaattctctacactgcagtttcctcatccataaattgataatatta

SEQ ID NO: 96925 - DNA, 1961 bp, Homo sapiens
atagttataacttgatttttagggtaacttttttccaattttaacactcttcatgatagcagtactctgctttgttaactgtatcagtttgggtcttctgtggatcagatgccaaaatgaaattagacatgcaagagatttattgggggagacacccatgttggagaaaggggagagccttcagacagcagtgaagggttgaccatgcaaaggagaaagtgaaggtagattgggtagaagaaccacagactgcagctagtgctcagaaaatttcagccaggctgctggggagtccttgagccaaaattagcctttagaggaatcccttatttggcaggaatggctaggttctagtaccactgctgtgttcagttgttggcagggagctgcccaggagaagtatgacctggtgtgaatgcccagtagagccaaaggtgtaaaagctggaggttgtgagtcagtcatgcgctccacagcaggttctgttgaaagatctgagctgggcaactccatcagtgccacagttagtaacactgaaaactacagtggcagaaacatatatattattttattaccaagtctatgaggcatcgtcattcatgagcaaatggagaaattgaagggttaaataacttgttagaggtcccttagctagtaagtgatagacccagaattctaacttaggcaggattgactccagagtgcctcaagcatttaaacctctacaccatactgactacatgcatatgttgaaaagttttctgtgaaactttatttttattataacttaagtaaattcttttcccagtgtttcatgaatctaaaaatgtctaattaccttttaccatactagtttctaaagatcgatttgttttcattaaagcatatacgttcaaaacttgtggatttactctttgaattttgatgcatgtcttcacttgtcaaaaaaagtaaattatgcaagttacaccccatcccccttttctcccaatatactgaagttgtactacagatctttagctacagtaagcaattctccgaggatgaagaaagaaaatgtacatacacataggaatttcttttccagagctaaaattgacattttataaataatttccgtgttgcaaacttgagactaagaaatcacagcaattcagtgatatgcatttggcatgagtcagttttagttcttagtgattttcattggaaatggcataaaaagtaagatttctctgaattttttatgctgtgggcttacaagagacataagatgtttttctcttatagatgtctggcagtgcatggcagcagaagtaacgaaatggtcacaaaccccagcagtacttcccaggtcacatgcactcttaatttttaaagaatctagaaacaacctaagcagttgataacaggtcatttctaggtgataaagagtattggatatgggttaagtgttgcctttctttccacacctttcatttttataatcatttagagatttactttatatagtgatggttttatgttttaaaatatgtaatctaactagtaactgaatttttactttttttctttttagtgtttgacattgattttgaggtcttaaaatttttttcaagattttaaaaattatttcagttcgtcacttatgtttaccccatatatgatgaactgaataatttttattatatataatatataggtatacatatataatacatacattatatatatagtgagctgacttgaggttatggaagattctgattgtttcatttttaagctcaagaaaatgaatgcatcataaattcttaaaacattacttctactctgtgtagatacccatagtcactgactgtaatataagtgcaactggaccaaaggcaactactgaaaagagagagagaaaaaaattacagctactgccagaagtgtttgtgtattttttttaaaacagctttgta

SEQ ID NO: 96926 - DNA, 1956 bp, Homo sapiens
ggcttggacatttaaggccatcagacaaggtataaagtctttcatagtcacaagaagtaaaaggtatctgactagaagagaatatgtgggcaagtgccttgctggctgtaattttgttgtcatttcaagtactgtggtggtgtaattgatgtgacagggctgggctttagatgtggtcccttaacttgtgctcactttcagttttagtttctctgtcattcattttgattaggtaaaatttaggtgacaaacatatgcacaccagtgaaagctgtttggtgtaagtttagtaatgacatatttcaataataaagatgcaaagttaatttttttctttactgcttcatgaaaattgcaataattggtgtcaccttacattacaagatagagggtggtgtgctgatggcacagtcagcaggaggttcttttttattaatattataattaaatgattttctggatatagtccagaaacagatgcacgtcgatcatgccttgtccactgttgcttggcattatcacttgctttttaaaaaaaaattgacttgacaccttgtttttacaggttgttattgatgccttcagattgatcaatgctaatatgatggtcttaggacatgaaccaagacaaacaacttcgaatctgggtcacttaaacaagccatctatccaggtattgcctatatttgataatgtgttaaaactcttttaaattttaaaagcctgctataagtagtctttttaagttctaattcttagcattttaatttgcttgcaaattaatttttcttttgttttaaaagaattgtggaaatactgttgtaaaaattagatttgctcatatgtgagtcagtttttaatggggtctttaaattttcctatcatatttgaggaccccctttttgggagcatagtagatcttttatcttgaaagcattctggctttgcatggttaacattatagagaaggaccaataggagtttccggtgaaggatgtaactattatcattgcttgattagtaggtatttttcatagcagaaaacaatggagaaattgctgtatattttaagatatccctagaagtaattcttaaatatacttaaaattttcttctttaaaaaacccacctttaaaataaatcctataaaagacatccatatgttacttgtgatgagagtttatgtcttgttttttattgtgatagtcaattaccattaattgcagttactggtattcagacacttaatatcctcttgagtgattgttttctttgtatcattcacatgccatggtgtttttatacaaatctttattttctgcaaaaattattttaaatgtgtttttaaacgcaccacagtctgtgtctatctagttaattactactctaaagattaattaaaaggacagaaataccatgtttggttaagtagaatacataaaacaaagacattatagtagctattgctgctcccttctgaaaccttgctctgtcatgaggttgtctttggggagttgtggctttgacagttaaccatggttaagccttggttacactttgataactttatacttttaaatgcttaattttggggcagtcactcatctgtaatcttcatcaaagtgaagtgttttgttttaaaggattgaggtgtgttgatttgaaaaaaaaaaatgcaagtcaaggaaaactgcaaagtataatgtgtatgaaataagctaccagtggttttgattgggtacagacaagcctgtacttgcatgttccaagagaatatattattggacctgtttagccttgataatgacctttcttataaacttcggtagcatcatactgcttcattattttttgcaaaaggttaagtagcatctcacaagccaagatcattgtgattactacatggtatgtttctgccagaagtttttactaattgcaagtcactcaccacctgtt

SEQ ID NO: 96927 - DNA, 1080 bp, Homo sapiens
ggggtgggttgggaaggtgttggggagcaaaaaagacataggacatgtttaagaaacaatatgcttggctagcatgcatagaacgtgagggtgaacagtggggaattaagttttaaaaagtttctgaagtctagtaatagcacttgggatgtcaggataagaggtttttttgaggagtttttgtttgtttgtttgtttgctttttgagatggaatctcactctgtcacccagactcaagtgcagtggggtgatctcagctcactgcaacatctgtctcctgtgttcaagagattctcctgcctcatcctcccaagtagctgggattacaggcgcccgctgcaacacccagctaatttttatatcttttagtagagacggggtttcaccatgttggccatggctgttctcaaactcctgacctcaggtgatccacctgccttggcctcccaaagtgctgggattacaggaatgagccaccgtgcctggcctaagagttatttttgatcagaggcatgatatgcttagaacctgactttagaaacatgatttcacaacagtatagaaggaacactgtaagagaagatttgaaatggagagtgtgtttaagaggagcttgctactacccaaacaaaaggtacgaagagtctggattaccatggtagcagtgggaatggaggtaccaataggcaaataaataaagcatggcactggtcggatagacgaagtgaaagaaggaggaggaatcaaagaggaattcaaagtttcctgcctgggtgaccagtagtatggtagtaccattagcattttcaatttaggtagaagtagaaggattgaggaaggaggtaaagagtttatttttaaggaagcaattagaatgtgggactaggaattaatggtaaaggctagagctcaagatttcaggatcatagttaagattgttgttggttattacaccaaaacgtagtatttcccttttaaaaataaatacatcttaaaaaatattttatccaagagacagtgtataaaatttaccaagtgtagcaataagacttttgagagaactaagctttaaaataaag

SEQ ID NO: 96928 - DNA, 1049 bp, Homo sapiens
aatttttttttttttaagggaccaggtcttgctctgttgcctaggcgggctgcatgatactatcatagctcactgcagtcttgaactcctgagtttaagcagtactcttgcctcagcctcctgagtagctaggactccaagcactcaccactatgcctggctatttttttttttcttttaagatacaaagtcttgatgtgtttccctaggtggtctcaacctcctggcctcaagtgatgcttccccctcagcctcctgagtagctgagattattacagttgtgagccactatgcccagcctaattattactttttaatttcctggttttacagctagtctataagctctgtgaattcagatattgtctcattttatctttagtacactgccagataaatggtagatgctcaataagtatttattaaatgaatgaaattatgctatacttgtatttttctaccaaaaatgtaactttattaagtggccaatcataagcactgttattaactaatattaacataatataaactaaaatttaaggaaatgcaatgtcctctaaggggcacctttcttcctaatcttcaactgttctctatcatggcaccctttgcccctctcccttccttgaggctaactggataaaatataacctcctacgtcattgatcatttccttccacctgcctccagtattctcggagtcataaccttttcatgacagagtatggcgctgatgacaatttgctgtttccagcttgttaaaagagatgagtgatttattttcttagtgcactgagtcttgcatctctttcagttattttccttgtcctcttgccttcacatcatacctttgaacttctgaagtctctttttacttccatggccatacattcccgtggttcccctgactttttggcaactacacactctgctgcctttgctatgagcatttccaagattcagcccttgcctttctgctcttctgtttttatacctttctttaaaagtctgttttcatagtttagcaatgccaacaactttgaaatctc

SEQ ID NO: 96929 - DNA, 2351 bp, Homo sapiens
taacatatgaagtgtagattaacttctttattgagatgttttaaggattcagtaaattaatatttgtaaaatcatgcctatattgatgtttaattagtgatggtagtagaaaaactagttttaatgtcttcatataacacataatattgtttatatagtcaatactttaaaaatcatgaaagaagtaaaatacatatttttgaaatccactagcagttatgcattgattgcttaatagtgaaaaattagtatatgccattttagcagtttgtgctgtcttatgtaaaaattgccataatggtgatattaaaaagatatttaaatgggatcatggcatgttatagtgcgaacaaagttaacatgttaatgtgggaaaaagaaaccaaagaaatagtgaaagaagtatgatgtggaataagagagatacagggtggcaaaagcaaaggctaagggaatagaagagaagacagatgttggagtagctctaagtatgttcagaaagttaaaaacaacaacaacaaaaacaacaaaaaatccattggaattgacctcctggagatccttaagagtgttagtgaagtgccaaagatcccatcagtgtttgtaaaagggtaaataaagtgatggaatttgagatacagattttccatataagaaacttgaccattagcagaaaaaagagaatgaggttaatgggtttagtaaaagcctctgtaagataggggatacattggaggggattatgatcacataacagaccaaattccaaggatttcttagagctgtgcagaccgtgcatgatgggatagccatctgggggtctttgttgataaactgttaaaaacgtttctagtgtgaatagccacaaacattttcagtgcttttttgttggttgagtaaaccgaagagcacgaatgcaaaagcaaaatttgacgccaaatcacagaagttgccataaacacagaagttccctagtgaggacactgcctgtgcctgaatttcatttgtttctgctgcaatcatttcttacgtttttcctggtaactagccagattagaactgtgaatgaagacaaactggtcttgcccagatggtagatgagatacaggtaacttgggtagatagagaaaatatttaggcatttgatttggaatatcttagaattgaagagatatgcttactcttttgtcatgggggtttgcaaccttagtatatgcctaaatctacagctgctcctcatttcccagatggcatctatggctgggagtactttttaccatctgtacttctcaaagagtttgtgaactctctcttttaattattgggaatggaaaaactaattggtaaagtgggtaaattatgtaaaagatttttaaaatttgaattagcgctttttatacctaacttttcaaataagatcagtacttcaagtcctttttgaccttcatctttcattgtctatctaccatctttgttgtttgcaatattccgcaatactccctaataactgttttgtacatggattggtattttgagccaaattccaaaatttttgcctccttccaatactgtagtaagtactgttgttggcatgtacccagaacaactaacactgaatgggtatggagtacaaacttatgtgaattgttccattcatctaagtgcttttaagtcaataaagtttagtgtcacaatttgtgaaagtaatttagaaaaacatactcttaatatgttttgtcaatgtttccatttatgtaaaacattgaatagtgggagaagcaatttcccagttaggaaatacttttataactgaaaataatagagtgacatctgactctgaaaatgagcatattctctgtctagatttggcatgttattaactttttcttctttcgggcttatgagtcataaatgcatttcctaatgatgtgttgtaaataagtatcctttgataatcagtagatacaatacctattcactatcttttctctttaggcaggttctactggggaaaattctctagatagtttgtccatttataaaattagacacttgccatctttgctcattttcaagttctctgtttacaaaactattaagaaggtgtgaaatgcagccaaacttcccagtttatggggaatgtctgatgattacatttcctacatgttcattgttcgcacatgaagaaatttggcagctgtgagattataaagttcagagtatccaaatctaaccctcactgggattttggttccctgctttctgccaccaccatctcacctccttttgtaactctttttgtggtaaatgctgtgttggcatttcttaaggttagtgatccttaaattttc

SEQ ID NO: 96930 - DNA, 1032 bp, Homo sapiens
atcctaagtgccactgatagttaaatagatactgaagctatgggcaggctggattgataagaaaaaaggagacagagaaatgggaaattgggaaagaactgtgcaaataggaaaaggagagagcaacagaacagaattagtaccacagtgccgtaagtgccacctcaggtacttccatctcccatctcctgaagaattcagtaacagtttgcaaatggtcaacacaatcatttagtgatcctgtttgatattttcaatactttctgtgtatttcttgtctgttttcaaaatgatgatgctgatagtttttattgccctgaaggttattctgaagtttagcataattttatttgttcagtaaattatttgaataaaagttgtatgaatgaaaattctggtcatcattatttttggtgattatcctgcagtgggaatagaggatttataattttaaactctgtcctttgtgtttcattcacaggctgtagaagaagaagataagatgacacctgaacagctggcaataaagaatgttggcaagcaggtgaggtgtactgttaataagttatgcagttgcataataacatgttcttatagagttaaaactgttttagggcctatataatttttttcctgtccactctatgtttttcttctgtcatgtaaatgtgatactaattgtaaaggtcactaaatttatttgatgtcaggttctctatagagaagtaaatcacaaatacctaagagatattatcgtcagtgaaaataatttactaggaacaaattaggacacttgtatcctgaattaattttttaagtattatttttacctacagataaataagataatagaagggtagatttatttcatgtgtaacaagttttgttaatcatgtactttatcaatatgtaggtaatattcctgagaaaggttagagccttattgggttatactgagtgaagagaaagggctttaagtatttgctctttcacttttctaagaagaaatatatattttagtctctattatct

SEQ ID NO: 96931 - DNA, 1101 bp, Homo sapiens
gctttgaattaagcattctctcagacattcaagatatatgaacggtagagaatatacacatatattcagacaggtatacatatataaatgaaattttttaaaaaatcagatgattgtgagctgtatagaattccttgttactctttataaaaatctctggtacatagtcattgcattgtataaatcaagctttcattgtgtaatctattattttattagctacttaactttttgatttagaaattctaagaatgtaacaatatactagtaaagttaaattgtaaaatatttaagtaaggtctggctttctttactagtttcatcagctactgaaaaaaatttaagtaatttatctaccagtaatatggttctgttttctctttcctcatttttgttcttttaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtctatgcctcctgagatctttttggcaatgggtgggattgatggaataacatttgacagtggtctagaaatctcacacaaagatatgtttccgtttgcattttaagatcttacaacacataaaacatcagtgtgataaaacttcacagatgtataatgatttccattaatgagtggctacctaattagtgagtaactcagaaaaaatgttgacattttattagcatttgtcataagctaaatattgtatactcactatcttataaacatacttttaggattttgga

SEQ ID NO: 96932 - DNA, 1033 bp, Homo sapiens
agccacagaaagtatatgtctaaaaagcaaaatgagaaaagtagtcataatgtgagtttaatataagcttataagcaataattttgctattgtttggtctcatcttttctaaattaggactacccagttttctaatagagaaaaaaaaatggctaataccaacttctaatgtgatgtacaaaagtaactgcccctgttattacttacggttcagaaccatactgattataccatttgtatggcaaaagatacagagacaaagatctaattctagtctgcacccttgtgaaaatatggtgagagtattactgtagcttcattaaaggaatgttttacatggacttgcaatttaacttaacctactagaactgttatgagtgctgtgatagatcaaattactgtcctactggaacaagtctaggctcttattggttccctagtgaagttaccagaaactgaaagtcaaaatggcttaaattcccagtatgtttcacagtatcttttttggtggagtaagaagtattctgagcatttcttgcttgtcctgtggtttactgtttcagatatagtgacagtatattttatgtaggacatgtaatatgtattaatttaagttgttgggattacatttaaccatttaaaattcaaatataagtggaagttagtgaaattttcttttgcctaattcaaacttgtgtgcaggctttttggatatgatttttccctttgcaaataagattctataacttatttcacagatgttgttaatgagtgctagtcaatgattttttggggggtacagtgccctcagaagaaggccttaacatttcaagaactattctcaatatttgggttgaaagggtttttttgtttttgtttttgttttctacttagtcctctgaaaatatcctgagtcctgtgactggaaaggcttaccttgcctgtttttttgcccttatttgatcaccccatcttcctggactccctatagccacacaccacttactctcacttagttcatgttggtgacatt

SEQ ID NO: 96933 - DNA, 1034 bp, Homo sapiens
taagtttctatcaagatttttagaaaatcactatgaattattttttaacatgtttgttggaaattttgctaaatatgagtacataccttcatactttattaaatatcaggcacagaatataattcaatgcattcttgataactcagagccactaccataaaagttaatgaacatactgggcttcgtgacattctgcatattttctgtttcttttcttattcacaggtagtcactgaggctaccagttccacttcttggcatttgctacttttgctcgaagttgatgtgagaatactgatttataagactactagatttgtacaatatttatgattcaataaactctaaatagaaaacacaacaaaacataagcatgacttttttccataaagtaagaggattttgttggccaactctgtggcagttatttcagcagcgtccaagaactcttttgtgtacatcctgagtgacctagagtgtgtattcaggatgtctgagggatacagatggttgagaataatagacaagtgtgggttataaagtataacatcacagccaggcatggtggcggctcacacctgtaatcatagcactttgggaggccaagcggggtggattgcctgagcccagttcgagaccagcctgggtaacacggtgaaaccccgtctttattgaaatacaaaaaagtagccaggcatggtggtgtgctcctgtaatcccagctactcgggagtctgagacaggagaatcacttgaacccgggagtcggaggttgcagttagcagagatcgcgccattgcactccagcctgggtgacagagcgagactccatctcaaaataaataaataaatacataaacaaagtataacatcactatcccatgaggaaagctcagagcatggtatgaatggaccaatattatggcccatagaaatgtatcatctttctgcacagtcttctttctgtgacaatattaacatttacacccaagaatttgaattaatagttaacttccttaattgagagaaaactt

SEQ ID NO: 96934 - DNA, 1060 bp, Homo sapiens
aaataccagtttaaaatctaagtgtttacaaataatacatctgatttttgacttcacttctattaaacatatatatgtaatattgaaatagagtttttccagtttctaggtgctatatattaggcaatattgctttaaaaaaaatcatttagtttaatacagtttatcttactagagtacagagaaatttaacacttgataacagtttaattaaaacaagtgggcttaatgggataatcattccttcccatgcatgctgtgtaagcgccctttgagtcaaatttggaaatggattgggtgttttaattaaaatgtacgtatctttaaagcactattcaataaagccaaattcacagtgagttctctcagcacctgcaaaagaggatcagagacttctgcaggacagaacaacgtgccctggaaaagctctgggggaaaattagaccccctctttgaccccgtttcagtttataaactgcctcaggaattaaaacactctgttttataccatgtatgctcgtgagagctcatttgaatttacgtatttttttttttaagaagagtactgacttcctaattctaacttcttttctttctctctctagtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgtt

SEQ ID NO: 96935 - DNA, 1013 bp, Homo sapiens
cccggagacatttctaagcccttactcagaagtttttcatgcccttatctttctccattgcaggggcagactctcccaaactgaaaaacatctggagagatttaaattcaattatgtaaagaaaagtgcatctgggctgcaaatttttgtataaaactgtgaaaaaaactgccaggatttgttttctgtgaatcatacacacacacacacacacacacacacacacacacacacaatttttatgaactccaacaaaagtaaaccatgttcatctggatcttaggttaaaatgatagatatttatctcaggtgtttatttgattactggcagcaatttttagtctctaatagaatgaagcagagaacaaatggcagggtttcacatttgtgcctcatctaagttttctatacacaatgcagtactgatctgtggactttttccttgtgttttagacaattttcaaaaatgggatttgtggacaacaaacgaattgcaatttggggctgggtgagtagttgactgatgaatctgtatgcattcgttagtgaatatcactcagagcaggttactttatcttttgtatatacatatttggaggtgaaaatcacatctatcaagtcttaggtctctgggcagtaactctgcagaatctccactgagttaggcttacacctttgtttattatgatgagccagggaggtgaggtagaaagagcaagaaggaaggagtgaaagagggagggaagagggaagggaaggaaggagggagactttttcttatgcatcagtcagtaaagatttcgtgttattgtttttaaatcttctataattggtaccacccagtcactagggtcagcaaattttccgtagttttccccatatacctaccaagaaagggatcagggctctgaaagtgtagtctttaaagatactgtccaattaaggccaatttaagcctcctataccatgctttttatctctaaagaggcacagtatataaagatgtgagaaat

SEQ ID NO: 96936 - DNA, 1086 bp, Homo sapiens
cctacatttggaataatagtgtcacgtcttggttttcaaagctgttctcctcgtcagggttgcgtgtttactaaaattgaggagctttgttaagcagcgtaagccgggtgagatggggtttagaagggaaccaggaattcttcactagtaccgtaataataatggctacagtattgtctgcaggagaatctaatagtaaagtgttttttctgtaagaaatttggaaaaggggatttttatttttaccaactcactcaatttgctttatgaagagctgccattttaggaagacagaggaagttaaaagaaaaaaaaagatcagagactaaatatggagatgtgttttcagtggaatgttattttttgatgagcgaaactggcacatacaaaaaaaactccataaagtgttctcactaaaaatatcatattatttctaactaatctgtcaatcgaagatctatgtgtatatttaaaaaggttttataggtttcagtcataatattgattgtaaagctccaacatagtgaacctgaatttagagtggaaatgatggcttcctaattgacaccgttgactcaggtaaactgatttttctggtggatggtgtctttggcagaacccaaggtgttcttcatactgacaggcatcaaagacttttggtctcagggagacagggtatatttgcaaataataaagttgattttaagaggtttatccttgcttgcacaaagtgataaattataaagatataaacattcattatttaaacagaagtgctttggaccttcaagttttatatagtgtgtatatatatatatatatatatatatatatatacacatattctgtttctgcctgaccatgaaaaggttgcatttcatgactctcccttatgttcattttatgtatattaaattgttggaacatgtctgattgtgataattttatgaccataatgcagacgtttttgtgcagttttaaaatgtgtgcaacgatgttacttttttttttttgtcaataccaattctgtgattattttttcctaggcaggagctgtgaatccaactgtaaagttctttgttgtaa

SEQ ID NO: 96937 - DNA, 1062 bp, Homo sapiens
aatgcttactttagcaaaactagacacacccagaacaggacgggggctagtgaatggggagccagagagagagagagagaggcttaatactattgtcatatatttaagaataaaaactccttgaagtcatattattcatttcaccaagcacaatcaaaagttcaccctcttctgtgtatataataaatgattgtatgttttaaattttttttcaatcatcctactataggaggatattgcatatgtaagcattcagtttccccaagaatcagtgagaaatacgtaaaaatacttgtatggaattgtagaactcttcatggcttagtggtaataaaattcacatgcagcatttatgattcctttattttttcttttacactatattatatgctgaaatttgaaatatttggttatttgtcaaatagttttattattattgaattttattatggaaaagaagtatatctcttcttttgctcctttcactgctttagtggtaaatttcttctataccttctttcggtggaaaggaaatttgactgctcacccatccatcagtaataagagaaaacccaaatgtgaaggagacaggaataatcagagagaaaagatagcatctatgaggtttgcctgaggaagtccaggatctgttccaggtttaaagcacagaaatgcgcctgaatgaaagctttgtatgtttcaggggacaatttctaaacagtatgctctgtaaaagctggagttgactccagcttgctcagttaactattgtcaacctttgtggaatgctcatgaggtcagcaggttagtctttttcaggccagttattttgggttttgcttccctagccatagcatatgccttaagtttctctatcttagaaatctctgcctctcttctcaaaggggatcacaaagagagagaaaatgaagactactcagttgatggtcagagaaagacaatataaaaagactggagctggatcgtgtctttcaaattttatgacttaagaaattactgaggcccatggagaatgtggctgtaaataacatgcaggagcgc

SEQ ID NO: 96938 - DNA, 1038 bp, Homo sapiens
ttgggtgcagtggacccgcagttgcagcattttcattgaggtagagactcaaaagcagcgcttccagcagctggtgcaccagatgactgaactttgttgggagaagtgcatggacaagcctgggccaaagttggacagtcgggctgaggcctgttttgtgaactgcattgagcgcttcattgatacaagccagttcatcttgaattgactgcaacagacccagaaatccaagccagttttctcagaaagcctttctgactgatctcagcattacctctttggaaaaggaaggtagttcaataaatgaagagctgttgatgggatgattgaagaaacagctatgagaggactggctcccatcttttgttacttttgggacatcctgtcatctgagaatgaacaaagaccaattttttgtgtgtgaagcttaagggtcatatgtttgcttgtattttttaatgctaatcttgtgaaaataattgacaggtgaatggaaaactctatttagatgcatattactgtacacgggactatgcttttctcaaagccccattaactgcttcctattattttgatagtgggaccacatacataaaaatctctcatttgtgtggagtcatttcgatttcaagggagatccttgtgtttttcagaaagggcagaagtgggggaagaataatttagtatccttatctagtgtttgattatcaatgctggagaaaaatatctgtaagagtgtttatacagtacacttcagttttcttgatgatctccctttcctatatgatgatttgcttaaatatccatattaagtatagtctcaaggtaaggtaggcagcctgagagtctagaggtctttagttttaaaggaatctagccagtgaacataattcttattactagactgccacaaggaagaaattaacttaccctgtatatcagggtacaaaaaattcaatgatgtgcctaaataagttataaagatttaggccaatcataagctaacagcagtttcaggtagaggtgcatgcctaatgt

SEQ ID NO: 96939 - DNA, 1031 bp, Homo sapiens
gagagcaccctggccaccatggtgaaaccccgtctctactaaaaatacaaaaattaactgggcgtggtggcacgcacctgtagtcccagctactcgggagactgaggcaggagaattacttgaacccaggaggcagaggttccagtgagctgagattgggccactgcactccagcctggtgacagagtgagacatcatctcaaaaacaaacaaaagaatatatgggagataaatttttgagagcttatgtatctaaaaatgctttcattctaccttcagaattgattggccaggtatagaattctaggttacaaatgattctcaagtagaattttaaaggtattgctccattgtttctagcgtcccttgttgcattatctttctctttcctgcctggatgtgatgtgatttgttattcctctctggaaacttgtgagatctttgtctttagtattctgcgatttgatggtaaagtacctagttgtgttgtgtggggaactcagatggtattctcagcctggaaactcctttgctttagatgtaggacgttttcttcaatgatattttctgtttcttggaatgctttttgttttcactgggttttctacttttatcatctttttcctcctatcatttttttttgctgaactttttgggaattttcctcaactttatttcctaaaccttctattgagtctttcatttctgcttttcattaatatccaagagcttctgttctattttcatgaatgtgatattgtcccttatctctctgagactattaatatatttttaaagttttttcttcctatataacctttgttttttccagattgttttttctcctcattttgcttgttttggttgtctttcatgttaggtgcttttctcagttatctgatgatactgctttgctcttattttaactaaattgctgattagaagccctgagatcatggttaggcattgattgtgggcttcactgtatggtgatttggctgggcagttttgtcttggaactctgggtgtca

SEQ ID NO: 96940 - DNA, 1552 bp, Homo sapiens
ttcattcatattaacaagctgctattaagcactttgtaaatttaaactgtactaacgtgatgttttctttatcagggcatgaaattagtcttgagatatgtcagcatacaaattgaatgtaattggattagaaaaattagaaaaggattagaaaaattgaattttatcaataggtcatcagttgtagttctataaatatgaaagtgttaatatttcaaatcacccctggttttaagatagcttgtattgattttttcttccttttttctccccccaacccccgagaaaaaccagttgcttcaattcagatgctcattttttcttacttggtctattacaataaattaccaatggacttacctatttccaatatcatctcactttatattttattcattgtaaactaagtttctaaaatggaaattttagaatttcccttctgcttctgaaaacacttcagtggcttttcattggcccaaactttttgggggtagtattcaaaagtttcatgatttggccctcatttgcctttctgatgtcatcatatgtcactctctcccatatactttaatgcaagttttgtgatctctgagtacatgtcaaacttctactttaactccacttgtcatttgtgttatgaagactggaagccttccttttccccaggcttgggtgaagccaagtgctttacatacctggaatgtctttgtcacagtaattttcagttagtttgtaattgctcatttaattaacttagtcccctcactagatgtgagtactttgaaggcagtaattttttttaaacaatgggtgcttaacattcaataatagcttgttgattgtggtgattttatatattttggcagttttttaatgttttattttgaaactggagattgtcataattttacatagataaagttgggcatactctaatttaaatattgaatatgttttacagccttcagtttggaaacctgcagaattatgattgccatgttggatgtatccttgaatagaaatagaaaatactagaataaagagtaattgctttctgactatcaagccagtggttagatttcagtgcctgtagtaaactagtgaatttaaaaatactttgtaagatcctgtttaaattctaggctttctagtttttatgcagaagtctgttcatataatgagtttggctaagtctacagaagcatactcatgttttagtcaatgatttagagtcagataaactcaggtatcagaatttatttttgttaataaaactatcagagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggtaagaacattaacattctttagaatctataaagctaatctttgttctttgattagatgaacttaattgcttcaatttactaactaataaagggatgtatttttttgccagcaagttcctttg

SEQ ID NO: 96941 - DNA, 1472 bp, Homo sapiens
tcttaatagataataatttcacttatgtattagtttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaattgttcagaaattttacatttgacttatttgacaacattaacattagtggtggctttgccattaaaaacccagtaagtattttgagtgcatctatgtgatgtggtgttttgagcatagtaggcaccacagcaacttttctgcgtggtactaaaactgccgaaaatgcgacgtagaatcaccagatctttagtgtttaatatccctggtataagatgttataattaatgtaatttctttcttggcaaacacctcatgtctgtcttagtgaagatttaataaaccacttatttttcttatgctttaaatgtgtattttctaacctaacagtgagtgacataattttatgactgctgaccaaattaatttatagattttataaaatcccatgtttcttaatggatggaggatagatggcaatatcttgaacaaaatcttttataaacttacagaattttaaatcagccttcacttaaaaaaatcctggaaaggaagtaacgcatagtcacttgacactgataattttatataattt

SEQ ID NO: 96942 - DNA, 1054 bp, Homo sapiens
gcactggttaacttacaccccagttcttttacgatgatgtaaattattgaataatgtacactcttaatgtataagtgcttttatttatacagtaaacatgtttccatgtcattttgagaatttttttaataaacattcaaatagcttgctgtaaagttttgtatcatacaaaatctgttacatatatatatattatgagatgcttcagttcaaataacagtgcagtaattcacctatatctaaaagactgccaaattattaaatgtcaggtattgcacttctattctgagtggcagtttacacattttaaattacatcaagggtaaatcaatagtatggaaatcttaatttggtccactttaaatgtaatttcaaggatttctcatttgacctatttacacatgcatccagaaaaaagtaacaaaaaatgtagtcaagttatgtttatttccaaaaaaggcatttaccctagaagaaagtagaatctgttaatacagtttaaagtctgtggagttaaaaaaaataacaaaaaatcaatttgtgattatttctttaagtaaaatataagacattaagtttgcctgtaatcttatggcattactaaactggacaaacaaaataaatactctttgtcggaaatgtgctctttgtctttttacgtttgacaaactcttaaatgatatgttttcttctgcttttctagttttctgggtaattaatagaaataaatttgttaatatctggtgaattaaatctgatgagtaaattccaagatttctttcaggcaggcatattctgtcccataagctttaaaatgcaaccatgggtgttttattactttgaaacttgtgttagaagatcccaatttttgggttgcaattcaatcatttacatagtgaattaagcacatctgaataaatacataatgctaaaatatcatccaagaatatgtctagagtttatacataatactagatgatacaaattaaaatatttagaactggtaaatatttagaagttatgagtgcagacaggattttaaatgaatattgct

SEQ ID NO: 96943 - DNA, 1004 bp, Homo sapiens
gcgagtattcaggactcaggtgtgcttctgtgtatctgaatagtgagtagacattggcaacacttctacatcactatgatgtgccatacagtaagaaaatgaggaagctgtttccctatgtgctaattatgttttcagatgtgccccttctgtaacatcagagatggtggcaatttgcaaagcttaccgggagtgagaattggcctagatcatcatttaatagcaatatttgggaacacttaggagtgattaggtcctaattctgacatattgtgagaggtaccccaatgttttcccttaaccataaaaatgtaagtatgtacagatacgtacatacagatatttgcattctagttgactgtattattgaatcaaatttcattttgttgtaattattgaattttcaaaggataacctgaagagtgctagtatgaatatcccagaaacatacttattaaatattcatttttttgaaaataataagccattttcaaatgattataagatttttctgaacttttggatgcatatttaatttcccatagctatctatttgtggtaccctcagatttatattatggcaagagataatttacggtaagttctaaaatatgtagtttcttcatatttagattctcattttctgatcagccttggttgtagataccaatacaattttttctgctatttgtgtttggtttttcttttgtcaaagggaaatgttctcttggtgttctaaacccttaagatgaaggttgggaaatctaagccactaaacagactcaatagtccttagcttacatgccacattatggccaacacattttatttacaagttttcttgaaggtagtttgatatttttccccttaaataatagagaagcaacagggggaggaattaagaaagtatgaaactcgggcaaaagaaaatatctggatattttcattcttgcttaaaaaaatgaagcaaacgtatgttataaaaagttatttgcacatgagtt

SEQ ID NO: 96944 - DNA, 1093 bp, Homo sapiens
taccactgtacctagcccatttcctcaaggatgccttccttaacctgagttaaattcatccagtcacacactttcacagtgccttccttttatcttctatcacacatatcacaattgagatgaaatctttatttgtgtacttatttgtgtcatacccattttgccccactagtgactaagttccatgaggacaggggctgtgtcttttttgtttctcatagttttcccagtgtctgctcaataaaagttgggtgggtgggcaaatggatggatggatggatggatggatggatggatggatggatagatgtttgggcagaaggctatatagaaaaatgtaggcacgcatttgaagaggtaaggtagagtcagaattctaccacatcccctcctaaatcaattatggcatttggcttttaagaggggaatagtatttcatccagtaatatgaaattactgaaaataaataagtattagaacaaaatatttttgtagaatttataatatgtttgcttcttgtgtgtatcagtgttattccctgtgaagacagaaatgacaacctgcttttttttagggcctgactgctggaaaataaataaataaaacttccctcatataaagtccctccttctctattctatctctgaagcctgcaggaaagaccctgttgactttttttctcaagcaggcttgcctaagaactggaaagagagcccaaaggaagaaggcagctgatgaagctgccaggcagctttgtgctccagaagccctgggtcttggctttgactcttgtgctccctgccccttggcagttgagctctgagcactggtgatgcattcattcagggccttagtctcctctggggtgagtccatgttagtaagtgaaaagataccatggcaggaaaatctgcagaatgtcaggaatgatcataaggctctaagctttcaagatactgcctttaatcgttacttactgctaggcaagaattttatacttctctttcactcttgtttttcttactgcggttaggaaatttatctttaaaaatcagtttaaataggtggcctgaatgacaacatttatatgccta

SEQ ID NO: 96945 - DNA, 1052 bp, Homo sapiens
aaaatttctctctatattaagagattttcctctctctatatatattttaatatataaaataaaaggatacataacaaaaatatctatctctctctctatatatatatctatatttctctacccattggtagattttttattatcctttttttatagattttttatagagagaatatatatacacatattctctctctcaaacatatatatgtatatactgtgtatagtgggtctgagaacagcacaggtctcttattcccagtatgttggacttagctcttcattataatttagctgcttccttagaacaggttgtaaaatctcaaaagcttaaaggtcaataagtattatacttaatctaaatatttatgcaaataccttatgtccttttaaaaataaggtatacaaataaataaaagttgattaataaataataaattagattgtcaagctttctgttttggagcaaggtcttgtagaagaagatgcgtttaatcactatggagcaacctgcaggatctggagattaatttgcaattgtcaacaaggtatttagttttcagcaaacacttaagagaacagataatttttttcaccattgatagatatatatattggcttatttataaaaagggtctctttgggagaaagatataattttcttctgttttgttttcaggttgtgctgtcacagaggaaatcattactagattagctgtcatctgacattgattttggaagattttctagagggagagagactaggaaagggatttggcttttttcttttttttttttaacaattgagtgtcctggaccaaggggccaattcttattgttccatacttggggagaattataaaagatgtaactacatcttaaagaacttttcagtattaccctaggtcttttgccctgactggccactgaatatacccaattaataaaattttgatattttctgatcttgtactcacctctcttagtatctattcaagccttttttattttgggggacacatcttaaagtgaattgtatcatatttcttaag

SEQ ID NO: 96946 - DNA, 1003 bp, Homo sapiens
tttttttgagtaatttctattcagagcctcttctcattttgaaatgattggattatttatttacttgctattgagttgtttgagctccttatatattttgaatattaaacacatatcaaatgtatggtttgtaaatattctctcctattccataggtctcttcactctaatgattgtttcctttgttatgtatgagctttttttttggatttcatccatttttctatttttgcttttgtttgtgtttttagggtcatttcaaaaaaaaaaaatcattgctcacactaaggtcatggagcttttttcctatgttttattccggtagttctagagttccagatcttagaactaagtctttaatacattttgaattggtttttgtatatggtgttgatttaagggtctaattttattcttctgcatgtggatggccagttgtaccaaaataatttattgaagagactgttctttcttcattgtatgtttttggcacttttgtgccaattgaccataaatgtgtgggtttatttctgggctgtctattctgttccattggtccatgtatctgtttttaggtcagtaccttgctatttctgtcactatagctttgccgtatatttggaagtcaagtagtgtgatgccttcaacttttttctttttactcaagataccttctgctatttgggctcttctgtagttccacacaaattgtaggattttttttccacttctgtgaaaaatgtcattagaattttgatagagattgcattgaccctatatatttctattgatttatgtcatcttcagtttctttcatcagtgttttatagatttcagtgtacagatctttcacctccttggttaaatgtatttattgaagctattgtaagtgagattgttttcttgatttcttttctggatagttcattgttcatgtatagaactgctactgatttttgtatgttgatttttgtatactacaactttactgaattaatttatt

SEQ ID NO: 96947 - DNA, 1055 bp, Homo sapiens
ttttaatctatcaacattggcccactctggaacaggtacatttctctgggggaactaaaacataggaaatattatgtgatttactcaaggtcaaatataatttcagtggctggggaggcataacagaatatctaaaacatatttctactctgggaaatattacccaatctcatatgaaaagttcacatatagttatttgctaatattatagttttcactgtaaccctttaaaatgtgtagcagaaatcacagtattactataaacaaacctcttgtacctttattttttatgttagtaaaaaaaagttttatattgttcttctgtctgctcttttccaagaaactcaaatataatttttgaacagttggcaggtggattgcttgatcaaagcatcttctgtttctgccattttgttgagatcatatattgtgtctcagaagtgctagaagatctagctgtattgtcagtatttcagatggcttctgttattctcctagtactgtgatgactatggtataggggatgcccgtctagaaaaagtcaatgttagttctcagttgaattgtgaagtagttaaattttaagttttatgcttctgtattttttaatcagttttaaaattccttccccctttaaagagattagctatcaagtagacatcttatacaatgtttaacattctccgtgtttaagcacatgtgtcatttgaaattggtttcttactgtaatgcaaacatttatgaaataatagacatttcatacattcatcaaaccatttcttgttctaacattttttatttctgctggttttattatctaaagtatacattcttaaatccttgaagtcatggactctatccctttgaggaaataaaattaaaagttaagagttgagacatgagtgttattataccctgttataccattaaacctagagttgaatttgaacccggggtctagtttttatgggtcattaagtatttgaccttagatatattgcttaagctcactgtaatttaggtgtctcaaatacaaagtagagataataatggta

SEQ ID NO: 96948 - DNA, 1063 bp, Homo sapiens
ttagcagagcactctgctgtgacttgaaagtgtacctctgtgggcatgcacagcagaagctcatctgaaacatcaggaactttgaaatgtgaagtctgacttttaaatcaagtacatttgtgtagaatgtgttttctttctgatattctaattttattgaatcatgaatactccggctgggagcatgagctgacagttgatttagggtgttttcacttaatttttaagtcatttttttggtcttttccaaattggttcccaaaactcattgatgagaaaaatattttgctgacttcattaccaagtaccaactttctgctggatcctctcagcaaggatttagatgggtaaaggctatctgaaactacatgaaatctgacactgcttgagttgggtcttgccagtcattcataacatagaatagtccattttatcagctcaaagataataataagtatcattattggacaaatccatgaagaccagcttaacacatttgcataatttatactgtaatgaatttacatcagaggagacacaaaatacctatatgtagacataactaacaaatgagaaataaggcaaatgacttgaatctacctcacaatttcagtgccttgaaaagacaaatgttatataatgttatagtcttttcataaactcaggatttagaaattttatctgagtaggaccctagcaataataaaattgccattacaccttacagttgcacaaggttgctactttttaaatactttaaaatataccattccatacctgctttcacgtgaacagatagtatctctagtttctagattaagaaataaaactaaagaatgttcttatggttccaataaaaccccatgacagaatatgcaatgtggtctacaggtaaattctatacattatatatcatttttaactatcagattaatttgatgtaagtttccaagttgttatgaaatatattgcatccgtttttcttttatagtatgacaatgatttccacatagctgaagtttgtaaaaaatgtaagataatagacatgaattatgatttacaa

SEQ ID NO: 96949 - DNA, 1010 bp, Homo sapiens
gtgtgtgtgtaaacacaggtttctgatgactcattgtgcaattctgctgcacagtgtactcagcttctccgcagggccagtgccaaaggacaaacaataaataggcttgggtcattagcagatcaatggaaacaaaaatagaagttctaaaaaaaattctaaaaataagcttatctaattttattatacatgcatgttttgtagtttacagcttagcattgttttgtttcaaattgttatggcattccccacattcattttagtgcttcagggtctataaaagatttgtctggctaattctgagcaactggctttcaaagcccctcttgagtcttggagataattttgggtgtcagatttatttcatacgatatggagcaaagctattttaacatctgaccatctctgctcacattattggcaagtctttggctgtcaccctggaaaactaatttacttccacttgttcttttcttttttcttatctgtcttgtttgatgctcattcatgtgcagaagggtgggttcccttcaatatctactctcatcctttcaacatctactgttaaactaccaagctgtatatcttcataatttcagtgacaatatacaattttaaggacatggtacatactgggcagtctgcaagggtacagattataagtttgacaaatattcagggaggaaaggtatttctaaaggttaatgaagataaagagttcttagggagggcttgagtagagcatttgcagaggcaatgatggctaacaagtcaggagaaaggaattctgaacacagtaagaaaaacaaaggcttaaagatagagtttgccttgggttattgggaaaagtataaacagatctgtttggttggagtaaaattttacaaaagaagagagggacagaatgtagtggaccttgaattccaagtttagaagttcaaagtttattctacatagataagaaatagctacagaagactcagaccaccatcttatgtgagcaattaaga

SEQ ID NO: 96950 - DNA, 1028 bp, Homo sapiens
ctctgacatgagttttccatgaaaccttaaggaatcgtacagttgcagtaatatactattgggaaatatttacctatttttacgtgaaatagcaagagaaaagccaaatatttggaaagaaagaaatactaaagaggaactttataaacattgcctactgatgtaaaatctttccttaggacagaggaaaaaaaaccctcacaaacacacatttcacacacatagactcctgtagcatctttattaaattcctcacatcaatttgttatggtatttgtcacattgtttacacaaaggcaaaatagctaaattttttaatctccggagactactatagtagttgacacatagtaggcagcaaatgaaagaaccaataagcataagtagtaaaaaaaaacaaaagcaaaacacacacacacacacacacacacacacacacacacacacacactgcaaatgccttccttccagattaattttctactaggtattccacccaactaagacagcattactagccctctaacttcccctggtcattcatttctcttaacacaattcctataccccatttctctccctgcaatttggttgaatgtttactctctatggatgcatcaagctctggccatcgtattttctaacaattttggaactttacggatccttttaagtatcagcatggtgacagaaactagaaagaagcacactgtgtaacttgcagtgagtaattggcagtttcagatagtgaaagtcaactgtgtgtgggtgctatttgcaattaacaaactatatctacttggtatatcgttaagtggaaagcaaatggcatagtaataactgataaaaatggatatagatacagggcttttgggttcaaaactcatcaattgaatgattttaaaaatgtttcaataatatttgtagtgtttactgagtactcagaatggtgcttaatgaatcatggctcctgtcttaaaggagcatacattcatttatgaaactaaatttgtacagttgagacaaag

SEQ ID NO: 96951 - DNA, 1002 bp, Homo sapiens
ccaagccagaaagttacttcatgttcatcttctctacattactccagttaaagctccatggggaatgagaagcagaaatatacctaatatctcaggtaaaaatgagtgggagaagagcagatattataaagatatgagagaaaatcccattgccttttaagattatggaatgcagtacagtcaggtcccctggaagggaaattaggaatcataaagtcctagactgagctactgtctcttttagagactacatgatctgaagctctttcctctcttccctctcccaatgcatctccttaatagctcctctttctcctttctctccttctctttctttctcttgtcctctcccttcccttcctttctccaatgcatctttctcctctctttttgtctgtctctaccactattttttgacttatatttggcccaaaatacagtcttcaaatcaatatgtcttttcagctgaacacccaaaagataaccaattcagtcttgcactattttaactacacttaacagagagaaactgatttggcccagatcgtttgtattggccaatgattggcctccctcgacttgaagatgagcacatggggttgtgtacatgtaatacttacatgaagcctcccatccagaggctacatgtaggtagagaaggttcactaggaagggatcatttatattcctagcaccacacaatggatgtggaatgtagtatgtacttgataaatacctgctaaataaatgagagaacggtatattcgtagcttatttttgtaaatgtgtactcttttcatactttactagctttactaataattgacagccaatatgtgtggactgcttatgagccagatgttgtttcatgcacagtccatgtattcactctgtaatcctcacaatattcctatgagaaaaccaggcatagattgcttaaataacttgcccaagtttacatagctagtaaagagcagagccaaggcatgtgcctaggtactt

SEQ ID NO: 96952 - DNA, 1038 bp, Homo sapiens
aggaaactgttgcttctgatatgttattacctttgtggctccacagtgaaggactttgtggtgggcctagccactgttggataacagaaagatgctggatgcatagtgaagagttaggacaggctaggacccaccaggtgtctctgcatctgtccatcacagcatctgactgtgatgaccctcagagactaattgctactcaactactccactttcacctccccaatctcacatatgctgctcttattgtcaacttataataatttgaaggggaggagatttcgagaaacatgatttccagcttaaccagatatacagtgctccatcctacaggctattgatgcctgttccatggatggccttggtgaggatgcttcagcgtccctttgaagctatttaactttattttcagaatagtgcaacagaaacatgctcagaatcattgcttttcttgatactcagatgttttctcttcttcattaaatctctctggtggctctgtttctatcctcattattaaagccaaagttcttacaatgacccacgaagtttgaaggttggactctttatttggtctctggtcttgtctcccaaacttttctctctccttccctcagctccagccacactggccttctcattgttccttgaaaatgtcagacatgctctgctgtagtgcctgtgcacttgctgttcctggaatgcctttctccaaaatagccacatgactcattccatcacctttttctggtctttcttcaaatgtcgacttctcagaaaagcctttcatgacaattttatttaaaactgtgccccttacttcctcttcacccttcctgttttatttttttccattgtccttttcattatctatgaacaatatattacatatgtattttgtgtgctatcttttctcgcatactaggacataagttcagtaagcagagagaatttcatctgttttgtttactgccatgtatggcatatgagggtggacaaaagccagtagcaatgttacaagtatgtgttgaatgtatt

SEQ ID NO: 96953 - DNA, 1046 bp, Homo sapiens
gaagggaaactcctattccaccatgttgctgatgatacccctcttcttatttatttatttttaaatcatgcagcttaaaatactgaacatctggatacctccccaaatcaacataggtcatgttcagtaaatttaagcatgcttgtgttagacagcagcttacatttagaattttttttaattgaagacataattttaaaatactttgctttaaatacattgaaactttttgaaacattttcaaagatattacaccaacatttatttaaacagaatctataaaaatcatatgcattttaaaatttgtttggtttataatagaagtacaagctcaaaaagtcgcattcccagggtccaatatctggcttggtgacttgcttattgtgtggctttggacaattggcttacctctgtgcatgttctcttatctgtaggataggggtaattgtagctacataatggagtttaagtaaggaggggttgacataggtcaagctcatgaaacagtagctggcacacagtaagtgttccaagaatgttggctcatactactagctttttttttttttttttttttgagacggattctcactctattgcccaggctggagtgcactggtgtgatctcggctcactgcagcttccacctccctggttcaagcaattcccctgcctcagccccctgagtagctgggattacaggcacacaccaccatgctcaggtgatttttttgcatttttattagagatggggtttcacaatgttggtcaggctggtcttgaactgctaaccttgtgatctgcccagcttggcctcccaaagtactgggattacaggcatgagccaccgcgcccagcccatactactagttttaactcaagtttgtcaaaccattgaaagggagagtttattaaataatttgaaaaattaattgtctaataagagtggtacagttacaattcagtgtccattctcaggagatgctaagtagcactggtcatagactcttgcctgaaaaagttgcccctaaaaaccacacagtcaa

SEQ ID NO: 96954 - DNA, 1934 bp, Homo sapiens
gtttgcactacgcacttgataaggaaaaaaattagtgtaaaaattgttaaaggtctctatcagaacagtctaaggggcatttcatgataactcaatctttttaagatacagttttaaggcaatattttaaaaaacattttgaaaggtggatttatgaatactgcttctttttagaaggtgacagaatcaaacacaaacatgaggtgttcaataaatattgctgactatattgatttgagccaaaatttcaccaataatgcatttggactgagtgtgtaactaatattcttggattaggaaaacaaagctcttagaaaatgaatcctagaagtttgttcaagattctgtcacctaatatgtagaaaatgtattgaagattttgaaatatctgtgtataattttctaaaattcatgtgtatctcctaagaatcctaccatattaataccagttgtaatgtaggtcaaagatgtggcaaatattttcttatatgaatttttttcaaaagtattagctctgtaattctttcagaaattctctgggacggccaattcacaaggaataaaatgtaaattttaaaaagccttagggcaaactactttcgttttcttaaaatactctgcttctaggaaggatgcttctactaaggaaaacaggaaagtggtataagtgatctataactatgtatagtttacatgggacacagaaggagatagatttttacctttgtttttcattcactgtaagcagataaatgtatatttacttaaggatggcttgaagtcatgttacaacttctattactattcttgtcattgtccacatttttcttaattttatcaagtgtggaaagagaaaaacagaaatagtcttccttttaatttagaaatgggccactataagcatacgcacaactcaaaattgcagtttcttaatgttatgcacttgattaatttgtatgaattcatgccatatttctctgaactttgctgaattgccaggtatatggcttggcttgtatctccagttataagccttggtatagtcacgcctgactagggcagaatggagaacttgcttctggcttacagccctcctaagggcaccatgcaggttagtgctgcccatgatgctctggtgtttggagatctgcacacacaacctcattaccccacctttaacatctatgtcacagatcaagggtttgcaaaccatgatccataagccaaaagtagtccaaagatgtatttactatagttatatttcattcttagaattttaaaatttaaatgcctttgtgtctgtatcctgctataattctggtccaaccagtccttgttttcttatccagtccatgacactcattgataataataacttggttcccaaagatatgtgaatttttcattcctatgaccactcctgttttctgtcaagtaatgttagatttctctgtttaaatatgaaatgttgaaatcctaaaagctattaataaacagatcagttctcccaggtgacttgagtgttttcagcaagaattaccaatgcaataatccagagatattaaacaaatggctgactgctcaaacattgttggcttgacagagcatcatgttgagaagatttctgagacgaaacccaaattcacaatgaaagactgcagtcattggtggccataagacacgagagacaggggttgtcaaacttctgtagtcccagtagatgaggatttaccaattatgccttgcaacaaagtgagttatgtacttgttgtattgccccaccatccttcaaccagattgtacttcttctagatggacctgcatcttaaatctacgtatccttgtgacacttatttcagagctttacaaatggaaggttatccatataattggaactgtgccagatcagaacaggagatgttttctgagaccct

SEQ ID NO: 96955 - DNA, 1011 bp, Homo sapiens
tactatgttgaatagaagtggtgaaagtgggcatccttgtcttgtttctgttcttagggagaatgcttagaatgattttatacatctgtatagttccttgagacagtgaattagaaaatttcatatttgtgaatttagatatacttaatgtttttgctcatcaactacctattctcaagttcatagaaataacattattctaattttactaatggtgtcagatatacttttactttcaaaagtgaaattaagttaatatgattttaaaatactttggagtacatttcttgattttttttttagacaattggaaacactcaggcatgtcataatgaacaggaatagtgtacagaatgtgtcattgtccacagatcctgtaagtaaaaaatgcaaacacaagaaaagggggcactgatcatctgaagtgaagtttcagccaaactccaagtttcaataaatgttcctgttccttttttatgctaaatattgtactgcgaattatataccaaagtaaaaactgtttgctacagtcactcagattccaggggtgattctttcattagaatgaaatatgtgccaataattttgactgccagatcattagcctatgaataatgacttttacaaagtaaagttctatattatctcatgatacagtaaaaagcatttaggctactccacaggcaaaaatgaatcatttaggggctgtgttaccttggggagattatacactctaagtgtcactttcctcatctgtaaaatagggatgataaagttctgtgactggagagttaaatccaatgttataatacattaaaatatttcacacaagtatttaatagatcaacaaaaatgcctacaagtttattgtagacatgattagtttatcattggcagctaatccagaattactttcaaactaatactttttcttttgtctattgctagtttaatcaaagttaattcctcacttatggaaattgaactaaattggaatacattttaaataat

SEQ ID NO: 96956 - DNA, 1039 bp, Homo sapiens
atgaatcctcttgatgtgatttaagttgtagattttcatcaggtttaataaataagtcatgtgtcctactttgagcatcactagaagcacttgatgctggtttgccccataattggtggggttaactttggtcacttgccgtgccatgttttacatgttgtgaaaaaaacttgaaaaatgaaatttaacaataccctgtaaatagcaccaatagaataagttggacaaaaatgtgcaagacttatatcataaaataatcataaacatggctaagagaagttaaaggagaaatagtccatattcatgaattggaacttgaaatattgaaaagatgtccagtcttcccaaattgatctgcaatctttaccaaaattatagcagactaaaagtcattcaaaaatttgtataaaaatggaaagaatctagaataacccaaagaaacatggaaaagaacacaatttgaagactcaaggcacctcattttaagaattactgtaaagccatagtaatgataacagtttgatatcagcataatataaataaataataatcaatgggacaggataagtccaaaaatagatccacacatatatgatttaatttttgacaaagcaccaaagtaagtcttttcaacaaatgagctagattaactggaaaaatatatgagaataaataaatattgacccctgcattatactgtgtacaaaaattaatttgatttagattacatacttaaatataaaagctaaaattataaatttttgagatataaacaaaaatatctttgtaactgtgagcaagtaaatattacaaagaaagaatacaaaaggcactaactataagaataaaaaataatgaatatgacatcatcaaaattaaaaactgatacactgcaaagcattccattaagaaaataaaaactgtatatatgtatatacacagtttccattaagaaaataaaaactgatacagactgacagataatatttaatacatttatttgacaaagaaattgttttctacaggtatgtacatatat

SEQ ID NO: 96957 - DNA, 1014 bp, Homo sapiens
caattaaacatctgcctccagctgtacaggagtgcgggcttgtgcctttgacacctcaatcctattctcctttagaagcaacaggcattataatacctgtgtttcccatgcactgtaaggtttaaaaaccattgctataggatgatctgattaacatggcttctggagggttttagaaataatttaaattcacctctgtttcccacaattccttgcacagagtagctgctcaataaatagtttctttaaataattgaatgaattgaaacattagacacattctcttaaccaagtttccgtttgatctattagttacttctttgataaagtgaaagtagttccttacctgtttgaaagggatgataaggagggagcatagtctaatgtttcatattgtgaacactggagtcatgttgcctaggtccaaatctggaacatacacattgtgtgatatgttacctttctgccctgtcctcactttcttcatcagtggaaatggaaatatgattataatagaacctatcttattcagctttgtgaggaccgtgtttacatttgtaaaagcacttaaaacagctccaggtacccagtaaatgcaatagaagtgctaaataaaataatttaaaaatgtgataaggaattgggtttaaaatacatattaagttgatatgcctattgagtgtcgtgctcaaaatgaagtttgcacccacatctgtggctgagtaaaataatgtaaaacaaatttttacatcataggtcaaagaagaaattagcagcggtttttgaaaatttaaaatgtaaaattttaggggctttattgtggagattatggcctcaatcaaattctggacaatttaatttgtttttaattttgaacactgaaactcaatttaggtgtggctatattgaaaatatcagcagtttggacaacttggactcccagtttctctgtgtacagctgtctttcagctatattaaaacaatttcagtatggtgtttcagaaaccactgtgt

SEQ ID NO: 96958 - DNA, 1001 bp, Homo sapiens
tacacaaaaatgccattaatgatgcacaacctcaactgtcctattagctggcatctattcattcgaaaattgcagaacttgtttctttgcaggtcatgtttccagagtaagcagaaggtgtcctagtgaaatgtcatacccaccaacattctttattttaaatatactcactgtgtatagtgtgagttacacaatattttgtcttaattactggctgccccaataacttcaatgatgaatttttctctgaagaatacttcatctcaaagagttaatactttttgttattaatctaaactttttgaaaatatcaagaatgccgattacagcctttaaatctttaccaagtaagattttataatatcattcgtgatttttcttcaatattagaaaataaaactaaatgttggcagagctaatgctctgctacagaaatgaaaattaatttcgagtgtaaaagaataaagtattttcataggtacttcttatatggcaattaaaaaataactggtaacatctaaattttcttttccagaaggtaattagagattttagttagactgtcagcatttaaaaatctataaatttaaaatataaagaatgaagatgaagcctgctcttttaaccactttagttggatggtgaaattcctggaaaagacaaaagaaatctcaggcattgaattttcattccagcagaagttatgtgtgctaacttctgttaaagattccaagaaacatggactaaaaaagaccagagactttttctaaaagtaatgacattattatactatgaagtgtaataaagactatgttatagtataaccaggcagggccttcttgccactaatcttgttgttctagaaatggaataatcaacccctcctcattaccacacccactttaactataactcaaggcagaaatcagatcctggaatttttaaatttttgttgattttagtttctttattttacattcatgaacactagtatcttgcta

SEQ ID NO: 96959 - DNA, 1034 bp, Homo sapiens
cccaggaggcgggggttgcagtgagccgagactgcaccactgcactccagcctgggcgacagagcaagactccgtctcaaaaaaaaaaaaaaaaaaaaattggtgccatttaccaaaggtgtattttgttctgggtaccattcaagagactttgcatgcattctctaatttagtcctcacagtatcagtatgataggaaacagtgctggagataaagacatagctgtgttaagaaatggtgaaaacgaatgaatgaatatgtaacaaaagataacaaatgaatatgtaagaaaagagatttttccagttccattgtgaatgtggattccaagaagcaaagatgtatgtctttaaaataaactttttttttttttggcaagataaacattttttttttttccctcaagactacattcacaaagaaatgctgtctcgatgttcaggaaaacctcctctgatactgagattgatgattccatggggctgcttctaacaaaagaactttctgatctgtgttctgtggagtttatgggattatttggcttgtcccttgagatagagctgggaggtaggggcagctactccaaaaggcctacagactcaggcccgccattgctggtgccctttctgctggctgttctgggcaccagatgcttcttcctgttgttgtgacagttgggtaggcactgtgtcttgattcttttcatcatcctgctgggcctgttcctgaacttttgacagtagctgctgcttaatgacagcaaggctgttggtgaaatagctgtcgcctgtgttaaatgatctataaatctatgatcaaacactgcagtcgggagaaagtgggtataaagttaaaggtggcccaaccatttaataagatgaaatgtcaaagtgttgcaaggaagcctaagtacaaacaaggcttaacaccatggtcatcagaatataaagacttccttattacaacatggggatgacctggctgcggttttcaaattcaacagtgagttgcattttttattgagtctcagaag

SEQ ID NO: 96960 - DNA, 1072 bp, Homo sapiens
gaagtgggtccataggactctttcctctgggaatatgaattttgagttaaatgttatgatgatttaaaaagcaacaacattgccttccaggagagattgctctttatttcctattacctggaacatggtcgctgctttttttgagtgtgcttggccaactatctcatactttctgtgtgctacacaatatccttttgataaatttcatttctgcttaagctaggttgtcattttctttgtttgcaacctaataaatctaactgacataatgcaatgtctttttcagggggcaatttgtagattcataggtgacatttacagaaatttcacaaattttcatttcaaaggatgggagcttggttgagtcaggtccttggcccaagccaagtaacatgcttgcgccgtagagtgggatacagttctaagcctcctggtggctacagcgttatgctgaagcacggattagtcactcccattctcatgatctgctgggttttatgtatagcatggttgacataaattcttatcttcttcatccttgcaatctaatattaggaatgttgatttcgatggaaaaaaaaacaatgtatgtaatggagatgaagtaattttagaaaacgaaattattacgacagcatgagatatttgtagtatatgtaggtgtcaaatgtcatgcagtttagtgcaagaagtatctttcctagatgaagtgaaatttagtgtttttaataatggagggagcatgtttggaatctatatgtttatgtatctgcataaataacagtatatttacaacttgagaggatgttcaatgaaattcctctctttttcttaagataattgttacacatacaattatgtgtaacataattaagtatgaattgtggaaaattgtctttctttaaaacatcaacagtaacaaagcatgacacaagcatttaataaaggcattattgtaaactttcttcattcctgagaaccaacagaaaaatctcaagagacagaccattaaatcttcttcctcagtgttaacttaggcagcagctcaggagacatctctgagggtgcaaga

SEQ ID NO: 96961 - DNA, 1104 bp, Homo sapiens
gatgtcttcctagatgttattttctcgctgattctttagagcatttcttctacctcgtctacttcagcctgctcactattcaaccaagtttaggtgtcttgttagcatctattttctacatacattcatcttgatggaattgggttgtgataagtggtacttctatccgtgtggactggctaccttccagtaccatactgttgatgattcattcatgccattcagtgtgaagaatgtgacaactttccatcaaacacattgcagattcaatagcaccaaggataacagatcccaactgcagagcatcattttggcatgtatatggagtgtttgtggggagggggaagaggaactctagagggcagggtatataatatcttttataagacagtacaaaaataattttaaaataactccgaatatatttgatgactaatggtccaatttgtcgtgaaattgcagatccatatttcactttcaggaatagacatgctatttcctttcagctatagacaaagcctctttcaggtaagacagtattttaccttacaatcatacaacgtcaagccagactcattgttctaaaggaactgaaccttctgccacttcaacaacctctaagtgctgactgttaactcgtttttcttttcatctgatgtgactgtgacaagaaacaaattcacagaagtgaaattatctgtgatagtggtctgctggatagatgaccttggaaaaattaatacaataagtgagtagtagttgtcactataatcagatctgtgccagagttgcaattagaaacatggacattagcctattgctaattcatagtattccagacacaaaatgctttaaggagtacttgttagatttgttgttattgtcaatgttttgtttgttaatatctttgagacatatggtttcagtaattttaagagttattttaaaattttaatcagctcaaccaagaagtgtgtgtgtgtgtgtgtgtgtgtgtgtgtgtgtgtgtgtgtgtttaatgcataatgtgattccaataaggcttaaagtggaggaatcttttctaggaacaagtacatggctgctttgacattatgtctgctt

SEQ ID NO: 96962 - DNA, 1051 bp, Homo sapiens
gacatttctgcttagattttttttattttgatgggatcattatatggttgatcatatgtgtgtaggaagctgctgtacaattaacttggagatctgaaaatgctttttgtcctcattgttgcagtttcaattgtaatccattgcatctcattttcttgggtgttggcactgtaatatattaaaaaaaaattcagtgctcagtattgtaacaactgtccctactgaatattccttttcataaatacttgctaccacagggaaattaagttttcatatagaataactagtttcagtagtaaccattgaagaattaaaaatgtggttcaaggcagatatttttatgaaaagttttctctattgtaaaatttgttgtatatggctatgctactatcatggaataagaaaagaacaagcatacctcaaataaaaaaaaattctgagttaaaaaaattgcagtttgatttttatcatgaacccgagttatctcatttttcccctacccttagcaatagtgtcagaaatgagaagctaaatctttgttttggattataaaggcaaaataataaacacacagtccctaggatattggtgaaaacttggcactgttgactgggtccagttttagacggtgctgaagtgtgagctgtcacttgatttgcagtgttcccaaaggaaaaggtagaacacttggcaaagctgccattgatttagaggctgagttacactcaactcacaaatgactgaatcctctggcatgggactgttaagatttccccctcgtgaagatgctattgtcctcccatgtgaagaagcactgctttataaaatgaggtggcagaataattgaaggtcagactcaaaatagagaggcctccataaatattttctcagttcagaaactgaatctattgatagctaaccgtaaacctaatgagtggagaaacaccaatattaagacataccttttagaggacaaactcattaccatggaagaaaaacatgcatatttctaggtaaccagttctatcattatttactaaattacgtacag

SEQ ID NO: 96963 - DNA, 1052 bp, Homo sapiens
ctgttggaggagatatggctgacctttgagtagatagtgctctcctgtgattctttgattctgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaaaaggaagtgaaggaaaccacttcagtattgggatcaatagaaattcaagaggtagttcataatgaccttatatgtgacacaaatggaaatactctacacttctggcatgcttctctcccaaatatttagaacattagtgacaatatgaaaaactttgctgactgagctgatcaatggaatgtgaaggcagtatactttaaggctatttactttcacacagaatgtttatctattagtcagtttgtattctactcaaatgcagatagacgggtataatgttttcttgtgcatttgaaacctatcaaggagaaaataaaccattccactaaaatacataggccaaacaccatctgggaaagtgataaaagctatccagaggctatgctatgtaaaatagcaaggtcaatttacatgggttgcatagtacttggctatgcagttttcaaaagaacacatccaaaaaaaaaaaaaatccaaattagttcctataataggtctttgtaaatttaaatatatttgtgggttggaaaatacgtttttagagacatttagaatttctttctctaaaaatgtatccaactccaagcagaaagagacttctgtactcacattctcatgtttcttagaattgggtagcatgatcattgaatctgtattttgcaaagtg

SEQ ID NO: 96964 - DNA, 1015 bp, Homo sapiens
ttatgtcaataactgcaagagttcttagtacattgctccttgataattaagtgaaaatgttcttaaaaggtacactggttaattgaaagctacttattcagtttgtgttagtgtctagacctgtcagccacaagacctgtttaggaccctgaaagtcacagtacctaaaaactatgactgcctttttattgcataggtggtagtggtggtgatggtggtggtagtttgcaagttatctcttaaaactgctgggaatggtgtcattctattcactaatctagcttatagacttgccgtgctgtttgatagaatgcagaggatagcaaccaaaacaaatacacaaataaataaaaacaaaaaccaaccaacaaaccaacttacatacacatatatatatccacaaagaacctctccatctcctccccttctttttgactccactcttgtcagtgcaattttgcttctcattttgaaatctgggctgtagtgctcctgctttatttctacctcagttttgttacatttctcttggaaagtaaagtagaaaattggaagtggacacacacactgcaatgtagcttgccaaacatgttactttgttttcttccatctttcaccgtaaatctagtttccaaagacatcagcatttgtgcttacttccacctcagtctaccagccccacccctacccatggcataagtggcatttttcttaatttcctatttttctcctgctctctgtcaagttgttctttgtatcctttaatgctttatgtgcaacctttcattgatagtgggctgatgtttggcaatgcttctgaactgtcacagagcaggctgtagctttccacagccactgcccatgcataagcagaacagcctggccttttgaatgtattttcctgggttttttccccttttctttttttagtttagagatgcagtaacaaaactgttgcaaagcactggcattttatgtattcaataaataagtgatgtacatttttaaaaaaatt

SEQ ID NO: 96965 - DNA, 1049 bp, Homo sapiens
aatatatgtagcatttgggatcattgaatatagactctagtaagctctataggtccctgagtgtatcactatattatagcacattacaatatcgattcaataataatgatgattagtcattaaaacaggttaggaaatactgcatctattctatttttttttaagtgtaggtatgcttaagaaaggttttcatcacaaataattaaatttcaagcctttctctatgtgtcagtctctctccttcccttctgccctctgcatagtctccaatgtaatgggatgagcgcatctaggctgtgaaatcaaatctttcttccaagtctggctcttccacttcctggctgtgtgacgctgggcaataatggtactcagactctctgtcagtgtaatgttgaggtttaatgagataagtgatgggcaaattagttagcacttaataaatgtttttcttccatgctccgcagggataagcttcagttactaacattttatcatctaaatttcctcttgtaaactcactattcgtgccattttacccttggcttcaattctggttatctattgctgcttaacaaacaaaataccccaaaacttggtagcttaaaacaataacatttcataatttctcatgattatttgccttgactaggtgcacatgagcaattcctcaagatgacgttggctggggctgcagccatgacaggatttatgtgttggaatgtccagtgtggtccctcaaatgctgggtgcctagatggacagctggaaggctgagctcagctgggacacggaacatctgggcctctcttgccttagtctcagggccttttctctctatgtgacctctccatgtggcctctgcagcagggtgggcagacttcttcacattaaaagtcagacccccaaaagcagaaaaggcgaagctgttaggactgaaagtttggaactggcttagtgtgtcttctgctgaattctgctggggaaagggaataacagggtctgactcagacacactgtgggagggactaaaaaatatctgaggagtatgg

SEQ ID NO: 96966 - DNA, 1099 bp, Homo sapiens
tagaaaaatcctatccctaagtagaatactaattttctagattgattcttaacatttttatttagtgaaagtgtgtgtgtgtgtgtgtgtgtgtgtgtttgtgtgtgtgtgtgtgttggttaatggatatggtcctgtcatcttcctctcttatggaattctcttatgtgaattgcctgacactaagtgatctaaatttttaaatacaggcagaaaagctgttattttttatttagcttttacagtgtaatggaatttgtgacaagattatttgctacaacgttattttgttcttgattagtgttctttgtaaaggaccccgagctatgtgtacaaaaggctgtatatgagctgcggatagaggggcaggtgaccttcattcaaacatatccaagtagtcattaacaaagttttaagcatttgaacttcctaactggaggtatgacaacagtaattgcagatgtccttaagatagctgtacacattttgatcaatgaatatcctaagttcactttgaaagaagcaattattactaggtataaggtttgcttaaattatgtcctttaaaattggcatttagaaacttcttgggcaaccctagcctgctgaatgctttggtgctaacaataacatggtacggtgttgtacaacataaatacatttgcccacgatgtaatgacttgctttcaaaagtcttttatctcctaaacagaatgaactgagtttagaggccctaccaatattgtagctctttgagtcagacagtggccaccagcagagtatcaacaatatgaatttgctttaataaaggttagctctcattttttaaagcattacatgtcttattgcatatagaacataaaattttgcaaaatatttaaggtagctttgccagacaatctcacagctctgtaactcctcctcaactgcaatgcatttcctaaattactgattttcaaatgtatttgaacagttgaacttttttttgtgttgttttgttttttgagatggagtctcactgtgtcgctcaggctggagtgcagtggcttgatctcggctcactgcaacctcccaggttcaaatgattctcctgcctcag

SEQ ID NO: 96967 - DNA, 1050 bp, Homo sapiens
tatatatgtatacatatatatgtatatgtatatatatgtatatctatatacatatatatgtatatgtgtatacatatatatgtatatgtgtatacatatatatgtatatgtgtatacatatatatgtatatgtgtatacatatatatgtatatgtgtatatatatatatatgtatatgtatatatagtttgttgctctttttcagtcttgggctgttaacaaaatctcagtcaagtctgaatagtccaccagaggtggaattatttgctgtgttgcaacatggaggttgtatgaaattaagtcttgacttggctatctcaaattgtaaaagatagaatattttctctttgtatgttgcaggtattattaattgatatgttgtcagcacttccataaatatttctatgctgtagtgatttttttcctcactgaaatgtatgctgtgacaattcagcacatttctccacctattagatcagataccatcaatgagaaggaagtaaaggagctcttacaaggtgcatcaattctttcacatctaaattacattatgcagcattgaatattattatgaaagtttgcagaataatagagcactacagaaatatttaggctatgcagaggccccagaataacaaatctcttaagagggagttgatttcttttattcaataagatcagactgtgataagtcattttttcccttaattttttttattttttgtttttttttatttttttgagatagagtcttgctctgtcacccaggctggagtgcagtgatgcaatcttgactcattgcagcctctgcctcccgggttcaagctcttctcatgcctcagccacccaggtactgggattacaggcttgtgccaccatgcctagctaatttttttatttcagtagagatgaggtttcactatgttggccaggctggtcttgaactcctggcctcaagtgatcctctggactcagcctcccaaagtgctgagattacaggcataagccaccacacctggcctctttactatgcacatgccacatgttttg

SEQ ID NO: 96968 - DNA, 1017 bp, Homo sapiens
ggcttatagtaaaaatcctctctagttacaaaaaactgcaagaaaacctagaaaagtgaaattttgatttttggttactttctggaaaatgtttatgggtaatcaattttttaaactacatgggtaattttgtgagttatctttcagttattaatatgttgactgatcacagaccagtgaggggtagctctgtaaatgactgtaaatctaccaattttttattaaatcaggaggcaaaggatagcgtagtttgtcccaagatatcactgtgtagagctctgagttcagaatatacatacctcccaccccaaatgcttaagatgtatttccatgatcgtgagtcccttttctgcatgtttagattcttctgcatgatctcttcaacttccctaaatggttagtatgccacagaggttgattcctttttatctatgctttttgtttttgctgccttgtatttataaaacctcctcaactgtgctacacatggaatatttgccaattgagagagtgtagcaaatggatgatggcagctaacagaggttacatgccacaccttcagcactcatagaaagtgggcacattgcatctctgggcgatcacaagctggtgcaatatcttgtaaaatactgtttgccaagtcacgccagctggatagataatgggaatcaccgtgttatatagtagttccagttccagactgatcttgatgctatggttggttaaatattattgatgagctaattatgctcctaaaacaaaccaacagtattctttaaaaaggactctccaaaaataaacagaaatacagacaacagtcttgtcgtaaaggctaatgtctttttttctctttgccaaatttgttttatgtattgtgcatatatatcaaaagaactgctttagatcaggtgtttaatgtattttgaggaagatattaaattgctgagaatacttcattcattacaaaataaatatacattgtggatgaatttaaaagctagacttttaataagttgg

SEQ ID NO: 96969 - DNA, 1036 bp, Homo sapiens
aaaggaaaatgtaggaaatcatgttttaaaaaagattagcttctctgctgtccagcatagtagccactagcctcatgtggctatttaaatttgtttaaattaataaaataaaagattcagttcctaatttgcagtagccacatttcaagtactcactagacacatgtggccagtggctgctatattggacagaacaaatgtagacagaccatttacaccattgcagccctgaattctgtgctaattgagaagtcagtggggttaaggtatttgggataaaattgttcatatttgcttggatgttatgggtagttatgtttacctatttgcatgtcttgcttaggaatccacagaaacccaaatgaaactttgaaacagtagagcttcctattttacaccttttatttcctattccatgcagggaataagccatatcatctttcagatagataaaatctggcagagccatgcccattctgcaaacttgatggttcacatccttcttgagacagattgtttggcttaaagtacacgtgcaagagtcaacaaggatattgttgctgtcaacaaagtttagcacataagcagagtgggtgacactgtgagagtttgaaagctatccctccctcctttcattgaaatatattatcccttgggtatgtacatgttatcagttactgcctttattaatatttccttgcatacatattttgagtgctaattcttttttgtattataaactatggaatttccatttctgaatatcctctaaattgtgatgaggtacatatcttggatagtacaggtaaagggctctcaaaaggatgacttcaggtactgttcagatatgtttcaggctaacagatgactttggctatctgtgtaaataaaattgggtatttgagttttaagacaaacttaaccacagagctgatatttatcagcttcaaaatatgaactgaaatacttttcaagttttctgatagttgttacaaaatgacatttattattttaatattcttggtcacacatttca

SEQ ID NO: 96970 - DNA, 1010 bp, Homo sapiens
gtgagaaccagttatcagtattttttaaagctccccaggcaattccaatgtgcacctagtttgagatctacttcccatatctatctgtagtaccatattggatttacaaattggaatgctatttttgactccttctttgtctcctttctctccgtttaatcttaccaagttctgcagattctccctctgctgtattggtttgacccttcctatccccagtaatgctagcctagcccaggcctttatagcttaatatctagttttcttcttctagtccctcttaaatggtgttaccagacactttcgaacaacaatctttgaaacaacaattttgtcatttcacttaagaacctatactgttttagcatcctaaaattcaggatttttgtaatcaaactctatttacaaaactaatcttctgatatcttatatttcctattgcaacactttacgagtagaagagaattgaggattcaggaaggtgaattcttttaaaaactatttcacttgtaatcctgggggctttgaggcatgggctggggaggaaaagggagaaagatgttcaacaaaaggcatatccaggctatcttttcctccaacccatatgtctccctttagccagaccaaatccagtctggtttcttaatatatttgggttgtgcttaagatttcattagaacagaaaagagtttcactgctaaaagaaaaaaagaagaagaagaaactttgacaacccctggtggctaatcctctcatttcacaagggaggaaactaaggctcaaagaggttaagtgactcatccaaagtcatatagctaaaatgtgccctttgttcctgctagcatagtctcttcactttctctgaaaagtaagaagaaatgtcatgctagcacttgacacaaggccctatacgtacaggtgttcagcaaatatttgttgaatgaacacttgaatgaatgctatttcatatttctgtttctgttcacattgttactgtaacaagaatgcct

SEQ ID NO: 96971 - DNA, 1436 bp, Homo sapiens
tacacaactatggtaaagatgataatacgtaatcttacctttgggtagctgcttgcaatttatgaaatacctttatatccattactttccttgcttctcacaattccaagaggtaagcagactcagtgctgtaattcacatattacagaagacaaaactgagattaaggaaattgcccaggtcaaacaattaagaagttgcagaggacttgagccctgagctactgactcaatagatattttttttaaccattacatggaccttgcaatttattagggagataagaaatgcaaatttttttcccttaaatgcatgtgtatctttatatagagatatatttccttagtaattgtactataagaaagcatcaagaaagtgtctaaataaagcacccagtgaagagttgtacatctagtgtgttccagaaatatgaattgattagacttgatatatgtctattaagcacttggagagtacagggcactgttttagagcccttgttaattgattatcatggctgtgtgttgttttgggccctgggccctgtttcagtgagaagatagagctatcagaggaaaagccatcagtagttttagacactagacttctctctgctttcacaaaatgccatcccagattcagaggcatttcttatcctcaaatggaacatcttcacataccacagtgttccatttccctcttccaatggcctccattgcttgtaaccttgactgaactctcccctttttgcattctctataaatctgctagtcaccactcccacaacatagcctattatgacattgctgcaacctagcctctgaattctggatttcatcttctctcatccaggctgatgtgttctgaaactagagcttccagacccttctgagttctcactgtcgccattctgcgacaaatcctgcttcttgttatcctatgaaactatatttcagagccctgccccagtgtccccttccttctttctcttcttcaagtgaaactgctcaaagacctcattattcacatgcttccacatctgtacccttaacagccttccaaatgatttgaacagcctcacttttttgtcagttacataaggaagtgccttccttatgtcactgtggtgaaattattttctcaatttattctgtttcaaaaagaacaaaaaatgttcctccagcgttataactaatcacaatgtcaatagtttactaggtgcataactggtgcaaaatgcgaacacaaggcatgatggcttttctgtattttagaatctgtttcaggaggggttcttcttcttctccttccttctcctcctccttctttcctttccaattttctgtatctcttcttccaatcataatttcatacagtcagtcatagggtaacacaaaaataacatgttcctaagtgcaggtaaactcacctcacaa

SEQ ID NO: 96972 - DNA, 1085 bp, Homo sapiens
agtttcagttgcccagcagtatcattaaatcctctggagtgattccagtcccacaaaaattagggacccctttacattgtttccatattcaaatggaaatctttttgcaagttagtaattaaagtatttaacctctctctccctccatttattagaaaactcttttttctttattttttcaattacaaaaaaactgctaaagccaatcaagcatttattttgataaaccgcttgtaacagtctcagctaaattctgcaaataccaaaaaaaaaaaaaaagctaaataatcaccctgagcagattttgcggagaccttgctcaacctgttcagggataattatgccgagcttttagtatggggcaaaggaaaacataaaattaaggcatgaaagaaagtctacctattttgagaaaatactgggataattggtactctttttattaccattttattatagaaagatattgtcttgtcatgaaatataggtttacagcaatgaaacagtactattcggggtggaaagaacttctgtgttagatggattgatttaaaatgtaataaaaatagcaaattgctaaatagtgaatcgctaaatagtcaagttagagttcattatttaaatgactcctttttcttttctttttaatcatatgatgttcataattgctttgtttctgacaagtacgttacagggacttttttcttcttttttcttttttctttcagagtagcctttggtttggagctacaaccataactttctttgagaaatggaaacatcaggaatggtaccactacatgcaaggtgctaggagtagaaagcaatagacagattcacaatgttataaatggtggtgatatgaaatgtgaccctgataatggttatgtggtgctttggaaatttacctctcttacagactttgtccttttgtatgtgaaggtgacactgaacagtgtgtctgaacagaatgatgtgtaatctgtagttctttatatcttatcagctgcagatcctggttttgtggagcctgaagcttgcacaacatgggggccgtgttttaatgagaacaatagtacaaaatt

SEQ ID NO: 96973 - DNA, 1507 bp, Homo sapiens
tgacacaattcctttctgcatcgagggtattttatttgctggaacactaatgaccagtactagaacactaattgatagcactactttgacacagaatttttaacatttgtgtagaaggcacaaaacttcaggagagattttataaatatttgccatttgcttcacagtacagaaacaacctcagtcaattgtttattagttttaattgaacatttcttattcaattaatatttgtattattattttccttatgggttgtcatatgataggatatgttaacatttgtaaggcaatgagaaaataaataacagtttacatctggctagtgtattcctttttatcctagagctttcaagagtgagagtaaaaataaattgattgacctgcccattttaaaacaccattctatttttttctcataaatatgaaaagaaaacccaactttcattcccgaagtatgtgttttatgtttattttaccttgttataggggctgggcagatactgggaagaaggggcttctcgggtaatggaatctgaggtctgcaaagtcctgttcagatagatccttgaacacatagtaaatcgcttcttgagtgggatggggaatgctgtagtttataaggtaggattacctttcaaaggagaagaaaaaaagtctagatatttccaaacctttggtctttctccagcatactgaaactaaggtctgcttgattatctggcctgggctgtaggtcgctgatgatttcatttgtgatctctccagatgaactcttttgtactttatatttcagcttagacaaatcatttatttacttaataatgtgcatgtagtttcaattaagtgaaagatgatcccatgtaattagctagttgtaaagtggattacataaaaaactggcatggaggctgttctatagctaaatattactttttagaaaggcttccacctcaaaaagagtgtctggattgcccaaggagtgtctgggtttgaatttgggctgcacaactccttactgcaaggtgatgtattccttctctgtgtttgccaaggtcaaagttatgtgatgcacgtggaaacttggctttctaaggaagccatctgagtcctcattatggcatcagaatgtatgaagacttacactctggtatgcataaggacacccattgccgtatttacggtaccttagactcttcaggaagaatctattttgagaactttacttttgtcatcttatctcacagaaactttctatatcgttgtgaacaatgaacaatagtctatatgcaaccattacttcttaagcattaatatcatatgtaacttctgaattcctttaacttccttacttggggtagtatagtattttgtttgtggaagcaattctagactcctgtgtctaccttgtttttctttttctccccttacagattttgcctttcctccctccaaacctcagcaccgtccactcctgcccccatctagcaggattctcctaacctca

SEQ ID NO: 96974 - DNA, 1102 bp, Homo sapiens
aaatgtcttttggtttatatacagtagtgcctctgttttatatttttaataaccagaggcaggctctgtgtgtgtgtgtgtgtgtgtggtgtgtgaaagagacatctgtgtgtgtatgtctcatatataaaatcctttatactgctgtttatttaggcatttctttacagcacctttctgaagactctgatgacatagccacttgtactgataattccactacttcacctttaccgaacttgattcactaaggtttaaaagaacaaggctatcattgctgatcatatgtgctacttgttaatcccttaaaataaaattcagatcctgtgggagagaggtgagaagaacaaaacagagatttgcaaaattggtgtaacagttttatattttactgaatttaaggacaatgacttctgtaatatcacttaaataagatgcctatttacataaacaaaataaacaaatcttctaataaatattacttaagctacttttcctcatcctcagagtttttgctaaaatattattcatgtgactgaatctctgaccagatacgtttattaggtgtttgtctgtcatgaggtgaaaatgggcactatttcaccaacgtttactttagaaagcactacaagaaatgattactataatagcttttgcttttaatggttattaaataatcaattagagtattttaaataattctgctgcataatagtccatttcttttggaggttgtttgtgttaataaaaataaaaattgctataatgtgattgatgtttgattacattaacattgtatttgaattctttccatgttggcaacatgaaaatttatttgcctttattaaatggaaaaatattactgttttattttgccttaaaaaaaacctcacaacatataaccaagcatttgaactcagcggtttttattttaacaaacaattcaaaaagtttaggtgttcgtgtattaatgttgcctttaaaatagcacttgttatctttctatatgtatttgattatatgtcttacattttgtacttggaagaatgaattcagtttgatagaaaatgagagtaattgatataaagtgcatttcaaatta

SEQ ID NO: 96975 - DNA, 1009 bp, Homo sapiens
ttgggctgtggggctgagtgtgcccagacatttacttgtgtgtttgtgtctgtgtgcctatgtctgtgtatgtattgcttatgtgaagaaagtgattgcttcctctctgccttctccttgtgtctcccttcttaccgccataattccagtcacgtaaatcaaagtaatgtagatgtaaataaatcaattcaatcacatcatcctaaatctttttattcacttaagaaataaacttaaaatccataaagtcagacagaataaagatttgtaaaagtatgtaggcttcagatcggaatcgtggttttcttcattgtacatattacaatgactagtggctagccaatgcatctttagattattctcttgtcgtatcttctgcctaaaaaacaccttaacaggaaattagattgagtatatgtacaaaagatattgacaggcaatgattattcatatagctgctgttgaagtatggatgttgtattgagggtagacctataatgaaatagacagaagtaagctgttacaaagaatttattcaaatggaccaggtaaggcctgattttatagttatccatataatctgtaatatgtctctctctctctctctctctcactctctctgtcttatatatatataatctgtttattatatcaatatacttaggcactcgaaacatacaatctctctcttgctttctaactttcacttatttgatatggggattttgccatacagcaagaaaagttgtttaaaatgggcagtatattgagttcaaaggacccatacagttcataaattctctggtgtctactggatttttcatcagggagacttccaataaaaatgatctattttagaaataatattgtttagtaggttgaaatgtggtgtaataaaattagaccttcagtcttctaaagttactacttagatggcacccttgggatggtaaaatggctgtataagcagatgaatcagacagttccactgatgggtacatttgtcagt

SEQ ID NO: 96976 - DNA, 1061 bp, Homo sapiens
taataaaaaaacttttgcctaagccctacaccagatcagttagatgagattttaaactcctcagatgattctaatgtaaaccaaacatttatatatatcaagagatcttaaaatttttaccttttaaaaaaatgtcattcttcctggtttgaagttagaaaaatgaagatatctattcagaactgaatatactaatgacatgtacagatagctcatcatccggctgaagttcaacaacctatctagacttttgaaaacatttctgtcagtcttgcaagaacatctcaggaaagtaacgatgatgaaggacagtgtcagcagaagcccacagtcgaagatcattttgttaccttgggtaagccattcaacctcactgagccttagtttttagtttacttttttataaaagaagagatgattgaggtgatccgatgatgactaagatttcttgcagttttgtatactccatgactgctttgtcatggaccagtgaactcaagtaacttggaccttgctagtcgtctaaaagatgcaaaatatttttgtttctcttaagaaagctccaaaaattatcttggaaacaatgtagaaagctcaaggaccatttattactttgttaagcccatcagaagagatgataagcattcattaaatatgcttactaattggttgcatgcaaaagtgtcagcaattctaatatcttaagagttgatgggtattagttagctaatgcttttctcttgtaagagatttcaatagagtggcaatcagattaacttaagcagtggagttagaaacctcaaatccttaaaatatttagtatgaaaggtggacttttatcaaactgaaagcaatacttttttcctgtactttatcagcaactagtctttgtccaccttctttttgcttcctggcatgttcttcttcgcttgttgaaatcctactaggactttggtatccaggtcagttgttgcatcatccatgaagccttctttgaggcaccctaattaggattgatttcgacgtctacttaattgtcccttagaacatttgaaatgtct

SEQ ID NO: 96977 - DNA, 1081 bp, Homo sapiens
ttgcaatctatgtgataaaatcatatcattatacataaagtatttaataaaatatataatagtatatgttaaagttttaaatatttgaaacaattatgtgtctttctgtgtcattacaacatttgaagattagatcttaaaaatataatttatagaacatattccttggcattgtagattgtgttttgttaattattggttttgattgtggtttcatattttattttaataccgattctgggattgtcacaatctagtataaagatgccagtgatttgaattttaaaagctacagtatacacatgtgagctcttttgcattctggctaacaataatttttttaagttccaggtcctttaaaagcagactgctttccaggaaacccaaaaactgcaagccaaaatataggtcgtgtgttacattaactctagcactgcttttcagacttatactaaatgtaacttggatatttatttgcagacacacacagacacatctttttccttctttaggatctaattttaattttgtgtgcattaacataagaaatgtatttctgaacttaagatttatgttctgctatttttgctgcactccttaagatagggtatattaggaattcagatgtatgcacatgtgttacaaatcagttaatgtgcatttttttaatctacattttcacttaggttaaaaatatgctcttcatgtatgtgaccagggaaggtgcatttatcccacatgtaatgtagtagatgaaatgctcagttctaggaatgaagcatgaaataatgttgattatgaaacctgatagactatatagaaaaagaactccaattttgtagttacgtcactttaacttatggaagaataactttccatctttgtatggtattacttttaagccctaaaataagaaactaaggggcacagtgaatttttataaaagcaatcatgttaagatgaatgtttttacattttttcagcttactcttatctttcaattcatatgtatataaaaataataatgaattttattatattaatcctttcctaaactcctccaaatttcttttagagtcca

SEQ ID NO: 96978 - DNA, 1014 bp, Homo sapiens
agtcttaaatgcacatgaacctgtcaaaattcttcatctcttaatgaggtgaattgtccaaccttgaaataaatactttagttttggcaccatgatgagtcagagaaaaaaatagttcccatatacttaatgcagatgtgttatcaaacttatattatttacacagtaataaaaggaaattgagataacaaaaagtacattatgatattttatacatttttttctttctagacaacagtctgctttggtataaaaatgaacattagtaattgaaaattgatgacaaattttatcaatctggctatctcataattaagttgaaatctgctatgtttaacaaagatgcgtaatacattttatatgtttgtatgtgtctgtgtgtgtatatatatatatatatatatatatatatatatatatatatatatttgtctatctgtcaacatactcattgaaacattctttacagaaagaacaatagaagaccacgaactggtgattgaagtgctatccaactgggggatagaagaagaaaacaaactatactttagaaaaaattatgccaaatatgagttctttaaaaacccaatggtaagtgaaatccctcctaatagttacggaaaataaatgaacccgttaaattttatgtgaagaagatagtcactgtaaataaaatacagtcctattcggtaaattgtagatgaagactctggtcctttgaaattatacccatatttcttatgctaacaatgattagtgaacattatacacagaagttcagatacacaggtgcaaaactttttaaagccgtattggtaaagtctgaattgagatgaatttggtttatttaatttaaaagtattaggaaacctagttttgccttttgtgaaaaggtaacaattatacatttgatgtgggaaatgaatttctataggttctcacccagattaggaacaagtgttaagcaaaatattatatcttaacactttctatagaatttaggaaatttaaata

SEQ ID NO: 96979 - DNA, 1018 bp, Homo sapiens
gtggctggaaacactgtaagaaatgatcttcactgggcattttattttatctcattttgcatcctgcttcagacaaacactcaactattgagaaacggaaactctttgccatctagtattatgcaagtgaaatttaatacctagagtgttagttttaaaataactgacttaattttttaaatgttttacattattcatcttttatgcaattttatattctaatatatatcatggtttataagcagataagatgatgtattgtcatatacttatgaaatgtacaggtacatattttgctattttacttaattttaatcctagttattttacatagagtatgtaaggttgtaccctctgttgtaatagagtatgtatttgcaatgtttaagaaacatccccctttttagatttttacacaggttgttatattttattttcccctccattttcctcttatatttattatatagaaagtggaccaccatgcataattctacaattgcctaggaacagtggttaccatggcatttgcagtttgctgtacagaatacagctgtctatacttccaaaaatatgactggtttcattcagtagagaaatgtaccaacacagtataatatttaatctgctcccctttttaaggctttcctagatataatacatactttgccactgtagttttcatcagattttcaaagggtcataatcacaataacaaaagcaatggtgaatgcttatataatgcttactaatgtttcagacaaggctctaagaacattacttatttaatccttatgacaaccctctgggccattacattttaggtttctgacagttttagcctaaaagaactatgaattatgaggaattaataagttgttaaactttaaggaaaaatatattattcaaagagcagtaggtcatttgtggaattaatatggatttctcattcttgtctattagtatgtaaaaagtcgtacctctctaaaataacatgctgagttaataaaatagtatt

SEQ ID NO: 96980 - DNA, 1053 bp, Homo sapiens
attaaggcaaggaagtagaggatgctgtcatagaaaatgttaagaatggtgtaccaagctttttgggaattagcagttcaagaagtacaatggaaatcattagaatggtgtgggtaagggttggtgacaaagaatctgggaaggtgacactgaagccattctgggaagtgattctggatctctgtctcctgagggagacagggctgcgagatgaaaatcctgcatacgggttctttatgctgtgattccagacttttaaaatttttgatttttttagtgttatcactgactgttgtttgagcttcttctcctggatcacccaagaaactgagctgcttgctgttttccaaaccatctcctattcctcctgcttctgttcatacatctagttttccagaaatgtctcagttctacttcaacatctcaagttcatatcccataagaccatgtcaacgctcacctcctccagcatgtgactctccatccctctgcccagttatatgctctgttttatttggcatgacttttaggacactttgtattcatgttattttgtgtgtatttgtggcaggactctatatcttagtatagctcctatgctctctagcaaggtgccttgcactttacatgtatcaaagtactgtgtggaatatgagcagtcagaaaagactccaaacagagtgtaggaaaagccctctgggtttgtgaagttttgatccacgtatgaaaatattcttaattcatttctatatgcagcaaattcaactttgttaactagaattagttttatataatacatagaaacactggaaatcaaatttaagacattattattcatccgaaaaattagatttaccatcttttttaatgtgactgcttcatttcaattccttaatcaaattagctgcctgttttatacctgcttggtacttaaaaaaaaaaaaatctaccttttgttgcggaggaggatttcctctagctatttattttgaatcaaaggagacatcagctgtagcctatgcccctgaatcagcttcctattttcttctttga

SEQ ID NO: 96981 - DNA, 1172 bp, Homo sapiens
taagaatttatacattttttctaaagttgaggtatagtttacttttaatggaggaaagactgaattgaggtattttgtatgtacatgtctacctgtttttctttatatgatataggcaaattctgtctttttccccctctttctctttaaccaagtaggacttcctatggagatactgtgtcctcagaaaacttttgaatcaatgaattattgtgggaaaaaagaaagattagcagaaggaataccttattgttttactctccgtcagtatacatacattgagataaacgtatatggaaaattttagttgatttattcaatgactatttattaaacatctatgtgtcaaactccatcaggatgagagataagacacacccaatgccttcctcagagaagattgcttaattgatcacctagcagaaagtaaagactctttaattttatatataagaataaaagtaataatacaaaaatcaattgtttattaagaccttattagatgctaggtctaatgttaggtatgttgaatatattaatattatagcattttatccttatgtctgtgtgtgagagatactactatctttgtcccgatttatcagatggggaagggtagaggggaaccaaagagacaatgagaaatgaagcagcttctacaaagtaattcattcttgctaccttactactctgattcatctatttaaattatatattattttagtgtatactgtgtgaaggatttttagagattacttttccaaaactttataaaagtagcattccttgtgcctgttctgaccttgttacacagacatgggtctgaatgaaggatgtgccgttttcttattgggtaaccttgagaaagttacttgattctcacagcctctgtcccctagcttataaaatgtaaattacaacccattttgcagagctgtgtaaagcacatgctggtaagatcttaaaattttatttcccagtcattttcctcttatgcatttccataaaatagctcaaaataatcatgtgatcatataaaaaagattttgctgaaattttcagcttgactacaaacagttttcttgtaaattccttgtggtgttccagcagcccaataagttcagttgtgatgctggagagtaaacattggagttgaaattggaagccctgta

SEQ ID NO: 96982 - DNA, 1049 bp, Homo sapiens
ctcaattgaaatcagagctgcaggagtaatataaacaattattattttttaaaagtatggtttaataggacagaggttttcttttgtaatgacttcagacttgtagaaaattcctttgtacataaaggtgtaaaaataccacatatttgaaaatagccaaagtgtttcagaagcaagcctctgaaatgtggttgaataagaagctgagttatatagtagtttgggttcaaaatatggctgtacttataaaatctgatttttttaaatatgatgtgtaggttgactttaaataggatcgaatgctaaggcatcagaatatgtctttaaaataatattaatcattagaaaaattacattgtttctcagtgtgattaatttgagggattaacaccaagtaattggtaggtattctggtatatttttaaaaattaaatacaccattttaccttatagcctaaagtaaagctttacatcatagcttctgtaattacaacaacatatatttttaaggaagtagagttaagatgctcaaatctaggtgagacatttatcgacattccttgaggattccatctctcgaatctgccttcatgcacatgcacatgtactatttctggagaaatggaagcgaggaagtattagatgagcccaaggggagtagcgggggctgaagccaaagttttaatagctactacagttgtgtattgattgagatgtgctggaaaaacaggaaattgagctgctaaacaggaaaatgactactatcctaccattcccagacctgattggctgtgccacagtttctaggccagttaactgtaatcaagataattacaggagtcattgaattcattttctcctttgtgctaagatgaatgcaagttacacacaaaatggaagtgtccgagggtagagcaactctttctcttttttttatgcctgatagtcacttgctgtattactgctttaacagaattaggaaagagacagggtcactgtcttataggacaatacctgtatttcctggtctgtggcagctcccataattc

SEQ ID NO: 96983 - DNA, 1047 bp, Homo sapiens
caagtgagtgatctattttgttctgaactctggctctgtcaatgacaacacacgatttactagaacaaatcaaataagtgcatttgactcccattttgacatttcaaaacagttaagccatatctccttatgcagcaaatatattcatatttttaatttttactttttcttataagacactgttgtcagaatgagaatgaaaataacgacttagggtagaatagttttcaatgctttccaacattatggggagaataatttctgcatggatatgataatgtggttcaaaaatttacagcccccccaaatgactttgagactttgactatgcaatcagcagccaaatatttcaatgcttcattgctcctgttcctgttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagtgagtatctaaaactctgtttcagttgtgctctaaattgtgttgcatgggccactcttgggggctttagcttaattcactggcttgtatctgctcttaaattcttcctcatatcaaaatatttgtaaaacatgacataattttggttaattaaacttcagcagtatacttcttctcatttctatggagtgagtatgtaggaggcagaaatgagtccaatcggaggtaagcagacagcaactggaaataatttaatgagtgtcttcagcttgctgaaataaatctatcttttgaaatctaatcagttaagccattttgaacgtctatagattggtcaatgagttacacaatatttacagtgctgagtgtaacacatttacttcctagatgagaaaatgatgtttcttttttaaaagattgcttatgtgaaatcaaggccttgaaagccttgagatcctatagttgtttggacacagttaaaactcagactcaaggc

SEQ ID NO: 96984 - DNA, 1053 bp, Homo sapiens
acccctagctccaacagtttagatctccaggattattttaatatgtcaagtatgtgtccatttgtgctcagataggatctctgtcaaattgcatttcccaacttccatgcctactcccttccagatgggttcagcaaataagatgccttggtgggaaaacggagggcaggggtaagggatacacaagaatattctcaccaacccatccgtgcctcagatgatatatctagtggctgccacatcttctcatgattcaggccttgttgcaatggcccaacttttatattcatagcccccatgcaacaacctctccagggattcggctcccagaaggcagcacccactcttgatctctggtgacttacatcgcctcttcctttgggcctccagtctgaggggtggcggcatctacccactgttgctaatatctgagtttctttttccttttttatttggggtctcagctccctcaaaaccattgtaactacttccttgtatgaaatttcttcacacaggaatcattagaccacccgtcacgaactctattttctaaactggaacctgactgacaaccctagcctgggccgcatactcttcactgaatcaaacattgtcaccagtggatgaggtcctttgattgactgtctcattcatttctcccttgtagtggtaacaagaaaggagacatggaatatattactagaaaaaataggaggaagaaaaatgtgttgggccaccaataacaatggaccccatattagtaattcactttgatctcgtagttcataaacatgaaaaaaagctaaactaaatattttttcaaaacaacactgcaataaaattatttgtaagtgaatagtggaaattactcatagccaattgcttattaaatttataaatattctatcacattctgttccgttttttaattttctggttaataaaaagaactaatatattgaggatatgttgtaagtcccatgatataaaaataagtaaaatgttttacttattttcactatatagtataaaatcagagttcatatgcccata

SEQ ID NO: 96985 - DNA, 1029 bp, Homo sapiens
aacttattgtcccaaataatatttgttgattgaaaaccagataaataaatgagttaaactatgtatggatcattagaaatttactacattgttctaagaaaaaattttctttgctaaattatatagcatatgattattcagttctgtatttaatgctttacttatagtttaagatttctattgattttctcctatgtaatcacgatgttggcacctttagtaagtttgctctttgaaaacataaccttacataacattctgaaacgtattttcttttttaaggaaaaaatgaggaaatatcaacagactgaaaatatgttttcagaggcatagaatcttcaggaaaatactggagttcctgagatctcaaggttagcagtttatacattattattctcatgcttttacagatttgggatataatctgtgcatctgtttcaagtttctaatgtgtaattggaaatggtcttacttaaaatatgtgttttaaacgaagtctcctcaagattttaaaaaatccatttatatcagacatacagtatttagtttcattagggacaataaaaagttgtcttaatagagaactactggttcttataatttgcttcattttaaagggtagcactattagcataaaaataaacatttgacatttctataaatttttctttctgattgttaaatataaacctatttagtgactttttcatttcttttgtatctttggctgcaaaatgcacacatatacatgtagtttagaaggatagctaatcagcaatccttctgaaattccttgaattctatttcctgactttttttaactacagccaaataaataatgctatcattggaaagtgtggcttcgataaaatgacaattaatatgaaggaacaggaggatcttgggaatcttttctaagttgtttaggatgatataactggaaaagaagaataagcctacccattattaagcagcttattataataacaaattaatgtacaatattcatttagaagttataaatgtagg

SEQ ID NO: 96986 - DNA, 1312 bp, Homo sapiens
tttaaccacaaagagacagcttgtgttgtctgttatgggaaagccaaaaaaaaaaagaaaaagaaaattagagatgcagagggctggttgaaggttatgggggaaacaaagacttctcatgcagtttttctctgttagggatagattcttcccaaaccaatattgagctttgttgtactcatctggaaacgtcaatggaaagaactagaaactctggttgaggacaactgaaacttgacttttcaaaagcaggtagaaaatagcatatgctttctttaaattcctttgctttcatcctcccttcatttgctttacaaaattgccaacccaggaatcatttgcaactctgtaccacaaatccagttccctaggaatttttccaaataatgattcttccattctctcacaaaccaacacccacatgaatttcacattacctggtatgcccatgctctaggtggctctttcttctctgaccctgtcttcaaattctccaagtaatttcctagcattcttattcttccatcgttctggcaaataatttatctaatccaaggtttttcaacttcagcactattgagatttggatccagataattctttattgggggaggggagagagctgtcctttgcaatgtagggcgtttagcagcatttctggtactagatgccattggcacttcatctttagttatgacaaacaaaaatgtcttcaggcattgaccgatgtcccctcagagcaaaattagcccagatagagaagcgttaagccagccctaacttctataatctcagtaaacttccatccactctactacaacaaccacaaaacctccttagcacctccagcatcttgttctcagttaaaacagctcaacaaggccaggcatggtggctcgtgcctgtaatcccagcactttgggaggtggaggtgggtgaatcacttgagtccaggagtttgagaccagcctgggcaacatggcaaagccccatctctacaaaaaatacaaaaaattagctgggtgcagtggtgtgtgtctgtagtcccagctattcaagtggctgaggcatgagaatcacttgaacctggaaggtggaggttgtggtgagctgagatcatgccactgcactccagccctccagcctgggtgacagagtgaggccttgtctcaaacaaacaaacaaacaaacaaaaaaccgcttaacagatacactttaaatatcagtttcccttgctaaagtgaaactcacctctatttgatcatctgtatgtttttattttccttttatttgcttatactcggccttgtat

SEQ ID NO: 96987 - DNA, 1045 bp, Homo sapiens
ccacagctctccagccactcctttcttccacagtacatgcagccatgaacccgagctatagtgaatcctttcttgtactcacattcatgagtgctacaggagcaattataccactctgcagatttatggtgttctaatctgaggtagcccctcaatagcattcactaatcctttcattctgactgtggtcggccactatttcaaaagttcattaccccactcaagccacacaatctctccctttcacgattagtgcacctgctattttaacaagaaaattgaggtcattgtgtggaaactacttgtgaatctttgcaatcccctccagcatcaaaccaactaggtctataaacattttttctttccttcaatctctaagagggctcaggagtccttcctgctattcaaggcaaagcctatgtttgattttacttcccatcactgaggctgagaccttttgccattaattgtttcttttttgtcctttatttccaactttttcttccttgctagcccttttccttcagccattcgtgttcttcacactcctatccaaaaaagcaaattgacaaacaaaaacaaaccaacctctttcttcaccaccatccaatttctgtcctcttcaactcattcaagctctccaagcagtagtctacattcattatctccaacttctaagattcagttactcctcagcacagtgcaatctgatttctaaccccatttaacagagcatgcactttctaaaggcacggatgacccacagcccttatcttgactgattctctcaggggtatttgacattgttaactacatttttcttctttcactgctccctcttgatttccctcacatcttgtggatctttttgtaaagacccctctcactggctcttctgtctctattcttccatccagaaagtcacaaaccacaaactcaaaccccaataggtggctataggtaatataaatgagtgaagttggctaactgaaaacagtaaacactacagaggtcaaacaacatgcccacaaaagttcttgatatt

SEQ ID NO: 96988 - DNA, 1001 bp, Homo sapiens
agtaagagtattaaaataatcttgtatgtgagtttgaaggctttctagcaagttgataagtgtaagaaaactttttataaatggggaaatataagacaataaatgttactgttttcaacatatctgttacagaagatttgcattgataaaaattaatacaacatataatgaatcctgtctaggaaacaatgaattcttcttataactgtaaattttgaagcaaaagtaaagaaagaaaataaggtaaaaataagatgtatccagtgaaatttatcatctcatcaaaggttgtattgctttctcaagtaaaggaaattctgtgctttataaaatcaaaactagatgtattccattaagacaagggctgaaaactggcaacctgagaactgaaatatgtttgttttggccctcataatatttactaaaattaaatttgctgaatttctactacttcccattttttactctgtgctgatgcacattttttggtatctatctgtttctgaagtcatctgagtttgtgacgtctgctttagaaagttgctattgaatgagtttaaaaaaactgaaaagtgtgtaggacagattcttttatatattactggtgaacatgtaaattctttacaatacttttggaatatgtttagaaatatttgttaaaacactaattcctttgaatcttccatatgtctgcagccattctacagaaggactcatacaggtgcatagagaatgttcactgacacattggttgtgagtaaaaaattgaaaaaacttctgaatatctatcaataaggtgttgatttaataaactatcataaattcttataaagaaatattatatagctctttaataaaaaaataaagtggttctaatatacactgacatggaaaaacatcaagtaaatattaagtgaaaaaagaaagtggtgaaatattttcaagtttctttaaaaaacaatcccataatattaaaataataatatcttagtacattaata

SEQ ID NO: 96989 - DNA, 1045 bp, Homo sapiens
aagttgtcaatagtttgtgagcaccttcactatatcatgaaaatatccaatgacctcataattttaatagctgcataatattatactgtatggatgtatcaaaatgtatgatcaattccttattactgaatagtaaggtttttatatttgcccactattaatagtgatctgtaaagttaaatctttaaatacatgtatgattattctctctgtataaattcctaaaaattaattttaagacttttgataagaaatgccaaatcaatggaaattcatcttgtatattctacttgcaagttatcatagtattctctcttagtgatagaatttttacattggaatagacacgattatgtaggaatattcacagctctcaagatctctgatgttaagtctgtatgaaatatgaagtagcaaatcccaatttttttctgaatttactgagaatctgtggttgcgtaagtagcagtagactctcattctcctctgagatagatcaagcaagtagttggctcttattatcagttgaaatatgtcatgtggctgtgtcctctcctgagtagactgagggtgacagttagctggcttcctgggatggctgaagtatccattgactcacacttaatttgaggccttgggattttcttctactttactagaccaggttgcctcatctgtcttccttaactataccagacatctatctggactgcagagctcttctctaagctgttcatgtatttttacattgttattcttttattaatgatattttaatctaatttgtttacttttttaattaataaaagaaaatttcttgtaaccatggcatgcaaattaaaaatacatttagctagtaaagacagaaacataaaagttaaacatatttacctacaatcttatgaacatttaaatgatatattaataagatttgaaactggataaatagttattaccacatttccaatattatttagttgaagcttttaaagttcaaatacattgttttctatctatttttaaaaatttggcatgggagatgagg

SEQ ID NO: 96990 - DNA, 1023 bp, Homo sapiens
cgactggttgtgtcaagtgtttctgatgggtaataaaaggggaactgagaattgaccattgcattcaacaccatggagaccactggtggtgttgacaagcatagtttcagtgagctggtggtagtaaaggctaatctatatggttttatgagagaatgggtggagaagatttagagtgtgtataaacaattaatgccaggagttttgctgcaaaggagagcaaagaaaaggggcagtcactacaggagacatggtgtgagaaggttgttaatattataagtgggaaaaataacagcatgcctaggttgagaataatccagtagagagtgaaaaattaatgatgcaggaaagtaaaagaattgctggcccagtgtccccgagcaggcaagttaggattggatttggcacagaggggcaaggagcatattaaataaatttgtaatatacattgaccttgacagggtcattatgaacagttcaaaaagtccaaaattctggtggagatggaaaatatgtagagaggtatctgggttattgtcacttatttcaaggttatgaattcttaacaggggccatggggatgtgggccatatctgtcttatttactctgtgtacctggtgcctaggatgagttctggcccattaaatagatatttaataaatatttgctaaccgatttggtgatgggaatattttattttcttcccttttatttgtgtttcttaaatttagaaaaatgaatatgtattactttttaaattaaataataaacattgctgatcttaaagagagaaatagatccaggaaaatacaattagtcatttcaagtgaaatgtaatatttgaatgataatttacctcaggtaatttgctaaacactctataatgcagaaccaaaataaaaaattgatactagattgcctattatttgttattatttgtctgcagtacataaagttaattatgtgttattagccccactttatagatgaggaaaccaaggctcataaatgttaagtacctt

SEQ ID NO: 96991 - DNA, 1048 bp, Homo sapiens
ctgagtagaaataaagattcattcatccttgttttccagaacaccatcaaggcacactattcttcagtttctatatttagagcaatgtaggtatattttcaccagataaatgtggcacaatccatcctgaatcttgtccattccttgctgtcctactttctccctctgtcacttgcacatgcttactggctagtccttgggaggctaccatccctccttgggcaaggaatgctttcagagtcgattgttctgtgcaagaacagccatttgggaacatgatggatataagctttttctcaaacatggtttccttgcaattttagctttaccacataacctgcccttctccacctccccttccaaagaagacttacttttttttttcaattctgaaatcaacttcttagatctacttttccttacctttttctatcatctgcctccagaactggacagcttttatgcctccttcttacgctatcattctttgattccaaatattcccgagctttagatgtaattccaaggttgttcccacatggagtgttgaaattcctgtttcacccctgctaactcaaactaatacccccagtcatttcatctcaattcagagccctaggctgacatactgtcacgtgttctcccaaccccaatatgagctctataaaacaatgttgaaacagacactggaaaagttcccaccaggagaaaatgaagtttccttcgcaccttatttccatgatgtcttatttatttttcacaaaatcttttagtctccctctatacccaagtgaatagtgggaactcctgctgccctctgtctgccactgatctttctttctctgttgtcccttggtgctaaatcacaagtggagatggagaaattttaagataaaaactctcacatgtgtcttatgtgtatccagtaacagcagcagtcagtttcaaaagcccctgcagatcttgctaatagctattcctgtctaattctagctgttcgctgctaaaatagaaagctgggagaacaaagttgtattcccagaggaat

SEQ ID NO: 96992 - DNA, 1058 bp, Homo sapiens
tgaaaattttcatacctgaccttatctgatgggtcacagtcaaaacagagtcaaaactttgttttgttcacaaaattatcaaagatactctaggaaattgccttcaggttatatgaataagatatacataaatgaattttgtctttagacttgggtgccatccccaaggtacctcattatgtagatacaaacatttcaaaatccaaaaaaaattcaaaattcagagcacttcttatcttaaccattttggataatggatatttaacctttcagttaaatactgtactttcagttaatgtaatttagcaatgtaagatcacatacatgtatctaagataatttataaaatgtttataccctaaaatatctttccttctgcaaagaaagtttgtgctccttacttgactgtgccagttcatggtaaaatggagaaggtggagaaaggtcagcccagggaaaggggaaagtccattaacccaagataaattatttagaagaaaccatatccattctctacccataggcctttcaattcaattattgctatcttccaggtaaatagccttaggaaatttctgaaaaagtggccagggcttcagtaagcaggtagcatggggatgcatgtcacccattgcaatactgaaatggaaactacctaaaatttagaactgtttttacatgcttcattgtgctcagctaattgggtttcttgaattttagaacttgagtacaaaggtcgtgcatacttttttgtgttccagctgaatttcatataatgttgtaatcaaggacttcaggagacattggcattatttttctttacagattttcttggactcaggtggattttctcaatttgccaataaaaaggaataatgatattacattaaaatgaactatgtctcaaaatataaaaaccttttggtaatcaaatggttaaatactcatatttaatttaatcttatttttgttaatttgaaaatagaaaaaaaaatctgctaaagatcctttcaagggaaagctatagctcagctcatgtataaaaagccacataaaaa

SEQ ID NO: 96993 - DNA, 1075 bp, Homo sapiens
agcctggatatatatacatgtcctaccacatagcctctaccttttgcatggtcttattccgccccttaattatataacattggacatatctttaaaatgttatttctcatgagttataaaggaagacttaattagtgaagaggcagattatgtttctggatataaaggtctggatattaatggtttcaacattaatttctaaatataagagtaaaaccaaaacaaaatcttcaactggcatttctagggcgcccaggcatttctaatgtgccctacctaggaatgcatagaaaatcccaacatgttatatatgaaaattttatatataagaagaaaacattataagataatgagaaagggaaagactatttaagaaatggttatggtcttaggaaatttgaaaaagaagtgatttagactcacgtctcacaacatatgccaaaataccagatagattacatggacaattttttttaataatgaggaaagttacattttgccagacatttagtagaatcactatatgaactttgatatgagaagaagaaataatcacattggaaaatacttaatatatttaatgatgtaaaagtattaaacttatttgctatttaaaaaaagcccaaagtgaaacagtttatattggaaaaaatatttacattattttctggatagagtatagcaaaagtacatgtaatttcttgagataaacacgaagacacacatctccaaagaaaatccacatagtaggaaatataattaacaaatgttttaaagcatttaacaacaatagtaacaaagaggcagattaaaaaatgctaatgagatttcattagtatgaaatcacagagatttcatcccttgaaatcggtactcatttctccaataaaaaatactaatacctaagtgctggtgaaggttgcagtacagattgtaggcacacacattgctatgaatggcagtgatatttagaaagcacttcggaaatacaagagccataaaagcattcataagtgtctacttcagagaatttatctgaagagagaaatattaaaaacaaggtgaaaactatata

SEQ ID NO: 96994 - DNA, 1020 bp, Homo sapiens
gctaagatacaatctgtttgcttccttccttccttccttccttgtctccctccctcccttctctccttccctccctcccttttctctctgaatacacaaggcataaatatgccatcatgtgcacccaaagtcagtctttccccagtgtgatttccctactactggctccacatttcataatgggattagacataaagaatcaatagaaaacagatttgacattaaactttattagaagtatgactggaacatgcctgttctctttactaagcagttaaaatgcattgaagatttagatttaatttcaacaaacatggtatcttatgttacaggctctgagctaggacctttcaaacctgtcaaagtgatatattccaaacagtaaatacaacttggcgatacagtgataaattatgtctacccagcattgtagtattagtttgagaactaactttagcaaagacatatgtcgcaatctaccctgactcaatgcttttgtaaacaatggaggagtgttcaggccaagctgaacacaagagttttagaagaagtctttgcttaagcaggaggtaggacatcatgacgctcaaaagatcctttctagcctgtaataatatgcttataagaaacaggatccaaaataggcatcataagttagagtcaaggccaagcaggaaaggaagcagcatagataaaggtgcctctgaaaatctactattaaattaagaggttcccagactcttcacacccacttatgcctggaaaacaaccaattagctttggcttggggtacacaatctgggaccagctgcagatcatatgtagaaacatgcagatcataaataggtcatgttcagacatggaccagttgaatcattaggtgtttattgttggagataaaggagttaagtaaattatgagtggaggaagatatttatgagctagtagtcctctggaaaatagtcacttggatatgcaataaggcctgttgtctgatacaatagaattgttatcagatca

SEQ ID NO: 96995 - DNA, 1047 bp, Homo sapiens
atgaaatgagactgaaaaaatattgaagcttggggcttactattctactgtttacattcatatataattaaagttttccacaatacattttaaaaatatagatgcatatgattgccactgtgctacagcctggatgacaatgagaatatgtctctaaataaataaaaatttaaaaaatttataggtccaacttatcctaaaattttctgaaagagccagagaatatggccaagtatattatagtatatattatatggccaagtacattcaaaattattcttctgaaaaagaataaggaagaggtgaggagtatgcttagcctaacagatctcaatacttgaaaagctgaaatagtttaaaacccatggaattagctcaagagtctgtgcatggaacaaatagggagcatagaatcagaaccacatttaaatggcaacatggtatgtgacggaggagacattgcaaatgagttgagaagtaagagtctgttccagtaaatggctttttaacaaaaaagataaaattagatccctacctcatgccatatatgaaaataaattcccaatgaactaaaaatctaaatattttttaaaattataaaatatacaaaaaaataggaaaatatatgtatgtcagagtaacatactgtagcatgaactgtgaaaattattatgtatttgggtacattaaaataaaactgaatatataaccaaataccccaccaagaaagtgaaaagacaagctacagactaaaaggagatatttgtaaatcattaactgacgaggaattagtatctgaatataaaagaactgcaaaaataaggaagagctaatgcagcaaaaaaaaaaaaaaaaaaagtagacatagaacctgagcagataatacacagaaaaaaggctaacacaattatgaacagctgtgtaactctattaggaaccagggaaattaaaattgaaagaagacatcatttcacgtatgtcatatcatcagattagcaaaattttaagggtttgaaaataccatgtattgacaagcatgtgctgaag

SEQ ID NO: 96996 - DNA, 1065 bp, Homo sapiens
cctatttttcagaagtcccacagcagctttatacttgggtaagctgtgtgtgaaatgttttcagactgagtttggcaattgatattgatgagtatttttttttggtttttactctggctctgaaaacaatttgagtagcttaaccattaaaaaaaaaaaaaaaaaaaaaaaaaggaggccgagctgagtggctcacgcctgtaatcccagcactttgggaggctgaggtgggtggatcacttgaggccgggagttcaaggccagcctggcgaatatggtgaaacctcatctctactaaaaatacaaaaatttgtcgggcgtggtggtgcatgcctgtgttcccagctacttgggaggctgaggctggagaattgcttgaaccacggaggtggaggttgcagtgagccgagatcacacaattgcggtccagcctgggtgacagagtgagactctgtctcaaaaacaaacaaacaaattaaaaaaaaaaaaaggaaaatgagaaaataatagaataatgccatttgaaattttttttaaaaagaaacttctatgtagctctttgatgctttaacttttgcatgactattggcatggtgattttgcaagtttacacataaaggccacatataactggattgaatcacaaattacatcaagtgttaataacaaaatagagcattataaattaattttgtgggccacaatattatttcaatatgttcctccttctccaacaaaagaggaagattctccttgattagtgacatacctgctttactaccttttgactattttactgattaagattcacatgtcaaatattactatttacttgcctatgggtagagaacatgttatatacaaagtttctgtttttttaagcttcctttccttaccttttgcagcttaactcctggaaagattagactatttccctcatttgttcattcaacaaattcattgagtgagccctgcatgccagatactctgatgagttcaagctatttagactctaactcctttaggaaatctataaactagcagttccttaggataaagcattca

SEQ ID NO: 96997 - DNA, 1102 bp, Homo sapiens
gaataattttaaaggacattggacttaactgtttggaatgaatgagcttgattttttctatacatattataagttaatataaaaaaaggctttgggtagactccgtatgtaccttatgtatttgatttcatgagtttcattttctgcagtaactttatcattcatttttcatctcttaggctggaatgtagtggaaaaagaactgaactaggagttagaagatttaagttttggctctggctccatcacatactggcagtgatgatcttagccaagtttgaactgcttatggcggggtcttgtttattcatttcagtatttccaacccctagcacgtgttgggtcacaagcacagtttgttgaattgaacatatcactgagtcttctcatttgttcaagaaagaaaggagagaaagagatttgtaatcacttgctctactacaagcacatagtattaaatatgacttattttctgattctttgcttggtaactatggcagagtcaattattaagatatttaagtgaaaaggcattgatttcatgatttgccattttatttagcattaatgccaataaggattttttttgacgttttctctctaaattggcatgaatttttaaataatcatcctctactttgcaagttcagtagaatgatcattggtaataatagccatctggaattgttttcttggttacaaaattgaatatacaagagataaatagggtctgagtccacttatatccaaactttgaagagaaactctagtttaagtgaagtgactatgtcagtagttcagacagaagtcaaatgcataagagcctttagttttctgtgcatattagagaacttacataattatttgcaaaaacaaaagcctggaattcatttttatgaaaaatctgaaatcaccattttgttaacttactgaaaatgcacttctgttgtctttagtgtctatgccatttaataaaataattccttacacttaagaacttaagttgaaatggcaggggacagagactatttgtaatattgtaatctcttctctaattttgtttttcataataccttaaaggtgaacttaaaagcaacacttt

SEQ ID NO: 96998 - DNA, 1050 bp, Homo sapiens
tgaggcaggagaattgcttgaacttggaaggcagaggttgcagtgagctgagattgcatcactgcactccagcctgggtgatggagtgagactgtgactcaaaaaaaaaaaatatatatatatattagttgtttcatgtgatgatctattctctgagaagtatgacatacttaattgacaggcaggtgtatgcctacaattcttcctggttatttctagttataccaatgctttaagtctgtaatgtattaaatagctctgcttgaatgccattctcattgccttgttcccttaaatggaatgaattttgtttaggcaatcacttactatgaagctgctctgaaaactggacaaaagaattatctttgctatgacctggctgagctcttattaaaattgaaatggtatgacaaagcagaaaaagttcttcagcatgctctggctcatgaacctggtatgaaagtctttctggtttgaaaaaagtctgataactctgatccattttatttttatattgcataaatatgtatttgtattctcaatattttatttgtggttggttatataaatacatgcgtattttttcttttatcagaatgccactctactaaaatgtgatattttgaaatctagtagcagatttatgaaacagttaattgtgttatagaaatatagcttactttccaaaataatatagttatctttaaattacagctatctcatatttaaacacattagcatttttgtaatcttttttaaaaagtagcatgcttcttttttaaaattcaagctctataaaagaatataatgcataagtcatctgtttctcctatgaattccatttgccttgttctcaaattacctccctagtagcttgtaatttaatatatattctatatatgtgtgtgtatatataagtgtaatgtgattttcctgtgcgaaactgttactcttccttttctgcaattttttccacatacgtgtcccagatagtttgatgtcagtacatcatgcatttaatttgcatttctttgatgagtgataaagtta

SEQ ID NO: 96999 - DNA, 1090 bp, Homo sapiens
atgttattgatatatccagtagtatctgtgatttagctctttattattgttcactctattgccagtttgtaaataacagctttattttaacccatttatggttatcaatatggttaatagtgtattgtagaataggaattctctaaggttagttttatgctactgagtcttcaaagatccctgcctggttccttctctctgtttttctctttctttttctctacctttttttccttccctccatattttgtcctttcctttctccctctctccttattgaacagctctagatacaaggtaccattatttgtactgttaataatgcaaaggaaaataatacataaactttgctttcatgaatgaataacccagtagtgcatagagcacatccccagctaatattgtgagaaaaatgatagatgatatgagagatatgtgattaaagtatgcaagaaaataatagctaacatttattgcttgcttactttgtgctaggcactgttttaaattaaggagagatcacacgcttaagtgttaagagaatgtgaaagaatttttttgaaggaactagcatttgagctaaaacctgaaagatggatacaatttcaacaggcaaagattatgggaaagggaagtaggtactcccaaggtgagaaataatagatggaaatgagacatgttacttgagggtacactaagatactcatatttgatggaatacaggatacgttgataacgagaagggaagaaaagcttggagaggtaacttgagacaaattgaaggatcttgactgctagttaaaaatatttgtatctgattgacatgcattgagaggctattgaagacttttaactatggtagtgattttattagagtgcaaatccagaagattaattagacaatggtttcttggatgaagtggcttgagaataaactgaaatgcagtgaaaagaaaaagatagtacttccttgtggaaggttttgaggcactacactaaaatattgtacagtgagtacaaagttcaaaatttttaaatacccacaggacctgtgaactgataatagtttagaaagataacaagttgtcac

SEQ ID NO: 97000 - DNA, 1012 bp, Homo sapiens
atttttttattcccttaaatgtattatttgcactgccacccaaatgaacattttaataaaaacactttaatgtaaaatgtaaaaatgggcctcctcattacttagacttgaggttcaagtccaagtacttaatatgaggcttttcaccccaccttcgtctccaacctcatcatccaatactctctgtctcacttaagcctccagagcagagaatagcaaactttctcaacaaagggccagatagtacacattttagactttatggaccgtatggtctatcacatctaattggcttgttcaaaacagccatagacaatacttaaatgagcatggctgtgtttcaataaaactttatttatgaacactgaaatttgactttcatgtaattttcatgttatgaaatatttcttttttttccttgacagctggaaaatataaaaaccattcttagttcactggctgtacagccagccagccagatatggcccacagagtgtggtttgccaaaccctgctctagagtatggagtggcttttagtcatcttcatcaccactgccatcccaatgtaccattgatgacttgttatctgtgttgttgcagttcctcttcctaactcctgtaccttcctcaagaatcatgaaaaggaaataggaagagcgtgtacgtgtgtggagggagaatgaggggtttgcaattcaagagtcagctctgaaatcctccccaataatctttcccttgattttagtcatccatcctcccctcacaccacattcagttttcaatgctgtcaaaatgttgctatcccacattcccaaaggagtttataagctcttttcttacatttactacattatatttcagttagtcttcagattacagtctcatctgaaaaatgtaggttttccggggggacaggaaccatgtcttactcatttttctattcatagtagctagcccagtgcctgggtactagtaggcagtcagtaaatgttttggattgaataacctaac

SEQ ID NO: 97001 - DNA, 1153 bp, Homo sapiens
taagaaaaaaaaaaatgtggaactccggatagtcgatcaggaatgtccttaggttattttatgattttatgttttttttccccctaacttctttataagtcaccatgcatgcttctgaaaatattagtcatggtacacttgatcaaaaggcacatgactctgaatttcagaagtatgaacttcaagttccaacaatacaatgccttataggtgaaaaagaaataataattaaagtgattttagaaaggtggactaaagtaaattgtgaggagtgttgaaagtttttgaaagacaagatccataaaaaccaaggtggccttgttaaggtcatggtgccagtgttcactgaatgtttaccacgtccattgccatattctaaggatgtttccctttgaacttgagaaatggtcgttcagggtgtgtgtgtatgtgtgtgtgtgtgtgtttcaatatgttaaggttgcaatctatctcctcattctttaatcccaagggctagaaactttcttttatcaaggtaatttaatttaatgtgaatgcacataaaatgagaatgataatcaaaaggaatgaaccatattctgttatgaatgctgaaatctccttctacataatcttgcaaaatgaaatcacattcaaatgtccatattaatatgactttatttgtttgctctttcaaacttctagtctttgttgagcatccgtggctccctattttcaccaaggcgaaatagcagaacaagccttttcagctttagagggcgagcaaaggatgtgggatctgagaacgacttcgcagatgatgagcacagcacctttgaggataacgagagccgtagagattccttgtttgtgccccgacgacacggagagagacgcaacagcaacctgagtcagaccagtaggtcatcccggatgctggcagtgtttccagcgaatgggaagatgcacagcactgtggattgcaatggtgtggtttccttggttggtggaccttcagttcctacatcgcctgttggacagcttctgccagaggtgataatagataagccagctactgatgacaatgtaaggaagttttaaatagttcaggcatggctggctcactattgctgcaccagccagtgtttctacagaacggcaaccttgagaa

SEQ ID NO: 97002 - DNA, 1102 bp, Homo sapiens
gccatctatggattgtcatttctttctcattatctctttgtatcactactatttgtttcaaaattagcttttaatattatctgaaatcaagagattcttattttaaaatatatatattctgtgttatatttttactggttctcctacctgtgcccctaatatttctttttctttttttcagatggagttttgctctcatcacccaggctggagtgcagtggcgcgatcttggctcactgcaacctccgcctcctgggttcaagcgattctcctgttctcctgcctcagcctcccaagcaactgggattacagggacccaccaccaggcccagctaatttttttgtgtgtttttagtagagatggggtttcaccatgttggccaggctggtctcaaacttctgacctcaggtgatgtgcccactttggcctcccaaagtgctgggattacagacgtgagccactgcgactggccatctgagcccctaatatttctttcagattttactcagcatatctggggggaaaggaagtatatgcagtacatttgaaaggtggaccatatttattcctgagctagctcactttgggcctttctgtgtcgttacatgctcatattcccccacagcaaaggcatttgcattgcacaagtctgttcagatttacgatgatctcacaatgtcattcagggacagaatccctcaatgaatcagagaaaaagagggctaagtattgttggcataggggattgttcttctagtaagcacaggtgaaattctcccttccttcaaatgcgctttgtggtaaagctctatctgttttctggactcatactccttcaaagatgatagagggaatgcaggcagaggtgagacttggagcagtgcttctcaaactctgttgaggatgtgaggtctctattcttctataaaatgaagtaaaaattagtttctagaaaactgaaatgaaaaacaggcccacaacaacatccccctacttttttattattagaatagacagacacaacattaattggccaaattgccttacaaatttctaaacatggactctccatatctatacttaaccagtactggttggggg

SEQ ID NO: 97003 - DNA, 1103 bp, Homo sapiens
aaagtaaactctatcaccaccaacagaggaatccagtaagaaacattctagttccttgtatagagggtactatcagggaatccagacaatcagagagggtaaacacaagagcacctcatctgggaattgctgacgaagaagagaaaatctggggcttgcttggtgttacctctaggacgtcaccaaccaggcatttctcaagggtttatgtcggtgtgagcctgacagtgacacacaaaagcatccctccaaaatttagcctggggaccttgaaaggtattgctttctccctgggcagttggagaggctgaacctactattttctccctgtactcgccaaagggcacaaagcctactctcttccagctacctcagaatggggagggtgggagaaacagatcccagagaaggatgggagagaatcagcaattgaaggtcctgtatagtcaccctcagggtcaatggggctgtgctccgtgaggttatcacttcctttttaaattctaattagtgaatgaagcatgttccaccgctcaattgagattgcattagtttagggtagggtgggaagaaatttattctcattgcacttgtgatcagaaaaataagttgtgacagaattccccaagctgccccaaagtttgcttttccaacttttaaattttgtccacattcctagatttccatttattaattgttttatttatcaaaaacatatagcatttactctgtgccagccactatcctaagcagtactttgcaaatatgatctcatttaatcctatgaggtagatactattgttaattttacaggtgacaaaaccaaggcacagtgaggttcaattaacttgctgggttatacagttagtaagtggcagaatccaagcagtccagccacaccgtggccatggcgtctgtgttcttgatgtttgctcatcatccatgtgatggtagagctacagcttagccaagagactcaggactgaagttgggtgcagtcgtacatgtgagctgtaattcatctgctttctgacatgccaaaattccaaaaacagtttggtttagaatgattacccaaatccactccatttgtttgtttgttt

SEQ ID NO: 97004 - DNA, 1077 bp, Homo sapiens
aggtagcactacatgaatattccttctattttcgttcctctgttatctctgtaacccactatatgtccttcagagaaaatattttatctcagtggacttctgttttctcatctataaaggaagagactaacactctatggtttctaaaagtggaaagaagctttgggcaaagaagattttatacatctgacaacaccttcgtcttgcagcctgcagaggtcccactgagaagagccctcactgagtaatcttttaacataagttacaatcccattttgagatgatgagacaaagagctgcagtttgttcaattatagttttcaaagctttattaaaaccatagacagagagaggacatcaagaataccgcgaggatgggccataatgttttatttcattttatgcagctttttctttgtggtgtaatttgtttttaaaaataatgttagtgttcttttcacccacttacatgtttgctattttactgcttcctgtccagtgttttattttagttagaaaaagaaatagctggcaaaactcccaactaaacatatttgcatggcctttaagactttcagaggaaactgccatctcttcccatttgtttgtggtagtgatatgtgcagtcacaatatgacactgttaaaaaaaaaaagccagtaaccatacaaggatgttaagcaatattgacttgccttccactgggaaaactgctgtcagctcatggattggcattctttgacattttactcagtagactagtgagggtttttgcccttgtgttataagaatattgatactagctctactgcccctgttaggagcccgattcttttacccagcctatctttcttagatgtttattcaacatttctagtcactggttgaattaatttaacaaataccgtaagtgactatttttttcctttccctgtcctcctatgactgattttcatactctatcaggttcttttcaaaaatcttctcacaagcagaataattgtagaagatgccttcctacatgagcttatctgatgttttttcatggttacagatttttggcaggaataccacagg

SEQ ID NO: 97005 - DNA, 1039 bp, Homo sapiens
agaaacaaaatgcaggttagttgaggaagatttgagaattacaggagtgtgaggatagaccttaaagtgacctccaatatttcctaccttctagtattcaagccattgagtaagggtggggccttcttctaaccaatagaacatggtaaaagtgaatgacatcattccattgcttatgttatattgcataaaagtccattttgtttaggaaaaaatcaacagcaaaaaaaaaaaaaaaaaaacaaaactagggtctctctctcttgcttgctttgaagaagcaagctaccataattatatgccacactggagaagcccatgtagcaaggaactgaagggagcagcttcaaaaagctgaggatgacctccaacaataaactgaaaccttcagtccttcagctgcaagaaagggaatcccaccaaaaacctaagggaactttggacatggctcttttccctagtgagcctctgataagaatgcactcatagctgacaccccaagtgcagcctattgagaccctgaagcagagaacatggttaagctatgcccaggcttctgacctatagaaactgtgaggtaataaatgtgtgttactttaagctgctaattttgtggcaatttgttacctatgaacataaaatgtacacaaggcacatacaaataaaacataaacattaatttagtcctctataagatcctctagctttgccacctatggacacacctctgccactttcctctcaaaaatgtacaatcaggctgggtgtggtggctcacacctgtaaacccaactccttgggaggctgatgtgggcaaatcacttgaggtcaggagaccagcctggccagcacggagaagcactgtctctactaaaaataaaaaaaaaattttttaaaaaagaaaaataattaactagttgtggtggcacacacctgtagtctcagctagtcgggaagctatgtgaggagaatggcttgaacccaggaggtggaggttgcagtgagctgagattgtgccagtgctctccagcctgggcga

SEQ ID NO: 97006 - DNA, 1096 bp, Homo sapiens
ctaatcagattagagagctaaatccagagatcccagaaccaattcagaaaacttatccttaaaattctgttcctctagaaccactcttggcaacaaaatctgttattcagggctctctagagaaacagaaccaataaagtatgtgtatgtgagcatacagagaaaaagagagacagagagaggagagagagagagacagagacagagagacagaaagagggagagactataagaattggctcaggagagacagagaaagagagagagattctaagaattggcttatgtggttaggggaccaagaattctcataatctgccatcaacaggctggaaaattaggaaagctggtagtattcagtctgagtctgaaggcctgagaatgtggggaatcaatagtgtaaatttatgttgagtttgaaagctcaagatctaagaacatcagtgtccaaggacgggagaagatagctgtcccacctcaagctgagagcaaattcacccttcctctgacattttgttctattctcaccctcaaaggattgcataatgcccatctaggttagtgaagatgatctttgttactcagtctacagattcagatgctcatctcatccatctgcacaggcacacctagaaatgttttaccagccacctaggtatcctttagctcagtcaagttggcacataaaattaaccatcacagtatctttccagatactgtgcctatgcacatacagacacgaaatattttctcaccaatttttagacagttgttaatatatatatatattttgcttcctgatttttaaacacagcaatcttggaggactgtcaaagtttacaagagcttcctcattcattttctcaactccatcatattacctttgttgaaagtgccataatttatttattatgagacagttcctacctgatgaacaattaatattttttctgatattttggttaacacaaccaatgctgtaaagctcttgtgcatattatttcacacgtgtacaagaaactaaaggacctagaagtggagttgctaatttaaaatgtatgtgtgcttgttcactgtgaaaatgtatgtgtattta

SEQ ID NO: 97007 - DNA, 1068 bp, Homo sapiens
cttatatagtgctgagcctctttctttttcctctgctgtactgtttagggatgtctcttccaagatcttcccttcccttttcctgttcaaattcagagatttcactctctactcctctaaattccccactcgtaccagttgatagttaaaatagttgtgagtcttgttactaaaaagaccttcaaaagctttccaagatagaaaaacatattcatttaaaattgattttattgttcaatgttgagtccatgattaggagtaaatatgatataacaaaacttgaaaataaagttaaaatattaatttagtaaatgggaaaatagttgctatcccatcaagcattttgtggagagtaatattagtaacacaaaataattgttggaatgttactgtgtgttagaaatagaattgttaatctttttataggcattatattattgaatacttaataaaaccttaggcagtagatgttactataataatatctctattttataactgttgggactgagaaagacatataggttatataatatttacaagctcaaaactgagtttttgatagagccaagaatttaataccagaacctcaaacaaaacatgtactccttttgtttattagtttttgaagtagaatggtatctattactagaaaggagatgtcaactgagcaggcctagggtagtctaataagggaaaaaactgccctatctttcttagacatcgactgtaatttctgcctgtattattcatatcttctgtcatatactttactatgctattttattattttccatttcaatataaaattgagaaatgaagtaactgatactttaacattccatgtgaaaatccctccaataagattccttctatgtagtcagttgaaaaatgaaatgaagagatttggctactactatctaatgttttttttgaagggtataggtgaagagtaaggagttgagcacatttcttctaagattttttttaaaaggctcatttcctgttagctttttccccttttctttagttggcaatgggaaatgacatcctgtacttaatcttctc

SEQ ID NO: 97008 - DNA, 1056 bp, Homo sapiens
ataaagagtttgaactagggaaaatgagatcattccataattatctatgggtaaaatggtaaaacaaagagggaaatgtaaatatttgaatcaaggaaagattatatgagtgttctatgttctgtttttattcttgcatctcttttgtaatttttaaaattttttcgaagtgaaaagttaaaaaaatgtagatgcaccaggacttaaaatatttaaataatcatatgtaaactataatatagctctataaaaataaatatatacttgttatttttattgagatcaaaactcaaacttgaaaatgtctgtaaaggtgacataacatacttgaaaaagaatcatattaagattatgaattggaaatgctgtaattgaaactaagtattcactgaatgagtttaatggtagattagatccaatagagagatcagcgagctgtaacttgaggcagacaaaacactaaatattatagcaggaagatatagcaggaaaataaaaggagtgtaagagaagaaatagtgggaggaccttgtatatgcatttaattgtagttccagaaaaacaggaaagaggcagaagcagtatctgatgggataatgcctgaaaattttccagaactgtttttaaaaagtcagttcaaaaagaaaagaaaaataaagtaaaccacacttaggtacatcataataaaattccaaaaacaaaaataaaagagaaaaagaaaaatttatgttgacggatttggaaatgttcttaaagcaaaaaaagtaataaagccagtttcaaacaaaactaaacaagaatcctgagtttattaatagcaaacctatattaaaagagttactttatgtagtaggaaaattatcccagagacgtaggaagcagtaaagagcaaagaaggtggtaaatgtatggagaaatctaaatgaaatttggtttcataaaataatactgaaattgaataaattgaatggagagaataaaaaacaaaaataatatgaatcaaggggaaattaagtgaagttaaattggttctttggcccttaaattatttgaaca

SEQ ID NO: 97009 - DNA, 1049 bp, Homo sapiens
acctcccatggctaggattataggagtccacagcaggaatgtggactgctgggggctctcacttccccttttcctgcaatgaggagtctctcccagctcctggccgattctgaggcttttattttattaggatccaaaaccaacaagaacgatttttacctaataaatgtaacacacttatttgttatgcagaaattactgaagcaatatatgaaaatgtagaattatgtagttacctattgcactaatagtggcagttaaacagtgttaggttgctaaataagacctacagtatcagcaatgacagtgcacacaaacatatattttattgcaggaaaatgatacaatatagcaacagcatttagttaaggatatgtgtcacatccaaaggctgtttcacagcaggaagttaggaaaggtaggtgcatgccccagttgccctctttagtaaagatcatacaggatgtactttctctctcagatcagaaaccgcagatgtgtgcacaaaacacttcggaaccaggtatgcccaagtggagtcttggcccagatgactctgctggacatgttggcagatttttgccacatagacagccccactaacaggccctctaaggatctcatagagaacaaatgcaaatcatcaatcttactgttatcagttaagcagtgctgacaagctggtacaaatctttccaaactccttggacccacggttataaagcaacactattaatcagtacatttcatgccttacctgggtgtctgcactgtgcagatatattttttattttcatgagacagctcaggcaaattccaggtctgctggattgctggatgtagctttcacaagcatacctttcctaaaacaagtttcagaaaacttaattctaggtaatgatggcaaattgaaccatgtgcatttactttcactcttccatgaaattctgttaaaatggtagtaaaaggaagctttttcaaaggcataaactcacaaggacaaaaacaaaagaggagacaacagcaacccaattttggaaaacaaaatg

SEQ ID NO: 97010 - DNA, 1059 bp, Homo sapiens
tatgttgcttaatcagagcagttgtgaactctgttatcagaccagcttagaagagtcacagagtttatgtattttgaaggaaatattccagtagtataaagccaggcgtgttcattatccataatgcatttatttattccacaaatatgtgctcgctgttatgtcagtaggtgaaaataagacacagtactctcatgaagctcttagtcaactagtagagacatgtgatctgttaaaatatagtgtgctgtggtagatgattacttaagtgctctaggacaacagaggaagaggcaattatgctgggagtcttataaatggcttcactgagtggagtcttaaaaaacaattctttgtgagagttttcttggtcttcccatatcatcatctgaaaacaaagttaaaaggcttttgtccattttcactgaggtagacctgattcatggtattttttccagcttactttagcacagaggtggagtcccaactcttggtcatcttatctagatacttatttgttggattttttttttttctttcaaaaagcattctatgaatggtaacttaaaatgatatagtagttatatattttaaataaatatattttacacttttttcctagcagtttcagtacgaaaataaccattttgtgatttggaggggaaaaaagtatgtcatatcagtatattccatgaaaggcaaaggtgactccaatgcagttcacccattgagtatgccccacacccactctagggtataacaccctcaggctcagaaaacaagtactggctctaagataaatgttttaatttacttatgtatttgcatttgcctattgtatatctatttacagtatatatctactctgatttacttaaaataatccaaaaccacaacatcaagtttttctcccagccttaagtatcacctaataccaacttgcagagccatctttaaactgatcccttatgtcaatgtaatgcaaaattctaaaatccttgaataataagaattaatgcaaagttaaggagattttggaattaagcaatttatttgtac

SEQ ID NO: 97011 - DNA, 1024 bp, Homo sapiens
atttgtaataaccaattggggactaataagcattttcatggagataacaaaggatttttatgtgtaatctttaatgcttaaataaaaggtgatcgttgaaaaagattttaattgcatgccaaactgcccagaatcataatgctaagtaactgccatactcatttacagtgggctttttggtaaattttgtaaatctccttgaagtacagtttgttcatcatttgaagatgaagataatagcacatagcctgcctaccctgtgtgttactgagaggatcaactatgattatataaggaaaggaacgtttaatttctggatttcttataaaatacaaatattacaattgattataatgcttgtttgtagtcttttaagaaaaatggtttatatatctgagcaaagggttcatacacaggctgacgacacctcccctgtgttcccaagaagatccttgtgctcagcgtggatgtgttagaaagctcacagattgcattgcatgcagataacttagagcacatctagtacacccctgttccctctgcatccagcgtatgaaaacttttctggaaaatgcttaggtatgcatgcaacagtgacccttggtcatctcccaggattctgtatttcagtccccgtggggcaagggttggtgtcggtctactgcaacacaaagtggcatgaatgcagccacatgttccgcatggatatagccacgtgggacctacacattgcaaggagctgcatcttgtgcctacactcctttctcctatgtcagtgctctaccacttgagcctggtatgcatgttgactgttctcagcaacctcaaatcatgcactgatctcttccctgggtattccttatctgccttttaaccttggctgcatgcatatgttattccatcctgtggcactacctgaccacctggtgaaacaatatcattttcggctgggcgtggtggctcacgcctgtaatcccagcactttgcgaggccgaggcaggtggatcatttgaggtcaggagtt

SEQ ID NO: 97012 - DNA, 1074 bp, Homo sapiens
catggtgaaaccctgtctctattaaaaatataaaacttagctgggcatggtggcgggtgcctgtaatcccagctactcaggaggctgaggcgggagaatcgcttgaacctggaaagcggaggttgcagtgagccgagatcgcatcactgcactccagcctgggcaatagagtgagactccgtctcaaaaaaaaaaaaaaacgaaaacaaaaaaaaccacacacaaaaacaaaaaaatgtcattttaagttttgtcctactggaggtgtttttgtacaatctttcttacaagttctccatgatattgcagatggtattcctgtagttttttctaaacaaaaatgaaataaagtatacctcctgacaataaaaataagccttggcaattttgcattaattactcttcatggcatcaaaaataagagagaattttgcctcagaaagctgacatagctttgtgagaaaagatgtggtgtagcaaagcaactaaagtacacaagtgtgtgtagaggagtggtcaggattgaagatttgtttgatgttcagtgatgtttatatttctgaatttttcatgtgtaatgaacaacatactagtaaaagaaaataagatggaatttaaagggactgaaacatttggaaaatatgaaatgattcaattttctttctctcttacttttcgtgcctccctccattatttgaaactgttctcatctaagtttactaacaaggatacaaagacacacatgaccactactgtctttgcttttcactcttgacacaggtaataaactaatgtggttgtgaattaatagcagtgactacaggtgaacaacagaatcttccaatactgtgaaaggagaaggctgtttttgatttttttttttttttttttttttgagtcagagtcttgctctgtcaccaggctggagtgtagtggcacgatcttggctcactgcaacctctgcctcccgggttcaaatgattcccctgcctcagcctcctgagtagctggaattacaggagtgcaccaccatacccggctaatttttttttttttttgtattttcgtagagaa

SEQ ID NO: 97013 - DNA, 1407 bp, Homo sapiens
gcctcctgagtagctaggactacaggcacgtgccaccacgcccagctaatttttgtacttttagtagagatggggtttcaccatgttggccaggatggtctcggtctgttgacctcgtgatccacccgcctcggcctcccaaagtgctgggattacaggcgtgagccactttgcccggccaaatctcttatgtctgttttcttttttccacttcctttgccaccacttaggcagcaacccttataacctactgcccagtttgttaagatcccatttaaagggctttatacttcagcctatcttgatattccatacaagttattccctgcctcacagtccttcaattgtcttttattgcctgcaccacatttattgtcttcctgcgcagtctaattctaacatatttttcatctttatcactcatattatacatcaaccatgagttctcagcaaattggtttgccagaatgtgctatgcagagtctagactgacaccatgttttgcttattagacacctccttatcttcctcttcctcaaatatcttaattcttttcatccttcatggccaggatcaggtgttgtctcctccatgaatgcagaccaacaaaagcagcatgcctaataggctttaactaagataatgtgggacactagttgctgttgctacctataaagtggtcattaagcataagtttctttacctctttctcttttcaacatgtctcaggatgatgatgcatttccagtttaacctcacaggtcaccatctccagacttctgatggctctgagagccctacaaataatttgaaaattacagataatctaaaagtgagctaactttcttggttcattactgcagaaacagaattgacaaaaattgcattacatgggtgaggaagtgaggattggtgggcccagtgctttcatagagtattctgggtgatcccaacttatacagttgaacttgatcaaaaccgtcaaactcatatctatgtattgtatttaataactttgcaggatcaataattacagtaggttgtctagaaatacagtcttacttttaaggaatctgaactatctaggctatttaaatatagtgccattgtatatactctcctagatttattgttcagtattagcctttcaccatctattgtccatgaaaaatatttattaaaactagtccctgtcttatgttttttatattcctgaaattcagaatactttttaaaattatgacttttaaaaaaatccattgtgttttttttagactgacaaattttcacaaccactaagtttaaaatatgtgcaattactttgaacatttgcccttaataccaaatatccgtaatggacatttttaataaagtgtagaaaaattaacatctacagcttttctttct

SEQ ID NO: 97014 - DNA, 1048 bp, Homo sapiens
cttacttatttttgtaagggatagagcaaacctgtaaatgtgttgatcacctggattaattcttggaaccagagttcagatggccagaaatggagtcggagccaattacattagaaagagccaaaggtcaaggcagaaaaaccaagataagtccagaaacccaaagtcctagaggtagaagcatgtatgaggaacaagtgtagttttaaaaaggagtgaagaaagaaggcttctgggtgatttcagtgacggacattgagtttaggatttacttttatgggctattgattacatcggcagattaggatggcctaatggtaaagcatcaggcacattctacttgatagatcttgttttgtcttgttggaggcagctgtacacttatcgttaacagtttttttgtgtatgaataaagctaacaacatctatccaattttgttgagcatgtttgtgaacttttttttagtaataatgaacttttttttagtaataatgactatttcaaacagggctcaatttgaaatagtcaaatcttgtactcatcaaatcttattaagaatcctttatttaagtgtgatatttgaattaacactatatactatacactatattggaattattaacactgtacaatgtaatgtgataggattttattcaattttacctatatgggttgctaatttccagcagtgaattagaggctgtaattcttattaacaatataaggcaaaagttttttatttttttgagacagaatcctgctctgtcaccaggctggagtgcagtggcgcaatcttggctcactgcaacctctgcctcctgggttcaagcgattccactgcctcgcctcccaagtagctgggactacaggcatgcaccaccacgcctggctaattttttgtattttagtagagacggggtttcaccatgttggccaggatggtctagatctcctgacctcgtgatccgcctgccttggcctcccaaagtgctgggattacaggcgtgagccaccgcgcctggccaagcaaaagttattttttaaagc

SEQ ID NO: 97015 - DNA, 1031 bp, Homo sapiens
tcagagtcttggattctaagaaaattacctgtcatggtagcagagatttttttttttaaatatgtattctacatttcaaagctatataatattttgtaaattcttccacccaaaactactgtttttccacttttgactttgaaaactctttggacatagcatgacttacaagatagggtgatacatcaaaatataaatggaatgtaattagtcccatgaaatatatgtatacattccccacttttgctatgctagcctttattcactttcctcatttctgcctttctacacatttacttcttgtcactctgggatgttatctttcattttcatttcattatcttatcctttattcccctccttttccaactttcctgttttaataagagcatttttccgaagtatgagattctcttttgattcattatttgatttacttagtcacattttcattttttattttttcaggttcgttcattcccacccccattccttcatccatgtccccgttgtctcttgctgtagtccacctttttccttctgggccttatttaactgtcttttgatatctccccttcctgaggaccttctgtttcttaatttttttcctcttgtctccttttttgctcgtttcttaataaaatggtgctctgagtaaaacgcatgttgtgtgcaaagttctaaatttttcttaatcatagcaagatgaataaggcatggttcttgcctgtaaagaaggcagcattcacaaagacttttatttttattttatttttatttttttgagacggagtctcgccctgtcacccaggctggagtgcagtggtgtgagctcggctcactgcaacctctgccacacgggttcaggtgattctcttgcctcagcctctgaagtagctgggattacaggcatgtgtcaccacgcccggctaatttttgtatttttagtagagatggggtttgccatgtaggccaggctggtcccaaactcctgacctcatgtaatccacccacctcagcctcccaaagtg

SEQ ID NO: 97016 - DNA, 1042 bp, Homo sapiens
ttgctacagttttctgtatttacagaataattagaaaaataaaaggatcatctcaattaatgcagaaaaagcaattgaccaaatccaacacacatttatgaattttttaaaaaatttcataaaactgtcagaaaactgaaaatggatggaagcatcctcaatattataaaagaaatctgtgaaagacctgtaactaatatgtaggatggtgaactattagatgattttcctaagattggagatgaagcccagaggcccccttccaccacttctattcccccttttgttggagactctagccagtaatattaggaaagaagtaatagtaaaaggcccacagattggaaatgaagaaagaataaaaacataattgtttatttagaaaaccctaaatagtctaaagactaacttctaaaattagtacatgaatttggcaaggtaacagttgaaaaattagcatacaaaaatcagttatgattattgatgccaaaagcaaagttacaaaatgaaatttgaagaaataatttataataatatcaaagcaaaagaaatctagaaaaaataacaaaaattgtaaaaggcctataaactgaaaactagaaaacgttgctgaatagaattaaggaagacctaaataaatggtgtgatatatcatgtctgtggattagaagacttgttattgttaaaatgtcagctctcccccaaattgatccacagactcagcacaatctcaatcataaccctaaaagactttgtggaaatttatgagtctaaaatttatgtggaaataaaaatgacctgacctagaataaccaaaacatagatacatacatcagtggaatataatagagaatacagaaataggcctatacctatatagccaattgatttttacataaggttctaagataattccactgagaaaaagaacatattttcaagaaattgtttcaaagcaattggataagtttatgagaaaaaaagaatcccacctttgtactgcacatcatattcaaaaactaattcaaaatggattataaac

SEQ ID NO: 97017 - DNA, 1153 bp, Homo sapiens
ttgaaacctaatagagtttgtccagttggaagtgaaattacttagagccagggattccttttttctttctgtcttcctccctttggaatgagaatgtctgtatctgttatcttatgcgttccaccattgtgctttgggaacagataatttattttctaatttcacaagttcataaatggaggaagaattttgcccctggatgtcgcttacctacagtctcacctgcacctaatttatatgatttagatgacatttgggacttttgagttgataatattagaggatttttattttaaattgatgctgtgatgggttgagactttaaggggtaggtattaagatgggtgaatgcattttgcacgtgagatggatataaatctttgagggccagcaggtggttgaataatggctcttcagacatgttcatgttctagatcctgaaacctgtggttactttataaggctaaaggaactatcaaaagtgatcaagttaaggaacttgagatgtagagattaccctggattgtctgggtgggcctgatgcaatcacagtggcctatacaaagaggcacaggaggagtcagagttagagtagaaagtgacatgatgatggagattagaataatatgtttagaagatggagaaaagaaccataagccaaggaatacaatggctcctagtagctggaaaaggcaaggaaactgaaccctccccagaacctccagaaagaatacagccctgctgacatctcaatttcagcccaaagaaaccgatttcagacatctgacttccagaattctaagataataaatttgtgttgttttaagctactaagtgtgggtaacatttcaagctgctaagtgtgggtaacgttttacagcagcaatgagaaattaatacaaggtgtctacatgaaactgctttataatgatgaattctggtagaaaacagatgcttccttggatattcaagaagataattcatacttcttgaaaaaaaaatcaaatacaaaaataaaactctttgtaatggggatgggagttggagatgaagtaaaggtgaggaatgtttattacatacattgctggttaataactaagaggaatttcacagtttgacaatattgttttgacttttatccaaaaaactacac

SEQ ID NO: 97018 - DNA, 1011 bp, Homo sapiens
aaatttctagttatcgtgtaaacatgtcctgagagaatagaagcattagaatcaacctgggaagatattttactctcttacaagggttacttaagaatgtatagtgtgcccatcactgtgctaggcaacaaactttgttgttccttgagaattaagagttcctgatctcagaaaggtcactttctggcagaaaaagtcttaaaatttaatttcagtgtattctcataaatacaataaagtaaacatgttaacgatacaaaataattaatggtgagagaggtgacagtggatcattaggaaggttttcctgaagtgcctgagttttgaaaaaagaaataactcatattatcatcatagagtgttcccagactccccctgccacctggagccaaggttcttttcttagtttctttctctccattgccttgctagaaaggggctgcctttggctgatcagttttttgattatcacaatcaagagatggaagaaggtgaccacatgagtgaaccaaggctgggaaaggagtttggggttaatttaggaggacaaataggggatgctattgtctatcagaagaataaacaggagagaaaggtacagactttaaaaagtgtagctcttctacatgatgtatcacatttattgcttcaagaacttaaatgtcgtagagtagcgtagagacacgtgaagtaataaatgttccacccattattttcagatctgggagtgaaccatatgggacacagaagggtaagtggatatttactgggaagatgaaagtgacatccaaccagagaaatcagaatggcagaggcataaatacatgaaatagcatgggcttttaagctgactctaagaaagttagtattgacagctgtacagagggaagggaaatgtaatggcatggacatgtcagtagatgcagctgtgtctataggatacgccatcttaatatggataatttctaatcagtctaatggttcataattttaacagctgtttgactgact

SEQ ID NO: 97019 - DNA, 1071 bp, Homo sapiens
gcaaagcatcagtctaaccactttggaatagaagcaccattagcagagattgcaaggtgttttgtcaggcttcttgccatgacacacatggaaaatggtaatattcctaggatacactgtgagggggctgctcacaagcagagatgactggcactgctgagcagctccagggctgaagccttggcatcttattagcacatctgtaaacacttgtgttggggagctgtgctgctgagcaatacaacctttccttttggaaagccctacagtgtctgctgctttttatgcatgtctatgattgaaatctggacttagaggagtttttcttaggaaaaaatcaagacattgggttctagattttcagtggaagttaattttacctaaagattgaccagtattcctgatcttgtgtcaagaaacttgaacttggaatcttttcctttttcttctccgttaacaaaatgataaagaagctcttccttagaggatccaggggcacatctcaattctggcaggatcccttgttttcttagggttctggagaaatttacacaagacaaaattttgcccccagggtaatgagaactccccataatctgaggtaggtgtgtacttttaggcctcacttcaatatttggactaggccgggtaactcctgattctgttgtgttagtagtcattcaaaaaatgtttaagtgctcagcaggttctgcacctgactcaaagccagactgaatattgaagaattgtaggtttcaggctaatggggcctgaacactctgtggtatttcttctgtaccttattccaatatcatcacaggtaccacctcgggaataagaagtaacaactgcgaaaccaggggtatcaccataaaaggctgcagttacagttctagaagttgtctcatctgaccagaattgtagtctttgtttggtttggtttaattttaacaacttctgtgtctttggttttacttttgctttttttttttttttttcattaacagactttttaaagagtagttttatgggctgggtgcagtggcttacgcctgtaatcccagcactttg

SEQ ID NO: 97020 - DNA, 1044 bp, Homo sapiens
ggtaattttgtatttttagtagagacagggtttctccatgttggtcaggctggtctcgaactcccaacctcaggtgatctgcccgccttggccttccaaagtgctgggattacaggcgtgagccaccgtgcccggctttgccagctttcttaccaatcaaaagtataagccctataccccttccccagagtcccagatctgttcctaggcttttccttccaggttttatcctagctttgaggcaagggatgccttcagggaaaagatggtgcttagaattttgggatgggaaggcctatgtaatccataaatcaatgtttcgtatggtgaagggaatgaaggtgaggaaaggcacctcagaatatttgtggaagacaaaacatttattattaatgtttattaaaaggaattatggcttttaaaaggcatagaatcaatcacagagcaagttaaacttgaacctttaaatataggtacaatttgcttttccagaacatgaaagtagaagaaagaaacatttcagtcatgggaccacatgtacctgagtaaatcggccaagtgtctttcttctgtggtctcgatttctttttttagtacaaatgttgtttaagcttttattcttccagttcatttgcctaaactgacagtaaattatttttatcacacataggacctaggactaggaggtcaactatttcttaaatgaaaaagtcaataccagcttggctaaagttgactggggagtgggtgcccatgaggctggatgtgattggtagtcatactgagcagggccttaagttccagaataaggaattttgacttggccttacagtgaaggtttctgagaaggttaatgagaagataaatttgggctttgaagaggaaaatcagccaacagtaaaggagatggattaaagagaagagtagaaagaaatgtaattagcatgctaattggctaattaccgtgagaagaaacttagactaggctgttggcagtgaaaagagaaagaaggtagtggatattataaggaagtttttaaactc

SEQ ID NO: 97021 - DNA, 1058 bp, Homo sapiens
cgccaacctacatttccagcatcattatccactacctgctgacacaaattctacgttttgaccaaacgtactcttcccttgagtattgcatttccaagaaatttccctcaactaaaatgcccactcaatttctcttcttgaacagcttattcattcttcatatcagcactgaccacctcactccagagcactctttttctaaattgcaattttaaaaatcacaggaggtctctaatgccattccatattccttgatgcccatccacttgctaacacttatgaaatggtcattgccttcattgtattaaaatttcaagtgcaatttgttatctttgctgtatgcatggattccatttacacactagacccatatattttcttatattctaggtgtcttttttgcttcaaattcctttctagcttttctttaaatccttactttgcccatcttcagtgctgggttggtaaaggagacagaaacttaacaatatccaccaagcaacagaactaccacatcaacaccaagaacttcctggcttcctgggcagatatgcagtgggcacaatttcataacagattaattgctaccaatcatgaagaagttaaaatactctcagaatttagaaggtatacttgatcacattgaagttttgtaattctgtgccaagcccatagattgaatgtcttctattatttagttggccttgtttacttagtggtaatcatttcctgagactgtacagaacattaaattggaatggatacaattctagcctagagtctatagcctagaattagttataagtagctcaagattacatagtgtatgcaattatatgtcacccatgaaaacaaacactacccagttttcaggatctcaaaataaatcacctcaaaggtcctgctttgatctgttttgtgattgggttgcatgggaaagcaaattataggactatgtgaccatgaaaatgcctcttttccctttaactagtgataaataaaaagtgaaaagaaaattacttatcagaaaggagtagcatccttcaatcttcattgat

SEQ ID NO: 97022 - DNA, 1059 bp, Homo sapiens
gcaggcagatcacttgaggccaggagttcgagaccagcctgcccaacctggtgaaaccctgtctctaccaaaaatacaaaaattagctgggcgtggtggcgggctcctgtagtcccggctacttgggaggctgaggcaggagaatcacttgaacccaggaggtggaggatgcagtgagccaagatcgtgccactgcactccagcctgggtgacagagcgagactccaccaaaaaaaaaagacagagatactaattctgttcattcatggttcaagcaacacaactctatgatgtctttccttataccccaaagcaaatgtagattctccctcctctgtataccaacagcaagcattgcacacctctgttttcatataagtcgtgctgcccctgctggcagattttttgatgtgattgttgtctttaaagactctttatttttcaccattgtatcaatggcatataatagagtacaatgtgtagagatttaatatctgttcaatgaatgaatgactttgaagcaaaaaggagactatctaaaattaaatacttcttaaaaagatgatttagaatacaatttggttttgtgaaaagtagattaccaccctagaaatagaacttatggcaaataaagtgaatgcttagggaaaagtgttatgtaggaaactcgatgagctgataaagaaaactttaaactttgtggggtgaggaaagaaagaagtaaaaccacatactatgatttatgacaaacattacatatactcagtcattcaggcatgcaagtgctagtatttctgggaggtgaataagacttagaatttacaagggccttatattctaatacaggagacacattatgcaaataaatatccacaatataagtagcatgtggcataatacacacatagataaaataatcatgttgcttggccttcaagtatgagttggatttggatttggatggtggagaaagttaatccatgcaggggaattagaacaagtgtatgggtgaatgtttaatggtatacattgcaaacatcaaatttcattgactggaat

SEQ ID NO: 97023 - DNA, 1049 bp, Homo sapiens
aaagcatcagcaaattccctcaactgtacctcagaaattttctgacctccactccgcctatctaaaccttttccttacttctgctcctactggtggctcaaaatgatccaaaaatctatgatttctaaaagcctgaagccttttcaaacattcatctttaaattcctggatgcttgttcttttttttttttttttttgacagagtctcattctgtcgcccaggcttgagtgcaatggcatgttcttggctcactgcaactgcccgcctccctggctcaggtcattctctgctcagcctcctgagtagctgagattacaggcaagtgccaccacgcctggctcatttttgtatttttactagagttggggttacatcatgttgaccaggctggtattgaactcctgacttcaggtgatccacccactttggcctcccaaagtgctgggattgcaggcatgagccaccgtgcttggccctggatccttgttctaaagtcacctgttcccccagcgtattactttgtggtggcttcctctgattcacgtcatattaacttagatctactaagatttatgccacatctggatactagaaaacaaacaagcaaaagattttaaacactataaacaaacttggtttagctgagtaaattacacacatgcatgcatacaaatacatatctgtgtatatgcttttaaagtatgtatcagtatatacgtatatgtgcatgtatctacatatatatttatgtgtatatctatatttatgtttttaaagtcctgagaatagtagggtggttgaggatataaaacctgaaatattggtgaggacacattaagggtgtgatttcaatctctgtaagtattgtttcacctttttgcttctgtataatatacctgacctctgtagactttaaaacattggtgagcaaattccctttgaatcaccctgggtggagcagcgtacattactctgttcacaggagatgtctttagttattctccaaactcggtctgttttgctcaccaaaatgaaaaattataaagaa

SEQ ID NO: 97024 - DNA, 1076 bp, Homo sapiens
agcagtcttaccaaatgggtggcagggctggaatggaagcccagatctaccttcttcctgcctctttcttgaatgtgcatgtgctagttttctccttagagaaggaaatcaaaaagagaaatcaagcttaccagtgacttcccaactccacctccattatcactcccacctaatacccatgatctctttctctctcataaatgcctgaagactctagttcccagatgcttggcatctcagtatggacacatgactaagttctgatagtaaaaagttaatggaaatagcttgccatttctaggatgtctttttaaaagagagggtgtgggcccttcttctccttttcctccctcctgctgcctggaatgcataggtgtggctggagctttagcagccatcgtggacaatgaggcaacagtgagaatgcaagcatcaaggtagaaagaacctggcttctgacactgagcagatgccataccagccctggattgcctgtccagacgtgtgtgtgagtgtgtgtgtgtgtgtgtgtgtgtgtgtgtgtatgtgtgtgtctatgtatgaaataaaattttatcttaagtcttaaattagattactcttatttgggttttctgtctcatgcagacaaatctgtccaattaaatttcaagaagtaaagcaaaccaaaaagaacttgagttgtctttttttattatttgtcttttttaactaatatttaatctcttctgttcaggaatatatttaacctggttcaagttctacctctcattttgtattaatctacaatccatatatactcttactggcatatgattttatattaatgtttattgatgcctgaatatgtgttgactatccaaataggttgtaatctccttgaaaccaaagtccaatcactttttagaatcacttatagtttctaactcattactgacaacacataaacctctcaaaaaatatttagagaattgtattaaatgaattatcaatgtttgttagctatttataacagttaaaaatagcaatgcacgtatgtatgttggcggggggctcacaaacttaggcaggtgtta

SEQ ID NO: 97025 - DNA, 1119 bp, Homo sapiens
tctgagtctagatgatttgaaaactttacagaaacttgctgccttctctcaacctaatgttagcatcaaatattaccattaaagtcatgtaattttatttttatttttccttttaatgtttgtattgggttattccagagcaaaagtagttttgaggaaaaaaaatacttcggaaatattcttttatactcttactctttgatcagataaatagctataccagacctaccttgcaataggatattctccataatattttttaaggtttttagttttcaggtctcaatttccaattctagttttgattatctatagtagtatttcataccattttctactttgttttaaatgtacttagcttatcactaactctacgttaaccgtaacagttggttctaatctcaaaagtcaacatccttctcatctctttgcattgctatccactgagggagttggagaaagcagatggaatatgcaagctaatctcagataatgaggtaattttgtatagtgcatgcatttcaaaaaataattaagtacacttattatcctttagatgcaagtctgagtacttgtgagggaagtggtggagtttaaaggatacactctagactttgtgacctaaaatgcaataagtctccagaaacttacttttactttaagaacctgtggcattttgactaagagcaaaaaacaaactccacatgttctcttccagcagtaaagtatctcaaaccccaagcccaaatccattctatgataacaactgggaaggtagaaattgcatgatgatctctaaaattttgataaaccagagctacttttcactttactgtagccttgatgtctttggatgtagagaggaaacatggtagcattgaatttcctgtaccatataaaaatagtggcctctagtggttgtctgacttctcactagagcctagcaaatggaaagtggtgcatttttcagtgggctttggtgatgcctttttaaagacattctgttgaaagagggatgaaagagaggaagttgcatctgaagaatgagaatgaagtgacatacacttaaaagatgttttatttagtttttgaatggtagaggcttgagcacgtgcatta

SEQ ID NO: 97026 - DNA, 1064 bp, Homo sapiens
tttagctttgtgcttcttaccagttaagtcaaaaaataaatacagaaaacttacatatgttcaaattcatgtcctttagtttttttctttagttctttagaaagattttaatcagtgttcttttgttgctattgttttaccaccccccaatttaaacagtgttctgaaaacaaggggttatatcatatagtgagcttggaaaatgtggctgctaaaatcttctttttggagcctctcagtacacattagcaaatctacttcttgaggacatcatgcagttaaaaagaaatctgttcaattttttaatcttggttcaattgtcaaacaaatttagtttcgcaagtatagacttttcgattctcatacataataacatcctccacaataattttcttttaaaactattttggaaactgttaagttacataattctcattctggtgaaagggagattctatcttcaagaaacacatttcttccaggtatcacattctaaaagaaattcaccatggagtgaaagagggcttttgtaagggacattcaacaacaccacagatgggaatttcaacagaaaatttctttgaataatcattttgggaatctgcccttaatgaaagtctctgcattcacattaaagcataattctgtataggtgattctgtagtaggggaatcccatgtggctcaaacgtgcacctctccaatgatttaggcacaggctagaattcctagttcacctagaaaaagcattttccttaattctctttattaactgttactgtggcagccacatgtttgataggcctggagagagcaaattgaggattatactccttgagtattctgtgtttctaatcgaagggcagcatgtagacagaggcaggttcagcatttacttggaaaaaagagaaaccttgcttggatcttacccatagcacctcacacagaggggtgctgcagagttccctccagaaacacatgggttctgatcagtcacccagtttatggttcaacttataaaccagagttccaagctatggaacaagaattttaacctggactttc

SEQ ID NO: 97027 - DNA, 1010 bp, Homo sapiens
aaattaacctagctactctatattaatttactgaaaaaaaaagttaagagaagttaagaaagatgtctcttagtgaatatgcacatgagaaaactctgcccctgtagtcctattagacacttaacttgtcaagttgtccttgaaattgagtatattaaaatcttgcataaataaagcaatcaaaaattttttttaccctgcacaattctattcagagatttattataatctaccataaaccttgaacaacaggaatgttagtgaatggattttattactttttcattttatcagtgctctgcattatattggcatgtgagcaattactcttgtatggttgtaaagcatagtattgagttctggaaagggccattcagatatcacctagcctagctctctagcaagagggacatacccaaatcatttcaacagaataagaagaaacatttcctgattacagatgtgaaaacttgttagtgaaaagttctaggactatcgaaggacaaaccgaaatcccatggcagtaggttgtgctaaggctgtagattaccccagacccacactgtcttcattagtgttactactctaatgagaaactgcacttcaaactgctgctagaatcatgactaaatgagttctaggccaggattttcctgattgcatcaatatattcaaaatgaattttcttcgaggttttctcgggggtattggagggtaggggagctcacctttgaaaatgtagcccagatatcttcagcttctgtaataagtgtattttcatcagagaccaaagcaaccaaaatgttctaataagggttctaataagatgttctaataagggttgtcttaaaatcataacagatgtcctgatacaggtaaagaaacaaaaatagcctgtgtgggaatgtagttaagctcttgagctttaacataatatttttgtcatttaaacatgttccagggaaatcccagaagctggaagtcagtggtgctctggaacttaacaggta

SEQ ID NO: 97028 - DNA, 1055 bp, Homo sapiens
cattcgctttggaaaacttttttgccaagtctaccaaaacttaacatctattttttacgatctaataattctacttctaaatttatacccaatataaatgaatatatgtgctccaaaaggcagatgtaagaactcattaacacattcctattaaaacattgggaacaactcaaatatccatcaataatagagtagataattttcggaataatacctagaaaatttaggaataaatactatggaagaatatacaaaaataaaaataacatagatgcttgtcttaaacatactattatgcaagttaagcaggcacaaaagaacgtatatgtatccatttttatggaactcaaacaaaactgatctatgatgagaggtcaaaataggcatttgccctttggagggcttaatacctagggcagcacaagtcaagtgtctaggtaaagcgccattttttggagtggctggtaggtgtattcacttagtaaacactaatgaagctgtgcactttgatttatgcattttcttatattttcataatactttgattttgtaaaagtttgcttaaaagttagattcaatttataagagactctttgttttgaaaaaaattcttcaatccttccttaaatccaggaagcagcaatgtgcaaagtccaggaggcctccttgggggcattttgcccaataatgaaaaaagtcatattttctttttttttctttgagatggagtcttgctcagtcgcccaggctggagtgcagtggcacgatctcggctcactgcaacctccgcctccagggttcaagtgattctcctgcctcagcctcccgagtagccgggactacaggtgcccgtcaccatgcctggttaattttttgtatttttagtagagacagggtttcaccatgttagccaggatggtctcgatctcctgaccttgtgatccgcctgccttgccctcccaaagtgccgggattacaggtgtgagctaccacgccaggccaaaagtcatattttcacagatacctttcaactgcacatttaaagttcattttaa

SEQ ID NO: 97029 - DNA, 1007 bp, Homo sapiens
attcatttatttggagtacttttaaatattatgtaatgggctaaaaaattttcttgaccaagcagtatttaatggagcaatacaaacaggtatgtgtcctataagatgattatttgattagtaaaataaaaattttgaaaaggccgactgtcagaagaagaaattggatataaaacactaaaccaaatcaacccacaccctgatatttattttcacattcagaagggaaaatccgctaatatccaattatttattttccatgtcaaaggagagctttagattcgtgttacaattaaccgtatggcatgattcgttgcaaactatactttctctgcaatttacttgtaattaattttcttctttttaatctttggaaactggcttttgtttctgtccccccctttaatttatgtaatgattgtccattgactgcagaattatatttgggtgtggcacattaaaatgaggctggagtaatgtgtgtagagatatttgtaatgtctgctttctacttgaagctaggtcatataaattagaaaccatcctagatgacagaaaaatcaatgactaggccatatatatatatatatatatatatatatatatatatatatatatgacctaagccacagcaatatttgctgaaaactccaaaacaatttcactttgaagggaacaattttcagctcaactgaaagtacagcaaaagggttaggaaaaagaaaaagagaaggtgatttgaaaagaaacatgaagttggtcatgagcagaataaaaactatttaagtaaataccatatttattttttggtgttaaagtgacagtggaccttagccatatcaagattttttaaattttaaattaaataatacgtttataaataataaaatcatactgaaatctcgaattctaatccaaacccatatagatcttctttgccttcctccattaaatatgtgtatcttctttatctcacagtaagaagctttgcactcaacaatatcaat

SEQ ID NO: 97030 - DNA, 1009 bp, Homo sapiens
gtcctcctttgctcggttcatcaccagcagccatccaaggtcccaccatgcattcttcagtcttatgagttatttttctgagctgttgaagttacctattcacagtagatctgtggagttggtaggcaaagtcttggatatggctccagttagacaagaaacaggagatgccaacctggctacctgaatggaccatcctgaagggcagtacagtggtggttaaagtgtggcctctggagtcaggttggctggttgacatccaggcttcagcgcttattacaccttgggcatatcactttttgtgcctctgttttctcttccagaaaatggaaataataagagcacttaatggattgtgtgaagattaaatgagctaatactcataacacacttagactgcaaggcatttagaatatatttgataataatactatctactattagtctctcatcgggtaggactaaagacaaaactaactccttattaccagcttctgctgacctctgagacttcaccctgtgaaatctcttccaggctttctgctccccacttctcccagcctaggaatgagtgggaagggggagctaaaaaataactctgaaagtctgcgtcagaatgttctctcctttgccaaactcaactgctttttgttttctctctctctctttcttttttttgagacagggcctcactgtgccactcaggctggagtacagttgctcaatcatagctcactgcagccttctgggctcaaaggatcgtcttgcctcagcctcccaagtagctgggatagcaagtgtgcaccaccattcccagctaatttttaaaatttttttgtagagacaggatcttgctttgttgcccaggctggccttgaactcctggcttcaagaactcctcctacctcagcctcccgaaatgctgaaaatagagacataagccacaacacccagcctctttcttttttttttttttccacttaactttagactctaattcttgactctc

SEQ ID NO: 97031 - DNA, 1048 bp, Homo sapiens
ttctgatcaccttgttgtgagtcataaacgataaaccaaagcactgtacttgttaatgtgcagaataaaaaattgaaagatagaaaatgcattatttttaatgatagaaatgcataatttctaaagatagaaaaggcagaaaataattaggtcttgaaataacagaaaatagcaccaactcttttgagagatcaaggtgataattattagattctgtagctttggaaaaagaaattgctgtttattagattaaatcccttagttctacccatttacttccaatgatccaagcacttagggatatacttgaataagattagtgtttgcatactaccttgcccatagtaaacaaatattttataaatatatatttataaaatcaacactaaaatccttatattgagaacccaaaagggtcttaaacaaatacttttcaagatagtattaatataccaaattatccaattagtaatcataacagttaaaaaattatctacttcagaattatttagttagatatttagaatatatttggaatacagttagatttatacagttagctatctagcaaagccttttggggtgaaatattttcacagacctctgactaatcagaaaatttgtccccttccttacattgctgaacaaagatataaagtaatcactaattattgtaacattagctatgcatgattaatcatatagttagatcatttggaagttatatatttactggttctcagttaagctttgctattctatttattcatgcaaattgttattttaattaaatacacaaccatagtaaattgcaacaagtggtctcaggatctacatgaactagtagttaccagaatttagtgtatattaaatacaactaatattggtattaaaagaggaaatttatatttgtatttagggcctttgcaactgtgaatcaaatatttttacttgttattaagatggtgcctgccaacaatctgttcagaaatacccattagagttataaagcaagaatttattttagcttattaatggaaagttaatg

SEQ ID NO: 97032 - DNA, 1037 bp, Homo sapiens
actcctgacctcaggtgacccactcacctttgcctcccaaattgctgggattacaggcttaagccaccgtgcctgaccccactgtcaatttattttcatatatttagtttgaacttcatctcattagcctagtttgctgagattggcctatagtcataagtctttttgctctgaatataaagcttaacagtattgtttactgtttcctataaattacactctagtgaaatattgagtgacagtttttacatttgatacatctaagtgatgaagattcaaccagttacctagagataacatttcaaaatggaatatttggcaccaacatcaatagagacattctccttgcatttatgttaaatttgtcttcagtcaattcaaccatgcctggttgtgcaacactctctttgattcttggtttactccagaggctgaaatgtaagtgaatattgtaatgcccatcaatattatctacaaggcttattccaaagcttaaatccagtccacagtggagggactcagagtcctacaggggaaacctcacatgcctgatgagccagccccacatcaaaacaagtaaataatctaaacaccccaagggcagcgctagtatttcccagacaacttaacatctacaaactcggaaaccaaacgtatttgttcacctttaagctattattaaaggactggttacttattcagaagaacttgaattcttatgcctctatagtagttttgtcaaactttttgatctctgaccctttactctcttagaaattattgaagacccaaaagagctttttactatatgggttatatttatcaacatttaccatgttataatttaaagctgataatgttaacatcttttattgaattttaaagaagcaatacattcattatatattagaaataaatcatatctttttaagaaaaaagagaattatactttacaaatcagcgagaagatgacagtggctggcccaaaggaaaacagctggtttctcatatctgcttttgcaatcaatgtgccatga

SEQ ID NO: 97033 - DNA, 1058 bp, Homo sapiens
cgaaaaccctcttccacactctgacctcatctagttgaaacattccacagttgaccccatgaaccccaaactccagcatcatagtagtgttcagggagatgaagaccttcctgacagaaccatgtgttagttcaggatctctaagaaggaagggtaaccctaagtcaaaccaattaaagtgacagttgacttatttctctgtatagaagaaccaattcagaagacttctgtgcagatattatgccactgctgacctatattttaaaatatttatgggattaaaattttctctggtgttggggatcaaatatgctttaacagatcttgggcctttaagacagagatatgttggtttctccataaaatcagttcgataagtctgagttgtctcctttacaggcaggaagaaatggcttcccttggagctatccatggaacttatctaagggactcatgtttttagcctgcttctccagcttaggtctgccctgcttccaagtatttctagcacaccaagcttctttgtgagtcttgctatgactagtttttgaaatggaacctatgtttttcaagcccagaggccttacactgcaggttaatatttccagtcctaccctctacctattcatcgccttctttgtgctagccccatctttgccaggaatccgcccacctgccccttgtccaggcatattgccctgcccaagacagagactgacttaaagagtaaccaagactaaccttaaaagcaaccagtaagcatgatttaaggatgattggaaaacatttcctgcccccaaagtattcctccattttagacttggaatgtgacaatcctcctatttgggaatgtagcaacaaagaacaatgtgactggatttgcacagggcaccagattaaatattttatatactttgtctagttgacattcacaacatctctatgagataaaaatcattatccccagtttacagttgagggaatcaaggcccagagaaattaataacatgtctaatttaacacaactggtatgtagcagaggcagtttcacacttcag

SEQ ID NO: 97034 - DNA, 1051 bp, Homo sapiens
agcaggaaactgaataaaattcaataacttgaataaatgtctagaaagatgctctgaccatagattttggtcagaaatattttcttatgtctctgccaacatgaaaacaagacacaaaatcagtggcaggtacttttaaagatatttataattgtcatttattgagtacttacaatgtgccatactccatacgaatttccttccaaatactatctcagttaattcaaagaataaacctatgaagaaagtactagtatcctcctcagtttgtagatgaggaaactgagttgtaagagatcatgtaagcccctcaagctagtaagtggtgcagtagggacttgaacccaggaaacatggctccagcgagcatactcctaaccactaaaccataaggatttagagttctggttctgtaaccagccttaaggtaaaatttcagctgcacactgactagctgaaatttgggcaaatatttaatctctctggagatcaatttttcatctgtgaaatgattaaataagtgaacaaaaattggcacctagctagtcatcagtaaatgttagcttgtagtctactgatgctacacattcttcatttatttctttattcctcaactaggtattgagcccttccttgctgtgtgtgccagatgatatttctctgcacacttagttttaaaaggtttcatattttgtgtacccccaggatcatcagcgcccaaagctaaccaggcacttttccttctttcctgtgtttgaacaccatatggaatcaggattagtcactttgagccttgtgtgagttgctgttgtttcaaatgagtttgcaactgcagcatcttttgttttgttacagtactaccagtctatcttttcccaatatctttttcttcaaaatgctggaattcatttgattattttctagggctatttgagcacaccctctgtgtgaatgaaggaaaccaggttttactgcaggcatctcccatttacatggcataatttaaaattaaaggcttccattgcaaggcagcctctgtttcctgttccac

SEQ ID NO: 97035 - DNA, 1047 bp, Homo sapiens
tatttacaggtctataaaaaatattggttgctataaaaattcagtaacataagtccagggaatgttctgcagaagaaactccctatgatactttcagagtgaatcagtgaggaagtaaatgtatattggtctagtcactattcacccaagccaggatgtacaggggaaaaaaaaaagtagaagtagtctttgatctcatttccccccagtttacaagtttgtttgtttgtggctgccactgtaacaccaagttaaatcaatttccaggccacttttgctgtaaggcaatagcaacttttcagtttctgtggacgtggtctgagtgtgtgggaacacagagattactcagagagccaaaaatgaatgacaagaatgagacccccgtgcaccatgtgagtccttggccatgaaatcaatgccatgatccgtttgctcctgaggacaccaaaagatgtgcaggtagtcccaacagccttggcagtcacttttttaaagttctcaaatatggatttcagaggacagagaataaattatgaaagtttctcttgtaaaatttccttctaacaatctgattccccaagtatcgttcctggactgcttttctattaaattaagttgataatgtaaaggggagactgagagacatgttccaagtatgttgacttctgttcatcatattttctctgcatcttttatcttccaatttttctcttttatatctttttccatccatctttctttgcttgatttccaactattttcaaataccttattcataagtcccatttttctgccccctcctcattttaaatatgttcagtcttttatttctcttccctttctgcttatgctgccatcattttctcactctctgttcaagtaactggatttgcacatggttttatattttaaacaatcactccaacaatatttcagctgtctctgggggaaaaggaatacaatcgtaaatataaatcagctggagccaagtgaaagcaggcttaagcgaagcattaaatccccccttccaatttccaaaaccacaca

SEQ ID NO: 97036 - DNA, 1049 bp, Homo sapiens
tcctggtccttaagccatttggtgatcctcccactttccatgcagagagaattcagacatctaaaaagcccttgtgaagcttttttcatttctgggagctcttgtgtctccactgagaaggcatcctggggagattctgtccccacagccacctcattcctcctcctccctgcccgtgaacatgtggaaaaattcatggactcaccaaatggtttgtcttgattccagacaacccacttttctcattgttttaattgcacaaaatttgcttgccaatgatttctcatgttactgttctacattgcagacctttcattcacactgcttcaccacagcccagtgtgggggttctgagagaagctaaactcttctggttgctaatctgagggaaacccaccagattcattcacttagcctctccactcaatttgcactgtgataaactgggctttgctagttttatgcctgctttattcaatagggataatggaaataaaatgcatacctcagaacaaagacaatgaactgttattatggctgatgaaggtctgatttgtttcaaatgccagttgcttagaggcaaggattttgtaaaaatcaaataataaatggttaccgtattggcaatgtaaatattcccttattgatcttctatgaaaatcagatttcagacagaaaaatgcctgatatgcttaagaatagattccagggcaagtatctgtgatgaattgttatcaagttcttaacttgcttacattacattttcagaagcaccctagtacttcgacttacaaattttcctatgttacttgatttctagattctacaggttaataaaattgaaaagtgaaagttttcatgactcagaatgaggctataatgcagcagttctcttaagtctgcagttagactcacctggggagtttatttaaaagaccatttcccactaccgtatcctctagaggttttgattcagtagttagaggagggcctagcaatctgcctttccacgaaataccccatgtatttctatgctggtcacccttgat

SEQ ID NO: 97037 - DNA, 1024 bp, Homo sapiens
actatcagttttctacttgatcttaacttgcctagacttcagtttccttgtctctaaagtagggctttgtactgggaataaataagaaaggaaagataccaaggaaatgggttgaaccgctacatagtctgatgctatgtggagaactagactaggggggcaataattcctaacttgcatgatgtttgcacataaatcacttagcacagtgcctggagcacagagagatcttactgaaggatagcgatgtattttccaatgcaacctaaaagttaaaatgaaagtaaccataaagtgccatggaaggaaaaaaagagaaaatgagggccagagaagcctctactgagagctagttgttaggagcaagccggtaattggcaggattgatgatgaaactaatgggcagtgttgatttttttccactgtgctgtcctgagctgttgcagcttctctccccatcctgatggggagccagaggcaactctgcggggaaaaactgaaacatgccactgtgctagggggcaactgcagccatgtctgtggtaagctactgtgttatcttgcaaagtgtgtatcttgttataataggagagctcagaatttctatagatttgcatggattttgtgttcatctaggctttttggggtgtcgttatagctgagccaccattttgagggtttgtttacttaagtttaactcctcctagggaaagcatagaatgaaaaatacatgactatggtcttggatttatttagctcaagtttttctatcattgagggagtctcaacccaaggtactagtttgaacatctaattaacagtcaagaaggtcattagagaagaacttgagagttcagttaaggatactgccatacttagtttactccatgtaaaaaaaattaaacacaaaactattagccagaaagattcattttttgctatgcaactgttttagaccacataggaaaactatacttgtttaagctttggactaaagtaaaaggtcccctgaaattttcataat

SEQ ID NO: 97038 - DNA, 1048 bp, Homo sapiens
taatttgactgcctttatatgaaagattatttcaagatacttcacagttcaggaaagtaagatgaaaggaaatcaagataacatacctggagtagagctccatttagaccagggcaatccagcctgtcagactccatcatgccacacttgaccagatgcccagaaggacctctgtggtgaatccccagataggaatcctcagtgcttggcagtcaggtcaaatcattattctattggctaatcagacagactgccaggattgctgatttcagcctcttaataactgccgctatggtgctggagacactacctaggatagaagtgatgtgtctttgtcattcctggacaagctctgagataaataaccaggaagacttcaaaccaaacatggtactgtcttatgctgccaccctaaagaccccagatcacatactattgtcatcctaacatcagaagggttgacttagtgccgttctgtgtacttgacccataaattgcaggtttcaattgcctgtattgttcctctgaaatattagtggcctgggaataagttgtagttgcagaatgatgagccaggttgggaagttatgactttcagtggcactatgagtatgatctgaggactccagacagcagatcattgttagtgcctttgttctctgacaccaaaactgaggcatgtgaagtttctaggacaaggctttatagaaccaagaacaatgtcatctgtccctatattcatatcactggattctctgagaatgctcacagagtaaatgtgggaagaataggaagcctattagacgaaatatctaataacagtggagagatgcttacatgattggaatatggcagtcattgaaaatgaatggcacaagagtacatagtcaaatgcaaaagtgttgatgatgcttgctaagtgggggaaaagcacatgaaaatctgcagactacatgatcccatattaataaatgaaaatatgtaagaggaggcaaggatcatcatggtggacgggaggcaggactggattgcagctccacacagagca

SEQ ID NO: 97039 - DNA, 1058 bp, Homo sapiens
tagagttgcacaggcttcagagctgatgactccaagtctagaacttgaatctgggtcttccaatgccataaggctgactgcctacaaaataatttccactgacagcagctacataaaattatgtttggctattatggattccagtaaatcaatattatataaaggaacaattgaaaacaaaagaaaaatcgccaagtctgttccatgtattatcagtcgctgcatagtaccaatatcattctttgaaatatgatctaaaataatactacctctctgtggtgagctgagaaatacctccctagactttgtaaattttagatagtgaatacactaacagctttctggtttctaagaatatccattaatatcagcctcccccaaaataatgggccgaatgaatactctttttgttatcacatagttcatcatttttaaattctcccagctgctgtttatattagtaggatgtctttcctctcatcctctttcacatttctaataaaaaatactggcatttcctttcccagtggagaagccccacccgaagcccaatcacattgccgggcttctaggctctaatgattaaataagtgattgctctgcctagctttaaaaatgtgtcttatataaggcagtcaagacacaatatccatcactgtaaaggaagccaagcatttatttaaaatgatgaaatatcctcattttcatttttccctgagaggattgtagtgatgttaaaaaattctctgaattctagaactagggcaacacattgatttgaagaaagctataatcttcccttctaatttgaagtatactttctcctcagtgaaataaagtgtggctttcagaatagcaagagccctaggcccacacacacaaagacatcctcatcccaaccactcctctttcaggtcggccccattcttcccaaggcagggatttataaagaccttttcaataaatgtcaaggtatattaaactaaaaaagagaaaggttcaaatcatttcttccagatttgggagggaaatgatttcaactgccaagtcatgatgaa

SEQ ID NO: 97040 - DNA, 1044 bp, Homo sapiens
tcatgtgtattttaatccttgagggcaattcttatacccttgttatgtttatttcagtatgtagaacgatgacataaatctaagtgacaactgtactttattgattttgcagagttaagaggaagatttatgagtcatggaaccctccatcagatttggaagaaagtagaatgagcgcagaggtgacagacagccactgaggcccatggacaatctccacctcacgcttctctatcaaacttgaagatttattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaagtggtatatgcccagggatttgtacccagacagtaactacccacctt

SEQ ID NO: 97041 - DNA, 1080 bp, Homo sapiens
aagcatgaacagcactggcatctcagtaggccatgtggttgtgcttttcctcaattctccatttcattttgattcactgagttccttttttcccacagagtgtggaagagaaaaagaagacttaagtatataaaaaactacctgaatgtactcaatctgattctgatcacatgttgattttgaacttagtattacctaacacatctacatcctgctgctgaaatagttcaataccaaattgttcatttgggtcaaggttggaccacagtattatctcttccactttttgaagaaaggcactatcctacttctccgattatggacccattagtttactgaagattctttttaaacaataagcctgtttcttctgtgataaatttcctgtgtgatgtaagcttttgtttctcaagccagtactttacatgagggataaatgcacagtagaaatgattattctattactgacctttcatcattctgtaccaaattcaatcaacaatagcacagggtagtaacttttaataacattgcttgccctttgatgaattatgagttaaagtatatgggttcgataaacctcttcagctaatgatgcttgttttgtaggctacaattcatgtagggggaagttttgtgtacattgcttcagtataagatccttgttcacctgaagatgctccattaagacatccattggtttgttaaaaaatgcacagttgttgataacctgattgtgtccattttatttccattgctcttagagcttcaactagcctgggtagatttggtgggcgaggtgcaagatggtagataaagggacatcactgttacttgaccatgcattttctctgcagcaaaatagcatcagggcaatcactggggcattttcgagaccatcttttatggcttgtctagtgggttgggagaagcccttttcttggtggtgtttgatgttaattggcagatattttgtgtaggatgttgacagagtcagtcactttatcatattttaaacacatgctcttccaatcctttcactttggatgcattgaacattttaatcatacctggtagtgt

SEQ ID NO: 97042 - DNA, 1050 bp, Homo sapiens
ttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccatt

SEQ ID NO: 97043 - DNA, 1097 bp, Homo sapiens
tctgaaaaagtgctccctattcttggctaccaggtactcccaggtctttcatttgttaattcatcagtgcctattagatgccagctcagtgttgggtagtgactgagaatctagaggtgacagatgggtctactgtgaaggagcctcagtctagctcccttgtaagtagagtgaccacatcaatttatcatccaaactaggccatttctgagagtgtagaataaaaaggcacctcttgcagagtgatataaacatacctcctgcagctgtgcctgttacatcaccttcttagggaataacctatcaaaagtaagtgctgcctcttgaaggagattctgatgcttcgtcagccaacttgtgtctcctgtttttggaggggtcagtgctataactgtagcctccaagatgggtggaaaatattgacagacattttatgtaggttacatgcctttctggagaaaaaaaattcagcacttaattttttttattagaatgcactttttaaaagctcattggtgtcagaggggtttaatgcaaactaaaaggatgactaatcaagaaaataaataaatagttgtagacttataccatacaacaaatattgggacgcctataacaagaatgttcaagccgacttctctgtgtcctgtggcaggactggtcagactttctatacagatttgatgtttactaacctctcatttcacaatgactccacgaactgtatcttgcaggctgcctagtgggtctcagctctactagccagtatgtcaagtttctggcaaggacgtcggcactgaatatttctcccaccaccaccctaactagaaacagttagctgcccatgccaccctttgtgttatctgcaagatctctctaggttgtctttcaaggagaggtgtgacttaccttggatcagagaagaaggatgatggcagtggctgtgggaggggtagaggaaggagaaggttattgggatgatctttcagatttaatcatgtgttaaaatgagacctttgcacagtgaaataagatttgaagctggaggtacaaagtaaaagtccgccaaacccatcccagcttgttttcttgcagca

SEQ ID NO: 97044 - DNA, 1062 bp, Homo sapiens
ccacactttctgatcagtccctacttaagacaaaaatatatttctagtggaagtaaagtaggcttactttggtgcaggaaacctagtctttgtgatgacttacatttttctaacattaccaagtgtgtaggatttaaattaaatggctcttttgttgaacagtctacttgttaatagcctgacaggcaagtctcccagtcccagatgaaatctctctgctgtttttttacttcattggttaaaataaaagagaagtcactgcctcatgatttcttatataacaggtaataccgctccttgtttgctcaatcaaaaaaatttgaaagttaaggaagaaaactaaatccatatattttttattcattgtgggcttataatcactattttggctccatatctaattataatcttaaatttgatcctgcatcttatattaggttatcatttttttttttaaaaaaagaggactttcttgccaatcctaagaaagcctagttcttaatcttgcactacttaagtttagcatccaaaaggttgtgtaaaaatacatgtaccccagattcattttaaaacgagagatctggactggtcacctgccgatagatttagaaacttgtccttgtcatcaggtttatgctgtccccattgtatcatcaacgtttgtgcccaattttgttcctttgttgttgttttttttttttttttgatgtgtttccaaattgatacatcatagttgcacatatttgggggatacatgtgatattttccaattttgttcttgggctaatgtttttcagaatcacccactatactgcataacccacggtaaccattccataaaagaaaattttcttgccagattctgtgtctgctgagctatagaaccagatagcaggaattcatagtcaggaaaccatctgaacagctttaggtgcaaacgcatgggcctggccagtgtacccttctgacacaagtaaagagggagctgtccattaaacttgagaaatggatttaatgccttaatctttatccttgtagaatttggtcagcgatgagaggttt

SEQ ID NO: 97045 - DNA, 1029 bp, Homo sapiens
cctcccaaagtgctgggattacaggtgtgagccaacgcgcccagcccatagtcactttattttatgcttataataatctttggagatgccttcagctcatttcatcatctatacctttttcccagtctcactaatctcctttgcttttctgccttacttgattctctgctgtctttaggagtctgttttaaaactgtgccagttaacttttaaaaattgtgtttatgtgtatgaatggtgtagatgccacatatatggcattggtataaatttttaccaaaatgagtagttacagttttgattaaaactaacattgctgctcaggaggcagtggatcctccagatggccttcagcttttatttctctacaaaatggcaaagtacgcttaggctctcaagtatgggagcaacaaaatctctctgctcagtcatgagcatatggttagatgtgcgaagtgctctgttctttctgctacagtcagggatatttaagtctgttatgagtgatccacaatttactgagcagcagtacacttttacgatgaaagtcttggaaaacagtgaacatatttcatctcatattcatttcagtgattatgctgtgatattcactgatattgactttcagtgaagaaaagcattcattattaaaatagtgtctttattacacaactgtactatgattttgaaatggtgacagggaataaaggaagaaaactccttaagccctttctgggtttagacaggcttgtggttagttgaattatgtcaataaatacagctgagtgattcctgattaaaagttgtctatgtgttaagtttaataccttagggaattaggactataagtactttgggggtgctgtgctgattacttttcttatatatttttaccagaaataaatgttgacctgttagatatgacgtagggtttctgttttcaaaaaggcactgcagcctatttgattgtaactcattgctcctggtttcccaattatcttttctttctttaaaaaaaatctttactga

SEQ ID NO: 97046 - DNA, 1037 bp, Homo sapiens
ttataacagttcttctgagcaacttgcaatttatcaatttccctttacaaagccttcagatagaagattagtgtgatcatgttcattcgtaacctttcaattaagtaattccagctgtattcacttgccgcagcctctttagtcccatccttatgagattgcgaactcctgtcacttatcattgagaaagtacggtattttattcaaccacatttttctaagacaatgtatctgttgctatcaaatgatcagtgtcatgttaaaggagtttcttaatagcatacatttaaattgctcatcttaatagtccaacaagctcataggctgtttgtacaaaatacaaggttatatcagatgctacccattcaacctttgctgtaattcactccatagctactaatgataaaaaaggattgatgatggtaggtgggattaaccttggcaggaaagaaaagcagtgtcatagggaacagttataacttctggaggtgcatttgaagattaattcagatagtagccagagggcacaagttttttagttcgccaaaaatagaaaaaataattttgcataacttctgttgaataaatagcaagatgcaaatggcacgtggcaaaatgtatttcatgttgcttctgattttctcctgatagagtctgaattgttgaattaaaactcatgggcgattttagtaaatgaaaaatatatattttacattgtactgggttgttgatttttatgttatggttactaatacatattcatttcacatttggacagatacagcagatggtgtatctcaggagctcttctctgctggcttggtggatggtcacgatgtagttataggtaaattgttttttagtatgcactgtcattttgttggtatataaaatggaaatgtgtttggaagcaaaagtgttcattaaggaataattcactctgaatatttgaagaattcttcttgaattcttatcttttatgtagaagtatatttaagaatcatatttggacgggcgccatgactcatgcctataat

SEQ ID NO: 97047 - DNA, 1051 bp, Homo sapiens
caccaaacaaagccattactttaaatttatttataagggcaacaattattagctggattatcagaaaacttctcagattctcatgggcttgtttcactccctgacaattatcaaggtaagtcaatcccagtctctttgtttcaaaccccaagccagagtgtcagtctccacctccacatggtcagggcctgtttactcaagcaatgctgggccgcttgaggacatgcaggggcctgcctcccccaaatcttgttatgtatgttgggttcattgttagcagctgctgtaggactcagtggaggatttgatacctacactcttgtttaggataggtgaagggatgagacagaaaagatctcagggcagggactaagattggacttgtaaaacacaacacctaaagattatacatattgctgttgatgttttttcactaatactgagtgcttgcagaaggcactgtccatgccttctcctcatagttatgccatgaagtagttcgtgtcactaccttattttatagatgaagagagaaagacttggaaagttaagtaaattgccccaaggtctcatagctcgtcagtgttacaatccgtatttaaactccagaatgttatctccagaaaccaaggtaggacaggctgagtcggcctaagcaaccaagtactttgtgctctcctttgactcctcttgatgaaaggataggaaaggagtcagaaaagaggctgttacaaggagttatgctcccctgccttctctgttcaaataaaataagtgtattgtacacttcagaacagcctgaaactcagtgcacaggtggctcaggaacagcgttttagagccataaatgtaaagcttttgtagccatccagagctctgctacatataccaaggccagagtaggccacagcttctatatattgagtcttgtctgagctgaacccaccatcccaaatgttgactgttggctcactgctcaggaggaatagtttcgtagccggaagtctcttcaatggaacagagccctttacctttcttagattttgtccta

SEQ ID NO: 97048 - DNA, 1008 bp, Homo sapiens
ataaagtaggtgaagtaaaatgaagctaaaatgagattttaaaaatatcttgagagtggaaagagaattgggcagggaacccagagtgatataattacaatcactgagaagaaaatttagccttcagcttgttagcaaccaggaaattatagttgtctatttagtcctcctctcttgacaaaagtagacctataggattaaaagattatatagcgaggcaagcttttgcttgataccaaattcaagtggaatttatctcttggttctttctataaagaaccttggataacatggcagagagcttgacctactgttgcaaaaaatgttcttgagttattttttcttagattgacactccttagaagtcaagggcttatcttcattgaattacagcatacaacataaagtaatttcttcagagcctaaaccaagttcaggtctgttttctttccactgatcaactctgagagaagatcttgagcttaaagttaaggaaatgtttttagcagggaaagaatagcagttagtccaagttaggagttctgaccaccatctaaagtacccatttgctgtatgttgactgaagggaattcttaggtttacagatcagatgagtaactagcagcattaccattctcattggaaaattcaaaaatctgatgtcacttagacagacgagcctccacttgcagacatactgtagagaaggaactttggggatagatcatgcatttttttttttaaagagccaataattctttccccaaatatacagtggacagcatacttgtaaaccatacagtataggagaagtgatattagcctgggcaaattacttttcaagtaggtgtgatcaatggcttcctttcccataaaccttgtgtatcctttggaacttttattattttaaataatataataatattttataataataaatagaataatattattaatacctctccaagagttggactttaggagttggaaggattgcatattttttaa

SEQ ID NO: 97049 - DNA, 1081 bp, Homo sapiens
aacatggcacatgtatacctatgtaacaaacctgcacgttgtgcacatgtaccctagaacttaaagtataattaaaaaaaaaaaaaagaaatatcgaagtattagtcacccactagtaattaataatttataacaagtagatagctcatccttgtttcatttgtttatcatcatattctacttggttgatggaagccagtgaagactaaatgttattattaataatattaattaaacagatgtttaatctgtgcctgatttccacttggaactgtgttaggcactgtgggaatttcataaaagtaaagacagctcgctagctggatgcttttcatctctttgggggtcggggaaggggtggtatttgcaaggacagtttccttaggtagtgtttcctagcttatatagcgtcttaggttatataaaacttttcaactgttatcccattattgatcttcttttgaccagtggttttggaatctctttttgtcaaaaataataagtacatgttttatgactttctgtcaattttgcattatatcctaattttctacataaaaagtgaaattgactttatctttaaatttatagtttcatttgggttcatttaactgaggagggcatttgctaaggcttctattaaagtaacactcttttttatagtagcatctcagttaggtgacatgaaaataaacagttcacaaccctggctggaaacctttaaaaatgcagtgtctagactcaacccacagattctgatttggtaatttgggatgatgtccaggcaactctgatttttaaaaagctgctctcaggattctgattcacagctaggatcaaggactggctaggaaaactgcacaaatccctcggaatccagaagtccagactggaatccaggaagctggtgtgctcaaaattcctgaagatttgttttaaatgtccatcagaaatttccaaaataaaaataaggaaaaagaaaatgtttcagaaatcccttgggaaagttgtgtttatttaatcaagggtaatgaagcaggtgggaaaggtttctggctgaagcccagtagggctcacaaaa

SEQ ID NO: 97050 - DNA, 1046 bp, Homo sapiens
gtcttaggtttttagattgccaatacccatggtctagtatgcgtcattaggcttcctgatttctctgcctttgctcagtcagcaggatgttgcttgcatgcgcttccttaggcaatttgatgcctaccacatggccttttgtatatggcaactaataaagtgttaactgaagtaaacatgaaaaatgagcttgatccttaattgcttatatgtgcaatgttcttccaaaatattttgttcttcatgtatatagtaatgcatttcaaaaaacacagcatttttggaaagaggatgagtttgggaacctggaggctgtgtagtctttttggatcttaaccgctagctatccctggattcacagccactcaggttattttcaggttggtgtgtatgccgtataacccaagttgcagcaccagtgaaatggttcacatttgactagtgaagaattgtgtgggcttgttttgattcaggtaagaagagttcctgggtcaagtggtcaccttcataaaaccgaagacggggactgggagtggagtgacgacgagatggatgagaagagcgaagaagggaaagcagctttttctcaggaaaaggtaaatgacatcgttgacgatgagctaatctgtgtaaattttatttttgtgattgtgtgtgtgtatatatattaatggatacataattgttttacagtcacgaagagtaaaagaagaaaatccagaggtgagctgtggctatttatttattattttgccatttcattcctttcttgtggtatcagagtctgatccatttaggggagatgcttcaaaatctcatggagtagaaagaaaaaggaaaggcacgaggactttgcagctcctaattctgtctgagttactttgggctgaataaatcggggcaaattactttgctttctgagcctgtttcctcatctgtcaaatgaggatgatcccagtacttataagaaagtcgccatgagggttggcaaaatcccgtacacaaaaccctccacggaatccttgtcacagactaggtaatccatt

SEQ ID NO: 97051 - DNA, 1605 bp, Homo sapiens
tagtgagaattaaatacaaacacagccaatattctttcacagctttcagatcactttcatttatgcttccatatttgtcccaaacaattgttcttgaagacaggtagagcaggtgttactgtcacactttacagatggaaatgtgagaggtgaaaaggacctgcccaaagtcacatggccaaataagcaggagtgaactccagttcttattctcaatctatgctctttccaccaaatcatacctcagaatgaagaagaagagaacggagaggacaggaaggaaatatagatggagaaggtaggcagagttaagtggtgtacacaggaaaatgggagcgtatttgtcattctcagagtgagtcggccaccatttaaattgtgtgaggaggatgtctgtgctattcacaggcactaggagatgctacaggcactaggagatgctgcaggcatcattgcaggaatctgggaagtttgccagggttctagcaagtgtagagggaaggaggtgacaaaaaggctttggagattatgttggggagagagatggctagtgagagtttggttagcatcaacagttgttagataccgtcagaagctcagcttctcactcatgaagtggtaatggtaataatagctatgtttgggaggactaaattaggtaatacataatataatagtggttgggacaaaataataagtggcacaggttatagcaaaattttttaataatcacatatattgcttttattactatagttattatagtccagattgtttttgtaacatttatgattgctgccacagctgtgggcacccctgctgctgttcccatttctgctgctgctagaacagctgtttccattacaaccactgctaccagtagtgggcactcaggtgcacatgatacaaggacatagcacagacagtgaaactcacctttctgtgaagaacgcacaaacgtcacaagacatgcaaaactcaaagagtaatagagaataagcgctttggtatgtgggcatagcatctgtgctacagctacgggaaaggtcatgaagctggtagatgggggacatgtgaagggggaagagagaaaaacgatatttattgtgcacctttatgcatcctgctagatgcttacgtcacatttatctcaattactgcagccatacaacaatcagtaaagttctgagtataagatatgttaaataggttaggccagaggataagatacattagactattaagaatgatttttaaaaagctataaatattttgaaataccaacagaaaaggaaaaaccatctattaaaagtgagttaagctatccctaaagggttacaggattttaaaattgagaaccacaaatatctcctagttttccatgcttctgtgtacaggcctgaaaattaaggcctaaggaggtcgagccttaaccaaggccaactgcatcatcatgtcctaacagtccaaagccagtatcccagtttgttaccatttagtttcttcttttagtcgataaagagggaaaattaccctgagtttctacagaattgcttttttcccctcctggaatcttataattaacttataaaatatcgaaggtta

SEQ ID NO: 97052 - DNA, 1051 bp, Homo sapiens
cttccagtcttatattctaacctccagccaaactgaaccatctgtgcttcccactgtgtaacccatactttcctttggagctttttgaaatttgaaaaaatgaagaatctgttcaggctgtaaccttcatttctttgaagaaaaaaattacttggccgggtgtggtggctcacacctgtaatcctagtactttgggaggccgaggcaggtgaatcacaaggtcgggagatcgagaccatcccggccaatgtggtgaaaccccatctctactaaaaacacaaaaattagctgggcgtggtggtaggcacctgtagtcccagctactcgggaggctgaggcaggagaatcacttgaaccagggaatcagaggttgcagtgagccgagattgtgccactgcactccagcctagcggcagagcaagaccccgtctcaaaacaacaacaacaacaaacaacaacaaaaaacttattacatattagtgtgctgtgcattccaaaccccagtttgcatctatcttaaacaataagcaactagagtttcgtgagatgtgatttttcaaccatgtcttctgccatttacttgctctttgcttttagatgaacctcaggtcttgttccatcatccatcccttcaaatgcaaggtggccgcacagctcagtgtcacataggagtgaagggagaatgcaaattagttctttaagcatcctagagaaaagagagtggcctgttttgctgttatcctggctctctagtttcataatattggctgttttccgatcataattctaattttaatgagcaattgggttatcagctatactccacccctcacctgtaggttctttgacatactctgcccgggacagcatcgatcatggctcatttctcattcatagtaagtgcccacaaatgtttactgaccaaatgatcacatgccaaggaaaagccctttgaaactgttttccactcatttgaacccccacaatgcttggcatacacgtgttcctaggattcctgttaatagtgggtagtctccccgcaagccccgct

SEQ ID NO: 97053 - DNA, 1002 bp, Homo sapiens
aaaatagataaatgagaaaataaaaaccaaaaaaaccctaaaatcaaatgggcagcaggacctcagcttttctcacacttcctatcactgtcttccctctgtcattttcttttttttttagacagagtctcgctttgtcacccaggctggagtggaatggcatgatctcggctcactgcaacctccgcctcctgggttcaagtgattctcctgcctcagcctcctgagtagctgggattacaggtgcccgccatcacgcctggctaatttttgtatttttaacagagatggggtttcaccatgttggccaggctgttcttgaactcctgacctcaagtgatctggcctcccaaagtgctgggattacaggtgtgagccaccgctcctggcccctctgtcattttcttaatttcttccagttccattctttcattctttctcatggagatagtttggcatatgtaggattttatcccaaagtgataaacacttcagctgatttgagcaaagagaaacctctaatctgctatttagttattctctgtgtaaagttggaattacctattacttaacaattaagccaataaaaaaagaaggcgggttgtttaaaccaattctattttgttaccttattgtgtttttgtacttactgatgaaggctgagagtggagtggagtgcagagaaaggagttttctttgcagcatgcttttcccttttacatttttggttaccatggcaatgaccttgctggagaaggcaaagtattttcccagccccgtatctcaaggtatccctggtacttcccagctttctctctacagcatcctacacttgacccttcctgtgtggggaggaggatttttggtggggggatggtgcagaggagacagggaggcactttgcctccttacgttggcacttcctctgtcctctttttttgctagcacgagtctcattttcattaagtctttctcctgttccccgctgtattgaacagatgc

SEQ ID NO: 97054 - DNA, 1046 bp, Homo sapiens
ctctgcctagaggcacgggagacaccctgtctcagcagcaggttatgcaagtacatgtgcctgttggtggcaaagagaacagatgtaaggcatagctgagagttgaaatgagtaagaatatatcagcttagcagggagggaggcagaaatattttaaatatttaggtatgtatactactgcatattttaaaggctgaaaatagtttttaatggggaatatcacttctgattttggacaagcactgccctagcctgcaagccatgaggctaaagttaaggaagagtgaagcagagaacatgaatgaagaggcaactggttatactcagaaaatagaatacacatgaaaattaaaatctgttggggtggggggggtgcaagtgctttatagtgaaccgaaatatttgttttgagtttcaggaacagtttataactatgtgaattatggtttgatgaattacgacaaaattctcatacatgaatttttttttggcataagtgaataaggacagtaaattaatgtggctccctgatttttggtatctcgacaaatggtaacatttgataagagctctagaatgaaccaagaatgtactcagttctggaaactgagtttttcattccagctgcacaccatcagtgagaaatacttggggagattgtaagcagcttctcatgctttaacagctgctagcagttgtttgagcaacagcttaaggaaatgttactgggtgaacccggtggaggagaaccactttgctctactctcctgctggaatttttgctcagctctgcacgtttagctgcaggggggacagggttgagcttcacagaagagtgtctaggggggcatgaggcagatgggactcagtctccctccttccctctcttttttccttcctgtaagggcctgcaattcattattaaattaaatttcacatattaccaaatactatggaggtctgcctaaaataagagtttttagacttgaaagcagagcaattcggtcctttgcttattttttcgtttatttttctttttcccagaa

SEQ ID NO: 97055 - DNA, 1050 bp, Homo sapiens
aatgtattttctcatttaccatcacagcagtcctgagaaacagggacagttttgttgtcgttttttggatgagggaggagctaagatccaccagagttcaggctggcaccaggatgcaggtgtcctagtaactcacccagtcttttatctccctgtcaagccttcggttcaggtatgaggctcttagtcctatgtggcagggctctctgctggcagagttggggggtcatctgggtgataacagtgatctgaagttcctgtgtctggtagctggtccacagggctctgtggtctcctgtagagaactttctaatctgagttgataatgtgggtgagagaattggtccttatataccttctttgaagtaatggcttaggcagcccctcaggtaggctttcgagtaggaaagttacccaggtactcaactgtgattcacttgtgttttgcttgccaattttcaccccatggtactatgtcatgttttgctctttttatagaaagaaattcaagccatgagtcagtgcagccatcccaacgtagtgacctattacacctcttttgtggtcaaagatgaactttggctggtcatgaaattactaagtggaggtaagtggattttgttgttgttatttatttgcttgttttctctccttttgttggaaccagcatattggagaagactttagattgaatcctttctctcctgtgtttgaaagtttgtttggtttctcattgcctagaggataacgtccagattgcttcacattgaccttcaaagcttttcataattttgcttaacttccgagaatgtgtatgtcctcttctccaggtatgaaatgcccgaccttctaggctgagaggcagcccccggaatgtattatgtgctctcatgcctttgcccctgacctgtcctctttctcagccttgcatctctcctttgttttccatgtgctcaggcctaaaaggtcacatcctctccacagtcaccgcttactcttcaaaaaagttagccagtcctttctccttgagtcctttctttttaacattgt

SEQ ID NO: 97056 - DNA, 1878 bp, Homo sapiens
agcaagctctgaagaaataagcccaaagagtgttcaaacatcaattatctcagcttctcatgaaagccttgaagtagcttagaccagagtggtttggtttgggctgaggtggaagaagagcttgagatattttaaaggcactcaagctagaaaataccaggaactgaggatggaaatggctttcatgcaaggttgtatgtagatgctcatgtcccttgtcccctgtgtcctcagacatacattgtctggaaaatgcagttttttttttctcctccagataattattttaggatttaagaaactctttaaaaaaaagatgtcaaatggtaatgttctgaatacgctgagtagaagagtttaaaaaaattgatctttaggaaaatagttacagatagtaacctcacagtgtgccatttgatcgctgatgttgtttttatttcattgcaggcagtggagctactgctgtggttcaggcagccctatgcaaacccaggcaagaacgtgtagcaataaaacggatcaacttggaaaaatgccagaccagtatggatgaactattagtaagtaacagtgcagggaatacctgctggttgcttttcttaatctatgggtatatggggatggttgggagaagagcaaggtgttatctccagttttgacatatgcatttcttggaaagcagcccctaccacttcctgctccccagattaatgggactgtaccttatgattgtgttgtataatgaacaccttcccttgctttgagaaacagtattttgctcagttcgaataatcccaaggtgagaatggcctcagcgttggcactccacttgctgtatcaagggcacacactgtggcgtgacctaacatgacaggattactgactgcagttttggatggtgagcttctggccctccatctagaatgtgtgacacaaatggaagttgtcccccaaactatttgttggtcattttagctttcataaattatagcatcacacaaatttgagttattttttttttaaatgctctgtagcttgcatttggctaatgagaggagtttgtttttcttaacgtggcaatttgtacttcttattctaaatgagtactttatataaataattggagcttgtcagtgtggatatgactatagtagcaatggttggttgaaggaacatttgcttttggcttagctgactcattattaaatgaacagcttggcaaatggttattagttgcccggcaaactgtgaagggtttgagggtttaatctcataaatatcgttgttgttctaccggccaattttctttttttcccttttggccatttatttgaggataatagaaaactgcagtggaggagttaactgattggttatccccacactaatcccagtacaaatattagtccagtagctccatacaagctacaaagtataatgacagttggctgcaaatgaagaagccttttgttacagtctacattgagaatggaatgtcattaacaacagctttttgtctttactcagaatatagcttttattttaggcttaattacagtacactatagtataaattaagtacaaggataaagctgtacttttccagatctgtttggccttacattttaaattaggctacacaatgcatagatttcattgggttttattgaagcaatggattgccggctaaaactcagaagagaaccagggcttccacaatttaatgttaatttttgaaatttgcatacattcaaggcttttaacggccttgaaatttcagctgtgctttgctcttactgaaattcctgctgcatgctacttgtctgttgcttgctatcttagtgaccagtaatattgtgcctttgtcacccaaccagt

SEQ ID NO: 97057 - DNA, 1143 bp, Homo sapiens
tattggaccagggctctgtcctgatgacctcatttaacctttaattacctccataaaggtggtaattatctgttaactgtatctctaaatatagtcacattggggattagggcttcaacaaagacattttaggggaacacagacattcagtccacaacagcattttagtcatccctgttaacttctgcagaggaagtgatcctatagaaggatttattccacttgaagcaggaatggtcacctttggcactttattatctagtgaactgcctgctacatggcagggatttaattactgtttgttgatgaattaatataagcaaatatctttttgctgcttttttgcactaaatgcactaaatgcaaagaggaagttattgtgtgagtcatgggagtagggactttgaacatactgttgaaactgcatttgacaatagtagtgatttttgcaaaataaacactgtagtttttcatgttaatttcacatagaccttagtgaaatgcaaagttagaatactaaattatatttccatgaaatatttctttggataactgaaagtataaaatgcaggtatgcagtgttctggttatttaccttaataccagcagcagtacagaggggaaaatgagaagaggtgtcaactaaaggaaaaatctgcatcatggtaatgaacgtgagcaatctcttacctctgattgccattgacataatcactatctaaaacttccaagtagctgttcttagtcgggaattacttagcaaaagtgaattgagatagagtgacttaaaagagtgaactgaaaagatttaaagccgtgcccacttaacttgtgcatatgtgcatacaggccataatcctattgaatgatttattgcacttgaaataggagtcaggaataaaatgagaaattcataaaatgttaagaactcttattccaaaaggggtgcatgatacttcattgaaaatatgctactaatgttaatgagtcatgtgtcagtatcatatattgttcaaaataaatacaaggtgctgttcagcatagtaattgctcttattttatttcatgttgctaacacttgtccagttcctgtatttacaagccccacattttttagcttcctcttaaactaatcagcaaagt

SEQ ID NO: 97058 - DNA, 1007 bp, Homo sapiens
aatagcagaattgaaagtcataattattgtggctataaatgtgagtacattcatgtgcgtgtgtgtgtgagtaaagattgcaatggaatatgcatcatgaaaatagttgtgtttgggcaatgggatttctaatacactttttgtcattgttgtttagtatggttttatttttactttttttttttttttgagaccgagtttcgttctttttgcccaggctggagtgcaatggcacagtctcggctcactgcaccctctacctcctgggttcaagtgattctcctgcctcagcctcccaagtagatgggattacaggcacccaccaccatgcctggctaatttttttgtatttttagtagagatggggtttcaccatgttggccagggtggtctcaaactcctgacctcaggtgatccggccacctcagcctcccaaagtgctgggattataggcgtgagccattgcacccggccagtatggtttaattttaaggaacaagttaattatttcttttaagcctttacaaggaaaagagttgaatggaaagaatacctacaaatactggatatttacatatatattttttagttatacgtaacatttctttataggagggcagtacacatgaatacccatttgtaagatatgattggacagttctttccccctgaaatatctcttgaacacgggaagcacatccccttctcggtttttattgttccttcccctgcatcctcacctttccttgttcctgatgttggaggttcattgaacaatatgtggcagcccaaggctttcaaattgacatctggagcatgcagaacatattctggtggatgggccagcgttggcagggttttgggatggatgaagagagaatcaaggccgttcattataaaatggagtgatgattatagtagaggcgattacatatttagtttcagtacctaaatgtctcctcctttgcatttaacttccaatctatcagcaagtcctgtggctctac

SEQ ID NO: 97059 - DNA, 1040 bp, Homo sapiens
ggctatgctatgaacacatttcaagttgtgaatgcctggtttaaggttagtcatggagcatggaatgagttcttctttgcaacttagtgctctttgaggcatgctctaaacagttatcaggttataccagtgagcccttttcagacatttaactgaggtttttcacatctcacatggctcagagaggttgagtaattttcccaggagcacagggtcaggagagttggccaaggcaatgtggagaggtgggtcagaacagacaacttcatgaatgaaggcttgttcaggagggcttattggtctgtacttaaggttagggaggaagtcggtgctctttccctgcaggtgagatggggaggaaacattctcaagaacagtaagtttcagtagcttccttacgcaaacactccactgaacgaatatattcgtctggtctgtttgttaagcacaaggtattcagataatctttgcctgacaagctgcttttgtttctgtaaaaggaaggtaacaggaaggtcttcaatttacgactcaagctttcttctttcacctcttctaaagtgagagaaacaaaggttctggatgactggatgagatattttttaaaggtgccattcaggttccttttgggtattagtttcaactgagatgtctcattctttctgtggaactaaaacgaataatgatcagtaagtcatttttgaaagtaactgtgacagagtggggcagttaaccaccacctctccattcccagcagctggtatgcacaccctgattatggtatagacttagttaataagagaaccagtgagtgtttgtgtcagaattttgctttcagaaccaggcataggaatttatacatgaacgccctgtgcagaaagaggaggtgtttgcacacagctacactgacagattattttccactcttgcacagtgactagtacagattcctctcatgagctcctcagagacgtaagacagggcgttgatgatgctttatcaagtagacagtatgtttgctacccacaactaagtaaaat

SEQ ID NO: 97060 - DNA, 1549 bp, Homo sapiens
cttgaggtcagcagtttaagaccagcctaggcaacatagtgagacctttatctctatttataaatgtatatattattcacattaaaatttgttaaagaacaactttgattatcatcattattcaaatactcaagcaaaggaaggctctccatctctttccttggacagtacctcatagcataccattatgtttcaaggtgcattctatagtaagatgagcagataatgcttggatgataaagtttaaagtaaacttgtaaatcaaaatttgcaaaaaaaaaaaaaaaagcaagaaaagtaggttaaaggaacttgacgtctcctttttaatatcaaggtaacttgtcagggcctggaaggcatctatcaagttgtgaacactgtctcgtctttttaaatggtgattctaataaatggcttttttagtttctaaacctggaccattagacaacactgagattggtaggagagcaattgtgagaccagagttttgttgcattgagaggagtgcttgcttgccccagaccacttggagaaaaagtcaggaatgggttagatatgttttctttttctttagctaagggcatctgtctgactggcattgggtttggacagtagagggatagaggagacctacacacaactctctatgatttagtaggaggcaaggaagtaaaagaagtcacagaaaagcctccttctccctgaggaagtggacagagatagagacctcttccgtccagggtaggaagtccccatagtgcctgacttatctgtattctgctaggcttttgagcaataaattgagagttaagtgtatgtggaaagtatctgaacacaccgaaaatatctgaagattttttttttttttgaaacaagagtctcactctgtcacccaggctggagtgcagtggctcaatcttggctcactgcaacctccacctcctgagttcaagcgattctcctgcctcagcctcccgagtagctgggattacaggcatgagccaccgcgcctgaccctctgcctactttttagagtgctatcatctcactttttcttccttaatatacaaattatgtgaatctttcaaggttccacctaaatgcccaccccaaattcttgattcatatgattcttagggaaaatgacctgtagctgtgtaatgtagcagcttgggcataattatagcttatttcgtctggtagctttttaagttcctgaagaataaaaagcatgcctgtcctgagttttatgtagtaagatttaacacggttcgtaccactagttgggagctggttgttatttgttgaatggatgcatgaacttctgtcaatcttttgattctcctaatagctttctctgtgtttaattgaggctttccccacgtctttttcagagtctagagcttttggaatctgcttttatttcttaacacttgatttttttgggggtggaggaggagtgtattctgtgttcttctgtttgttctctatggctggaattacttttggaaagatgtgacactgtttcgattttgtctctgagcct

SEQ ID NO: 97061 - DNA, 1032 bp, Homo sapiens
ggtctttgttgcgccccggtgagtgccagcgttgctacatcttggtgatccaaagaagaagtgccctttacggtctgaccttgaggaacttggaaagtctgcaggagagaaacaaacagggaaatgattataccctttgaggtaattctctggtggaggtgtggtaactaatcgttccatctccaaagtcctcctgtctttcatcagtagcatgttatatagttgtactgttgatcctaaaggaagggatttcaattccaacttggaaattccagccatctattctgtcttgcggactagttgtcttgttccaagatagactagtagtgagagacaggactaatgttttcatacaactttgccattttgttcataaaaagtttttgaagtttagtgctgcctatacaaacatggttaaatgctaacactaactgaatatacatgtaagtgtgtgtgtatttgttttttgacacgcatgtattaacataatgttctagcttgtatgtaaactctggactctgagacaatcaatgtttaaactttcaacaaggaagagaaataacgaaaagaaacaatggtttttttgttgtacccagcaactaaatttaccattgttctaagaactcgacaaatgaccacaggatgtgaacttaatcgagttgtgcctttgaacaaaggtatcctagtgatagtggaattttttacttcctatcatcctgctcatgtgttcacttgcctgcctcttctgaaatcaccagcagttcagtatgacttaaccaagtaaatgaattactgcaatgcaaaagaaaccaacccaggaaacaagaggaatcaccattatttctgactctgtctcctagatcagcattcgaagccaaagatttccaccttttactggaaaaatactaaatgaagtgactcacttttaaaaaaatgacccctgcaatgcagcctagatttaattgaaggtggtatttaactgaaagtgagggcagtgtgtataatcttaatctcctcagtcggacacatgtt

SEQ ID NO: 97062 - DNA, 1066 bp, Homo sapiens
ttctcttcctcctgaaccccattctgcttcactttcaaaacgatggctagagggttggatatgtcagtgatcatgaactgctgagtcctaaactttggtgtctgtgtccctcagaacctcaaagggcagtttccctgtgactttttaaaatgagaaccatgttcatgaagtgctgtcttagtttcagatcacttgaaatgtaatctgatttgagagacagtgtttaagctcctgtttaccaaaaggctgttttgattatcattttgcaggaattgttgctgggtaaaagacaaatgaacaacgtactcagaagagatgaccaaatggtctgatttcatgttggaaagtttcttctggtggtcttgaatctgcgttttaatctccttaaaaatgcctttttagcacataagcaaaattaaacattattgttttattaaaaactatgcagtgctccttattagttaggagaaaaatctcttaaatcctttttgttaaggacatgtgtaatttaaggctttcattttgacagcctggtttcagctgacaggtatgttaatctctatttgattgctttggtgaggagttgaaaatcacctaatgcctggcttagtgtgcatttgtaaatgcgctttcttttggttttcatttcatgcaataatgaaatgaattttcctactgttattttgttatagattgatggtttatctgattaccagatttaaataaacagttgaaccatattccctttgactgtgtccccttgtttatccttttttatttgaatgctgatgggtctttataagcattattatcagcattattatcagtacatatgtatgtatagagcctcttcatcagttatcttgtagcataacagtgctctaagaaagcgatttttttttgttgtttgtttttttagtttaagaatttcctattcttttctattttggtttaattttcattactcttttctttctccccttataagtgccaaagtttatgtgaatatgattatatatagaacatatgactatatataatctttttttctttatgtttacagagg

SEQ ID NO: 97063 - DNA, 1048 bp, Homo sapiens
tcccaaagtgctgggattacaggtgtgagccgctgatcctggccctattttatacttctcaaatattatacaaacaataatataaggtcattgtagaaaatttatacaacactgatgagtgaaaaggaggaaaagtaacctcatcacccaaggctagacactgtttgaattttgatgtaggagtatatatttacatggcatagaactttaaaaaaaaaagtgtaaattgatatttttagaaatgtctaccttttttgtattcccagtactttcacatttaatttgttacggcaagtaaaataaactagtcttagattaatacttgcttggcaaaagtgattttatttcttgagattttggcatacactgacaagcatgccttatgattactgcaaagtgtgttaagtgtattttttctcatacttaaatgttttcagaatcacggaatacatctaatacaatctactcttaatgtctgtgttacgacttagatttcttaggagtatctattatactttgccttttgtcttctagatactattggatcaccttattctgatatttggcacttcgttgattggtagaaaaatcgttttggccaggcgcggtggctcacgcctgtaatcccagcactttgggaggctgaggagggcggatcattaggtcaggagatcaagaccatcctggctaacacggtgaaaccccatctctactaaaaatacaaaaaattagccgagagtggtggtgggtgcctgtagtctcagctactcgggaggctgaggcaggagaatggcgtgaacctgggaggtggagcttgcagtgagctgagattgtgccactgcactgtgagactccgtctcaaaaaaataaataaataaaaaagaaaaattgttttacaaaaagttctggcacagagagaagttaagagtcagtaactttcttactgtttgtggatgtgtttgaacagagtagtgacttttggatttcatagtgacttcgtatgaaacctagagctggcagcatgaggattttctagatgaattaaata

SEQ ID NO: 97064 - DNA, 1117 bp, Homo sapiens
ccagcggggcaggagccagcattctgagcatgtgcgagccagccagggggctagggcggatttggggggtcgactttaggtcgtcgccctaagcgcaaagcgaaagagcggtgagagcaggggcgggcgacactccccggagcggtgcccctgcgcccagggcgcagcgactgcgccctgccctgcgggtgtgggcgagttggccgcgtgtgtgcctcgctgtttgacgcgaagacgagccaatcagggcgggcggcccgagctgccatgtgacgggcaaggcggcccctttccccagcgcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagaggtaagaagggctgaagcccctcctcccctccccctgcgcacacacacgcgcgcacacactcgcgcgctctctggcgcacgcccccgcgcccccaacgctcgcgttcacgcctcccaacctttgtgttcggggaggggttgctgacccccctgccccgctggctttctgggagccagaaagggtctggcttgccacggatttcctcccgggcgccggggaggagccgcggagcgttagggtcgccccctgccctcctcctgggccctgctctcctcccggcaagggcaggcgaacaaaggtgagcggtggtcgggctcaggacccgccgcattccgcggggctcgcccctctccgccggcgcgccacgcaaggctgccaggcagggcttcccgccggggcccgcgccacccacctgacagccaggaacgttccggacgcgcggcccgga

SEQ ID NO: 97065 - DNA, 1029 bp, Homo sapiens
tcaggaaggtatatttttcaccggacagtattgttgcttgaaaacgaagtcagctgttcgcctgcagaaattgacatgcacaaagcaacagactttaagacctatgtttaaattattggaatctaatacagatgtgtcattgatcctatacaaaaaaggatcaaaaaagtcacagcagtgctgtgaaaaaatgggtgtgtttgcaggtgtagagttacctctagagcaaatgtttggttacagaaaatatgaactctatacagttttgcaggctctccaaaaacaagcagactcagggatagcaggtttgctctatgttggcacatagtaggggatctacacacaattgctgaattatgataaattgtgtctgataaattctggctgggctcacttttagatagataatgcatttgaaagagatgtgcagtcttatgtgttggagaacaaaagcatgatctgtgcacaaacagccgaattttcctgacatcctccttctctatgctgattccaggctgttcactgtgtttaaaaaaattaagttgttagaatggagatggctttgtacttagattgtctctgcctctaaaaagataaacactaatgtgatagttgaaaactggaagttcatttttcctctttctaaacattttttattttctttctttttttccataatcccatgactcgacttagagtttacatagaggggtgagctgctttcaattgtcagtcacagcaaatgtcctcatattgatataaagtgagttggtcagtttccttcaggccattgatctaagtagaagagatttaatggcctgtatggaaagtgaaagtttatggttaatgttcagaataataatccaatatggcacatatgtcacagaatgctactgacttttggaagactatctactttgtttcttcctatgatagctctgtctttaaccattcagaccttctcaattctctgaaaatccacaatttagttgtatctagagttagaagttctgcatgtttctcctcttc

SEQ ID NO: 97066 - DNA, 1121 bp, Homo sapiens
gggcaacagagtgagaccctgtctcaaaaaaaaaaaaaaaaaaaaaagtggtctgcagacataaatagcttctcatagtttctgaatgacagtggatgttttgttggagaacaacctaaaatcagagggttggcattctttgcagaacttagtacagttttctcatctagtaaaataaaaagttttgaatttacacagtgaagtagtttggctatttgttataggttaatttatgggtaaaaggcataacattactgttaaggggcagtgccttagaatggtggaggaggtaggtgagataactttaaattatcaccatgatgtaatgtcatctaggattatgaaattaataccctgagttcacttatgacttctctgttgaaaatatttgaattctctatggacagggctagttttctcttggattcctggttgtaaagtgtttcagaagtggttgctcttctgtgatggggaaggacaggtggcagcagagggaaaatgggatttcaggtgagtttcctccatcagcataccagttccatggctttgtcagacattgctgcaccatcctcaggctgccctcttgtattttactaacttgattaaaccttgttggtgaacactagaacctaggcccatgttgtatattaaaagtttcaaatgttattgcatacacttacatttcttcctcttaccaccaggtgaaaccagattttttatttatttcttacatagtcgggactttcaaaattttattattttttttccttgctcatcttcttttgattaatttcttaaacacttttgaatcagaatactggagttccagattgtatgtctagttgtgtcacttaatttttcttaggaaccattttttcatttcgttttttttaaaggtaaacaggattgcctcgtatagcacagtgatcctttcatattagcaatgccttgagaatctttattcttaggattttattctttggtttcttccccctggccaccttttaaaaatgatttcataagttttttttggtctctctttcctgacaccataatctttattgacatctatactgtagcatgattgaacacaaaaggatgattcttttatttatttactt

SEQ ID NO: 97067 - DNA, 1030 bp, Homo sapiens
aatattattcatcttttaaaaggaaggaatttctgctacagcatgaatgagctttgaagacatgcttagtgaaataagacagtcacaaaaagacaaatactgtaggatcctacttatataaggtacctagagtagtcagattcatagacacaggtagtggagtgatgactgcaaggtgctggaggttggtgcagagtttcagttttgcaagatggaaagagtcctgcatggtggtcttggttgcacaacaatgtgaatgtacttaatgacatagaacagtgcacttaacaatggttatgatggtaagtgttatgctatgtgtattttaccacaattaaaaaaaatagaagatttgctgacttgaaaggtcactagaaattactgccttcattttcttggcttgacatttttctagttaggaacaaacatcccagttctgtttatctcagtttcatcaagcactgcttttttttttttttaactgcttaattcccctcaaatctaggagagcgcctcttctttccagaatcgtctggcataggtgggtgggaggtgaggggtgatagaaggaaggtttttaaacccagagagctcttaagtatcccgtttttttagaaggcacttgaactgagcatatcatttcaagtccatttgttaatatgacaacttaataatagtaaactggctgcatgtgtagaagaggagagcaaagtgtctgtagaaaagcacattgcatagtttcggaggagtctaggattaaagtcaagtcaccctggtaagtacacaatccatttaaagcaaaccaggataatgagataaaactctccttagcagcctaggccacaggtatatcctatggaagctctgggtgagtgaagatcagatttcatcttcctccctagctttcagtttaattttccatgcattttacaagcaaatgattcaaacacttgagtatttaaagatgatttttctcaaatgctgcatattataaaaacaatctgattagaagcagtcaggtacatattat

SEQ ID NO: 97068 - DNA, 1015 bp, Homo sapiens
tgtcacatcttatctttgaggttttcaggttacaaagctactgttgctctcctgaagctgtgattaagattgtattttctttctttcctttcctcgattcctcccccaccttccttccctctcttcttcctttgtcacttcctcctttcttattattactgatacagaccctttcttaaagacacggggaagtctttgagagaagaggagcagcatagagttaagagtgggggagggtgtttagaaaaccatctaaaatcttgtccagggacacagtttggcaagtatcagagtaaaagctgccagctagtctaagtggctctgtagatcttgttttaatagctcaccatttcaaagcagaataaagtgacttggtggtttaagcagtggcagttttgcacacaatagcttgagtgaagaaaaactgagaatgaagcaatcagtcatttgggcattatggaaaatgggagactaaaagggctttgtatgtcagtgggtgtgtgtacatctttgcatggatagacttgataacagtatatttaaattgtgttgctcttttgtatatctattgcaattaatagacatgtatatttatttctagctagaattgaaaggaaaatgggtgggatatcagaaagattacagaattcaggtttaaattcaaacagtgctgtttatcacctgtgcagtaatagacaacatattctctcaaatttggtgtcctctcttgtaaaatggagaatatgccactttgcagtattgagcactctctgcaaaaatgtacataaggggattcaatgaaacctggttcgtaaaaatacacgttgtgtagaaaataattgataccagagtacagtattgagtacctgcttgagaaatactgttctgtaatttgattttctaaaataaaataaatgggtatatgtgtgggggggcccaaggacatggggtcatggtacaacttgtggaagcagtagggcctgtttacatagttgatgctggacctggaggattt

SEQ ID NO: 97069 - DNA, 1064 bp, Homo sapiens
gagtaaccatttcatcctgatttgagattgtctcaggaaatgccatttcagggaaaattgaaacagctggtcactctacctgactgctcagcctattaaacccatcctgaggtcaggacagtaactcatgcctgtaatctcagcactttgggaggactgcttgagcctgggagtttgagaccaacctgagcaacctagtgagaccctgccaactctaccaaaaaaaaaaaaaaaaaaaaattagctgggcgtggtggtatgcacctggagccccagctaccccagaggctgagatgggaggatcgcttgagctcaggaggtccaggctgcaatgaactatgattgcaccataagaaatggcttctctgtctcgccctaagggtgacttagagtgtttgtgggaagaagcttccttggtgactgaggggtgttgcctgcccccactgtccctgtgccacatttcatggctttttaaaaaggtgattaaaaggctccccattaagtgtgggttggagcttctgagggcagaactgtgtctgtagatagccagggtcagttcctggtgtgctaattcatccttagcatgcctgtgttactgagaccataaacttttttgttttccttctgccttcacccagtgtgtgttaagtcttgcttgttaagctcccacacttaaatggctgcttgcagaattgcaaagggactagggagagaacaaaaacagatatgcaggtggtggttgttaaccagacaggatttctaaggagggttcaggcagtcaagtggttttgtgtatgtgttttatgttcatagttttgagttttacaatgtgtgaagcttacttttgctagcattaggtatagtttatttgaaagaatgaggctcctgaaataaacatgccagtaaactatatcttagagtttaatgagaacagtgctaggaaattccagctcctcccaaggctgcctcgctcagaggcaggcgttagctgtgggtctctaagctttaaacaggcttaccagtgtcaatacttgtgatgtccctgccccaggctgtccacacct

SEQ ID NO: 97070 - DNA, 1034 bp, Homo sapiens
ggttaggaaggaaatttaataataccataacaagacattttgccactctttctttaaagaaatgggaatgataatcataaaatacagtgagaaattcaagtttatactttgaactttgcaacatctattgcaaacatttatttaacaaacatatttcacccttcccaactcattgccttagggttacttagctaacaggaatggtgagtgttgtgttatattcctttacaacaaataaaagtcaaccataagttaccttgaacaagaaatcagtaatgaagaatatctgtccttgtatggggcttcctaataatttattatcagaagaattaccttatgattaagctattctgatggtagaaacattttcattcagcatgtaaacaagcaacaagtaaccaagattcagcaacaactatgaactgagaactcaaaaagactttaaatctagaactacgttgttcttcagtacagttgattgcctgtcccaccctaccttttagtcatcatattatctcatcgtgcttgtctacttgggaaaagttatttttttataccaataggatggcatgtattaacattttttgacttttatgaaaatgttcaaatatagagaaaagctaaaaaaaagtgccacgaacactcatattcttgccaccagaattcaatgattattaacattttatcatattttttctgtagcatgcaaagtaaatcgcagctattatgacgcatcaccaatgagtagttgagcacggatctttaaaaagccatcctagactgtctctaagaataaagacattctaggatggctttttaaaagtaactttttgaaaagcaattttatatcgtgggatttattttttctcataaaaatgtacagcttcaaagtggtagagaacttactgcgtatggatttggtgaaatgacagggtagaatcaatgattaaatttaatggatgtataaacaataaggctagcagtaatagtttagtgaaaaaggagtgattatatataatatttttattggtatt

SEQ ID NO: 97071 - DNA, 2105 bp, Homo sapiens
agcgtgcctgtcctaagcaaaggtcttacatttgaattcttccaccaccatttgttagagctgtgatgctgggtaagctaaagaaccactctgatcctgtgaaatggtgatcattttttcctttcaaatagtgaggattggaattaaggcagtaaagtgcttaactggatccctggcccatagtaggtagcagcgactgggttttgcttctttaaacttgtgagagaaatggatatggatgagtctttgagtcctttaatcagcagggcactaagttgttcatctagatatgccagtggagtaaaagtatagggagtcttccccaatgtctttgccttagcatacgtaattgactttcagttgtccacacaaatggagaggagaaatggcagagtaaataacaatagataatgtgttaaacctttatatgtctttatatgtctaggaattaatctgacaaatacttttgcagaatataataataaaatttcatagctggaagagaactttgaaattataaaacctcttaatgttagagatgaaaaaaacagacctagagagttaatgactcatccaagatcatacagtggtgtgatcttagtggcagagctagcatcagaaacgcatatgttaattccaagttccgggttctttatttaccgtttaaggttatgtttgctttaagtgcatatctagagccactaatgtgtctgagaactggcatctgggacctcagcctagtgtaggaaaaagaacatatgagcttggaggaatagaaatgcttttgaacttctgctgagtttttttgaagccagatattagggtttgagccactaaatttagggtgaaaacctagaactggggaaagttatgtgaaatagagtagacatatatctaagtcagaataagagggaaatgttggaaccctcagacaagccagagtctgttgaggacataaattgtggatagaagtcttgagtagcatggggagtccatgttagaaagatagccgggaattaggggcacgcttctatcatgggctagaagtccaggcttactggtgctatgtagagaaagcatgcaggaaatgaaacatcactctgaaagttgctgggcaccaacctgggcttgactcgcagagaggcatctgcagaggatccttgaggagcttgtggtttgaaagagggacagttggccaggctggccgggcgcagtggctcacgcctgtaatcccaacactttgggaggctgaggtgggcggatcatgaagtcaggagatcgagaccatcctggctaacatggtgtaaccccgtctcaactaaaaatacaaaaaatttgtcaggcgtggtggctggcacctgtagtcccacctactctggaggctgaggcaggagaatgatgtgaacctggaggcggagcttgcagtgagctgagactgtgccactgcactccagcctgggcaacagagggagactccgtctcaaaaaaaaacggacagttacaggtcatcagccgcaagctgactttgcaactgagcaacttttttttgcctgtgctcagaaagtttctgatttcctggtcaagtcggatcatttgcagctgattggggcttctaggtgtaaacactgaatagagtgaataaagtaattgctgggtaattcctgacccgtcttcattagctccagatctgaagctggcctttagaatatcataaagctcttcaatgcccaatgtttcttttgactttagtattgagaaataaatgcttaatctgttatgtaagtaggaataacgttgaaatcatggcttagctgaaagaccagttgtttctcccaaatgtgggtttacttattgagctaagaaatcattcctatgtaaatatgaacatctattatcctcttgtgtcttgatgaatttgaaatagtaccagcatgaatacatttgatttaggagtagttttggtttagaagttatttccctttagaaaacagcaatttaagcttaggttgaatttttgaataacttcagaggaaatctttaaaaacatttttcaaagactttcaacagttctgttatggaacccttataaatccagtaaatatgaa

SEQ ID NO: 97072 - DNA, 1051 bp, Homo sapiens
taacctctcaccatgtgcctctcacctagttcaggaatgttggcttcccagaaaatgcacagtacaagttgtgccttcagctttctcacacaatgaggcatattatgagtggtcttgcttctgttctgctgtagtgcataattcatgcaaaaaatttgatttcaactgcgtcagcttcaaagggctgcaatcaggcatctatctggaaggatttgctaagagaaaagtttctgttttccatttatacaactgggggactcacattatctttgattagtgcagtggcacggagctgaaggcagtttttcagtttgcaggcttatttttaagccttttgttttccttgaatttctagaagctctgcaggatgaaggctgtgtacatttgatagaattattgggtttatctttgtaagagctcatctctaaatcgaaataaaaactaagtgtctaatgattggaatagctgctaataaaatagccatctcttaagtactggtggtttaatctcttgtaaattccatcatagcccaaaagataatgagttcatgtctcttgcatgtgatagtctggacagtataaaaagtctgaaggcaggagtaaagagaaacagtaataggtttaaaaatgcccagttgataatggcagtagtgttttaatagctgtagtggtggtggtgtcagtatcaaagattatggttaacatttattgtagctgtgctactgccactcactattcttagagccttacatagactatctcatttaatcctcacataaagtctgtgaagtaggtactatttttacttctttttttatagatgtggagattaggctcatggaggtataataactcgtccacgattacatagctattttttttttttctgaagacgcttatagcactttgcttggagtgtagagtggaagctctgtgtgcttattggttgactcatcttggactggatactggttactggttactcaaaattccgagtttcagctttcttctgtgcaaaatgggaggttgagggagggccaatctctttctag

SEQ ID NO: 97073 - DNA, 1054 bp, Homo sapiens
ttacaataaaataaagataaaattttataaaaggtaaaataaaataaaataaagccttacaataaccttagatgagaagattgaggaatagagacaagctaagcaaagtccacagctatacaaacactaagtggtagagctgggatttgaacctgtcttgtgtggatatagcaccctcactgtttatcactttgctgtaatatctctctccacagattcagaatgctaaatttctcaaatctcctttattcttgctgcctctttccattctcctgtcccaatctggagtaattgattttctgcatatgctacacagccatcttcttaagtctccatttctccttggttgggtccattttttcctccatcctgtaccttctcctttcatgatttaattctacattttgttagagcacatctgtaaataacttcctggaaaaggaagtttaaaaaataaatgtcctgggtttttgtattttttccttttgtttacttttcttatccatcatctcccattgaattgatagtttggctaattggaagattctgggcagaaaatcatcctccttcctttgaaacttcgaagccattgctgtattgtctttttgcttcctttgtggctgaggagaagtcttccctgtctgattctctttcctgtgtgtcttattggtgttctgaaatttcccagtgttggacaagagttggttttgttttccattgtgctgagcatttgtgggcctttttaggctgaggacttagaaacctcagctttgggctatattctggtgttaattctttgaaaatgtctttataatctctgttcttttttctaaaaatggactctttctagtttgttggaacttctcaattaatcctgtttttcttatttttccgtttgtatttaaagtttaaaaaatttggagtataatttacatacagttattcattttagtgtacagttttataagttttgacaaatgcatttagtagtgtaaccaccaccataattaagataaaggattcacaatagccaaaaggtagaagcaacccactt

SEQ ID NO: 97074 - DNA, 1111 bp, Homo sapiens
accagcctctgagttccctcagtttttattgattattattttcatgatttcagtaaaaaggaatgtagtaggagagcagggtgataataaggagaaggtcagcaaaaaacatgtgagcaaaagaatctatgttagaattaagttcaagggaaggtactatgactggacatgcacgtaagccagatttatgtttctctccacccaaacatctcagtggagtaaagaataacaaggcagcattgctgcaaacatgtctcgcctcccaccatagggcagcttttctcctatctcagaattgaacaaatgtatagtcgggttttatactgagacattcagttcccaggggcaggcaggagacagtggccttcctgtatctccaacctggtggatacaatcagcaaagccctctcaataaatgaacttactggcagtttatgggagaaggatttatgtatctgggctcttggtcaaaagccacagttgcttcccagcttggccctgccatatatccaaagggcctgggctctggttttgagccacgagtctgagcaagggtgaagttgggtctcagcacatgtctacatgctgaaagtcatgtgccatctttccctcctctgactaacttctttggtgacttggtgccagcccctactatgctgagtctactccagtttctctcaaatactattgtatttgagattttaagataagcatcagtcacctggggatcttgttaaaatgcggaatctgatgtacttagtctgggatggcagcatttttaacaagtttctacatgatgctggtgccattggtctataggtcacactttgtgtagcaagtactaacattagagcagtgtctatctcttctccatgaattcagcaggtcattatgtgcataccacaataaataagacagtcatagttatgatcaattaaaaatgcttctaaatgattgctagtggtatggcaatgtggaggcacaatgatggggaagagatggtgcataaaataacatcatttcttccctcaagaaatttgtaatagtgttatggaaataagacataatatctgagtatgtgtaggtcaaagatagatattagaaaataacc

SEQ ID NO: 97075 - DNA, 1020 bp, Homo sapiens
atcagcaatgtgtaaatgctgattataagtctggggaaaaaatcataagattggtggacagtctctagttcttgaaaagtacagggttgagctgttttgtttctgttgtggtgatagttgtggttattttccattaatacaaaacagtccctggtttggagaacaacttctgtaattcaaagtacattgttatagtccaagtcactgctcagtgaatgtcttggtgtgcaagactattaccttaaacagttttatatctgtgggttgtattcaggtcagttttagctttgggacagaggtcagcaaacttttcctataaatggccatgaaataaatattttagatcatatggactttgttgcaattacaattctgctgcagcataaaagcagccagagatgatgcaaatgtgcatggctgtgttccagtaaaagtgtatttatggatactgaaatttgaatatgtcattttcatgtgttgtaaagtattatctttaaaaaatacattacaaaaaataaaagctattcttaacccatgggccatacaaaaacagatggcaggctggatttggccctctagccatagtttgcagaaccctgctttagggttataatactatttgtggttctttcagagtttcaaggaagagaatatcgtctcctagtgctaggcacagtcatccatttctcagagttttgccatttaatagaaaaatgtgaatagttctgtaattggtgtgcctgtctccagtattcctgggatatggtgccttgatggtgtgcagtttcatttagcctagccaggcactcttcaaagctgttagtatcctcaaggcagcattgctttcattacagaaattctgaagattgatgaaccggactatggacagtctgctcttttgcctcgagtaagcctttgaaaccttgtccccctcgttctattctagacctaccatctgtggccggtgaactcaggttttccatttagaacaagcctcacacattccttgatggcatatgg

SEQ ID NO: 97076 - DNA, 1206 bp, Homo sapiens
ataactgaatttattaaggcatcatattattatttaacccagtctgttatttttgaacctatgtactatttcttgttgttgcttaatgtattttaaaagttatttgtttctgattcagagcagaatcatgcaaatccttataattgattttgattgtagaggatttataaaagtctacataatgttcatacagaattgtagggggaaagacttcaaagcataccatccagaaatacatcctttatcatttactgcttatacagtgtcgtattttatacaggtgcccacactaatgcttacacatcatgtgtgtctgtacttggcacctgcccttcttgaaatgtttttaatagaaccagcctcatcagagtgcctgaagacggctgtagaaaggttatgttttatgcttcatcttcaggatctgtaagtcattgacctgtgggcagtagtatagtcacttgtgctgtcatatgacatatgctgcattcctaaaaatggccacaccatgcaaaatcgcacaacaaaagaaaataacttagggtttgtgagaagaatgggttagggacacaacactcagaaatttcatcagtgacactttgaaaataagctaggaacctaataaaaacaggagcagttttatacacattaaatggctaagaaatacatagctactacaataaatacggcacttgaccttgaaatggacctaacatttgcttgtagtggctgttgctgtgttagctcagactgtcataacaaaataccgcagactgtgtggcttaacagaaatgtattttctcatagttctggaggctaaaagtcccaggtgacataagtttggtttctccagggccttctttccctggcctttccaccgtgtgtgcatatccctggtgtgtcttcctcttcttataagaacaccaatcatattggaatagagtcctacccttatgacctaatttaacctgaattaccttattaacagcctcatctcccaaggcagtcacattgggaggtagggcttcaacgtatgtgttctgggggcacacaattcagtctgtaacaatgtcagaagggtggcagtgagttactgtgaagtgctggaaggaggaagatctgaaatcagagggaaagttgcaatgccggatgcgtgtggctcataactggtgtgactaaggtagcttggacatatttgaagagagtgtg

SEQ ID NO: 97077 - DNA, 1035 bp, Homo sapiens
agttaaacaaggtcagtttgaccttgtgtccagtgcaattcccaaatttgactgctgcagtttactgaaattgcatacatacaacagctttaggtgcctggattcacagtgagctagtgaaatagctggtgatttcatagtgagccagtgaaatagccatccttcccaagcacccacagtgtacagttatggtatagaggggccttgatgggcatggcctttgaaagacatgaaagctatagattagcctatattgttgtctggtatgtagtaggtaataactgacaaacagacaattgcctaacatgtgccagaaaacaacataggcaaggcttgcagttacaaaataatgcatagacaaatgtacatttaatcaaatttggctggcttgagggaatggttgatatacacagcacagactgatcaatttggtagtgttaagcagaaaatcgctcttataggacaagaatcttgtaaaattttgaaccttagaaatatgcactaatgacagtgtggtgtaggaatagatagtgatggggagggcgtcgagacaggtacaaataagtagtgtgtgttgattgacgggcatgtccttttggcaaagagagactccaccaagaaagtgattgggaaatgagctaagaaaagtgtgagagaagaagacacttcagttctgacattcaagaaacagccccactctgatttggataggggcaaagcctaactatagatcatttttcagccaactacagaatctttttagctttccttgcttctttttcatttgctttctctttcgaatttgaggagtagattgcagtttaaccacatgctatgagctcaggcctcttgggtggcctccctgggtcttagaccaaaccagtcattaggcttttagagaataattttaaaatgccatcccttaatattgtcagggttgtttgaactatgagaagaagataatgagcatgaagcaggacctttagaggactaggttgtctggagtttgtagttagttgaaaggctacagggtcc

SEQ ID NO: 97078 - DNA, 1035 bp, Homo sapiens
tgtactcattaaatcttaggattgaattaaattgatctaatagtgccttggtaatggtcacatgtaagtggtagccaagtctagttcctacttttctatggtattgagcaaagttaaccaccacctgatttctatttaccaataaactacaaaatattttcagtgcatctaaaagtattagatcctaacagacctcatgggttgatgtccactaccctctagagccaatgcagaatgattaccatagaatccaaggcttctctgtcagtttcctcacactccccaccactcagtacttattacacttcagcctacgccctgtgattcaaccaggcaaattggatagatgtgcaccatttcacaaaagtagataaaaatatacattgtcagctgacataacaggtggctttcttttaccacctagaattccataaaaaatgttgacacagtctcccacataaggtcacggcctaatctgggaaacaattttgaacctatccctgtataattgtgactctcagtgcaacagatctgtttctctctgtgatgttaactcatgatttaaattaaacttaatttgcatttatcaatagtattgcatgctcatctgctggttgtttgtggacctctgctttctgaagacaaagaccaatgatgaattctgattaaacagtttctagcactagtgttttcatagtccagccatctcatttcatagaggagaatgttgaacattctcaggtggacgccagtttcttggccttatctttttttttttttgagacagtctcgctctgtcgcccaggctggagtgtagtggtatgatcttggctcactgcaacctccacatcctgggttcaagcagttcttctgcctcagcctctcgagtacctgggactacaggcgtgtgccaccatgcctggctaatttttgtatttttagtagagatagggtttcaccatgttggccatgttgttcttgaactcctgacatcaggtgatccgcccaccccagcctcccatagtgctgagatta

SEQ ID NO: 97079 - DNA, 1051 bp, Homo sapiens
taattttttcataaaggttaatgaataatgtatttttagagcctctgaatatatgagaatacttttcatatattcctctgcaaatgagaggaagtttgcctggcagaagctttctttgattgagtcttccctttcttttggcacttaataatacagcagagaactgtaagaccaactgggtatttgttcttttgatggtgatttgttttcatttgatttgtgtgtgttgacttgttgtttttatgcttgaacactgaagttttttttttttttattgtaaacctaggattcaacatttttgtcagaacatcgctttgaattgatattgtttggaatgcaatttagttgtcttttttttcagttcacattttttttagtctttttgtctttgattattctattttagttcttgtatttcctcagaaacagctataattagatttgttttctagtcttccagatctaggatcttttttcatctttggttcatttctctggccttatgggggtgtttaccctctatgtaaatgacttaattttatactgtatgtatctgtgttcctcccctccagtggataataatgctgcacttcatttttcagactctgtgcaatgctcctttattccacctataatctctttatcttacccggcagtcttttattgacttacaactttctgttttgtttcaaggggtcatatcttcttgtattatattggcaatgcctaaaactttcctaaaaattactaatgattcctctaggaagtcatttttaggaggctgttcttcctttgaatctttaacatgccgttttctttccacatttattactacttagtagacccatgctgccactgagctgttattttcattcccgaatttagagatattcatctagacctgctcacagaggggatgtgtggattgccctcagccccactctctctcctcctgtttgttagtaaaagtcctcttttagatctctgaccttgaagcaggttgatgtctatagacttggccccattttcagtgaaagtttcatataaagca

SEQ ID NO: 97080 - DNA, 1103 bp, Homo sapiens
ttctcatagtcgtacacatattaacaatagtgatttggcataacatggggaattatttttaaaagttctctatagtattagcctccaaagtgatatcagtgttatctttatttattacagaatttttgttaaaattgggaatgcaccaaatttcatgccttattaatcttgtaaatattgacatggaaattttaaatacatttaagattttaaaatctgggttatcaaatattgtccgcctgtggtgaattctattataaatagtggttgtttcccattatcatattgttttagaggattgttttttacttgtagtcttttcctttggtaactgcacttattttcacttaataagaccatatggcccagaggccatttgaatcgatttagaaggatgagttttactctgtggggtttctgtgtatgaagaaattctcaactggagtaaataaacatggtttaaacggcttattttggaattctgttctagttttcagatttacttatctagaaaaaatagaatgactatagcgcttttgtgcttataactttactaccttggaagaggaaacagctttggatggaatttcagctgatgtggaggaggtgtgcttcatgggaaggtcgggttgttaactaaggtcaaggtttggaattcgtgcctggttctgttggtgaggggctttgttggtgagaaaggaaagagaggatgagcacgtttttgctcttttcctttaggcctgctggatatagcctctctagctctcatacggcaatgcggttatctgtcatcagaacaggaaacactttgacgcttagctctggttcactctgtccctaaacaaatggaatggaatgagaataatttttatccaccagtcctcagtgagtctgcacgaggcagtaagaggaactgtcagtagagtgtttccttggaaattattttttcttaaactagaccagttttatgccaatttcctttcaactgcctctggttataacaaatgctttttttttttaataaaaaaaaaaaggaaaggaaagaagaactagacactgttcttcttgttgaattaatttgtgtgggaatttctttctttaat

SEQ ID NO: 97081 - DNA, 1310 bp, Homo sapiens
tagacttctactcaaaagtttagagttgaacttgactatgaaaaacattggtctaatttatatgctgtgacaaaactagctttacaggcttcctttggccggaggcagtgcctgagaagggagttgcattagtattcacctcctgtttctaccatgggaaatagaaaactagtaactcccagaagattcaggtaatttgataggaagtattgatccatgtatcaaaatctgtacctgcacattcactctgcattagctgaaccatcatcagagacctctctgacacagaaagaaaaatgatttactgaatttagcgaggaaagcattactcaagtgtgttttttctaaaatctgaaagctaatggcgttcacataccatgatcaccataatagaacattttcctcatcaacaacaataatgaaacaaaccagatgttctttacttaagaacagctttctgggggaagtaatgagatgttctacttctgcttgtgaagccagtgttctttcccagcagggaagggcctcatcttgtctgggtgtgtttgggatgggggtggggtgcttaggacaagtacttgatgtggagcagagcagcaggaattccgattggaccagctcatgctctgattatagctctgtgtgtggttccaggggaactctagttcagggagtatctggtactgggtctgctgtcaggtgggacaaatggcttagtgtttgtgctttgttttgtttatgtttgcctcccttctcatttattaatgcacatgagaataggcctgcttgacaggggccgttgctgtcattgcttaggatttattagtcaaaaatctggtgatactagttatcttggaatgactattccaaagcacagacaaggtgaccattttgtgcccaagaaatgtaggcttccacaaggaagtgaagagtgaaaaggataaagtaactttttccctcatagaaattaatctatattgatagaggtagttttacctgagtggggtaaagagagactgctggagtgagtgctggcaatgttctcgatatggatagtgatgtaagtatttacatatctagacatacatcaaatttctgtgcccttaggaccgtgtactttaccttaacaacttaataacgtctgttaatcctatagctgccatacaaagcagtccctgcatgttgctgaatggaaatgtgggcataaagcattcaagtaggaaaagctgggatttaaagggtgttccattcctggctatttccaaagagcttctgttcatactggtgggagatactgatctctgttcatt

SEQ ID NO: 97082 - DNA, 1111 bp, Homo sapiens
cattattgccatctccctcaggagggagaattcctttccttgcgtttttcggctcacagtggctgcctgtattccttggctcatggcagcttcttccatcttcaaaatctatcactctaatctctacttctgtcatcagttcgccttctcttttgtagtcaaacctccctctgtctcctttctatacgcccggataatttcttcatctcgaggtccagaatcacatctgcagtttcttttgccatataaggtaacattcacaagttccagaatttaagatgtggatatctttgggtgccattattcagcctaccataccatgccggtctcctactggtgtctcctgatctctgagaaggcattcgctagtatatccagagggaaatgccattttgttaagaactgatatagcataaaaatctttctgtggaaaggtcacatattctttatccttaaacagcttacaggctaataggagatatgacttgcttgcaagtatttttggcatcaggcagcacatggtaagtgctgtagtgatgatgaaaatagatgtctaggattacagaagggggagggaggatttcagatagggtgctcagggaagtctgaactgagcatgtgactgaggatgaaggaagcttcagctcaggaagatgaagaaaggaggtgaaggggaataatagaaagtggtaagtctggaatgtgggaagagttgtgtttggggatggggaagagaggaggcagcagatatgagaatgatgagaggcaagtgaggcagatgaacaaaggtggggtcaagcattcaacttctgtttagtagggaaagcataaagaaatgacagatgattgagctggagaaaggaaagctggtcacagtgtgcagaatgaattaaaattcacaaagactggaggcaaggagatctgtgttagccactgcagcagccatgctccttgttgtccctggcattggtccacatgcaggtgaaacagcttcttgtgtatcacttggagattttgttaggcatacccaagaaaagtcagctgacagccagtttcaggcaggtaaaccatttcctccttgttaggaagacttaccaggcactgaagaggt

SEQ ID NO: 97083 - DNA, 1148 bp, Homo sapiens
gaatccttttgaaaggaaaatttgtgtctcattttttaaaggtaagtttgttgcagtatggaaagaaaatatttggcccagaagcaatttccatattgatcatctctttcctagagtatactttggatgcattgaaatgtgatgtttaaacatagaggcatgataatgagaaatgcctcctggttttaatgtaacagaacaaagaagtgtgcattttatgtgcagacaacaaatccttagggattactatctggagtggcagcggggagcagagaggcgggagggggtggggcagttcatacacagcctggacaatctgagttgcttcttagcatcagcagtttagcagtatctgtgtcccaggaggatgtacatgtgactcaagaaaagggaaaaagagaagccaaacgaaatccaagtatagttgtatcctaagaatgaacatgttaggaaaaggcttatttaaactcgctatcattgatgttcctaattatatttttaaatggaatgaagattaggaaatcatttcaattaggcatgtaagattacctgctagactagcagctagagaattatgaggcctattaattataaagaatttcccaagtaccaaatgtaccattcgtagacaggctgtaatttgtgagttataggcaataagtggaaaggagcacagcgattcacataatcacatttttcatctccgacaaaacctttctcctcatttaaggttatgggaagacactttacatttcttatcttctgtttatatttcctccagtggttcattagtagttcagaggggtattgttttccaagagcaagtttaatgcctgacattttcgctcaagatagagaagtagatttttgtctttctctcatgcattcagggtaagcaatgtaaagttgacaggggtatttagctaagaatcactagcacctttgaaaactaggatccctggggagagccagatacacaaagtaacaagatacagaagcattaaagctgcctggctcccgggctccccactgggatgcagtgcaaatgtctgcaaggaatgctacttgcagctgtactggatggaaatgttacactggtagtgcattttgatagaaacgattctttcttgtattgctaagagtcaaag

SEQ ID NO: 97084 - DNA, 1090 bp, Homo sapiens
gtaaaaggaagagtatcactggtgagggctggagacaggcagtgtctgaagggaacagctgtacctacaaagaccctggaaagggccaggcacggtggctcatgcctgtaatcccagcactttgggaggctaaggtgggtagatcacctgaggtcaggagttcaagaccagcctggccaacatggtgaaaccccgtctcaactaaaaacacaaaaaaattagctgggcgtggtggcgggcggctgtaatcccagctacttcgggaggctgaggcaggagaatcgcttgaacccgggaggcggaggttgcagtgagttaagatcacaccattgcactccagcctgggcgacaagagcgaaaccctgtctcaaacaaacaaacaaacgagccctggaaagaaagctagacccagagagctggggtccagcagcctagcttcccacagcgtacaatatgtggtataaagtctttgcagcttcctgccaaacatcttgttggcatatagtaactacttagtagctattaaaatgattcatctttgccatgaagagaagtcaggcataaccaaaaaatatcaaaacaaggctgaagatttttctttttatcttatcccagtcataaatgaaagcctggaatccagtgtgaatggagcctattgttagacctttagtatcttggtaaagctaggacccgcttgagttcagatctttaggaggtttatgttgttttgcattcatttagcaccatgtggttctctccctttgagaacctgatgcttttgagctactgatttttcattcttgtttccaaatcaccatccagttaaacacagtgtatgtatttttttctttttccaaacttaaaaatgatagtacttttaaaaatgcattattagttcagttgatgattcatgccttttagatttttgaaattatgtttgattaaagattataaatttaaaatacacaaaaggtcataggaaaatataaaggcagtcaagcagttcagaactactactggaatgcagaatttaaaaaaactattataattttattttttattttttgtaaagaggggtctcactatgttg

SEQ ID NO: 97085 - DNA, 1109 bp, Homo sapiens
cctgattacgaataatgccctgattgtgtttaataaaagtggcttaatattatcagtgattcaaaagtctaaattacactggataaattgggttattaccaaaaaaaaggaaaagggaggtctccctatgatgtcaagtttccattcgtggggtcggtcagtaccacggtcagcatgacaaaccaggatttgtcttttgggagaaaaatggtggtggtgaaatttagggcttgaagtaattctagaaattatttggtccagcctctaattttatacatgagcagccagatgggagaattggcttactcagtgtcacccagctggctaatggcagactaaggcctgagagtggggctccagtgtcctttctggtttgctcctccctattccctgctttttcagtaattgcagggattgggaaattaaggaacttttgtctctctactctggattcctctgccattcattcaggaggtgttcactgcttaaataatttaatgttgccagtatttggctgctttgcacgtgtttgaattttgtattttcctgtagcattctcaaataataacagcacaacaacattttttcttttaatatattcacttatgtaaaatatgtcttccatggccatatgcgatcatttctagacagcagatgactaggagtttctcctaggatatgagtttgggaaatacagaactgttaatatgtttggagtcatgattcgtacaccgtgacctgttacgtatgggttttcagatgtagtaaccaggcataatgacaagataacattttaaaaagcaagtcaaatttcatgtgcaagaaaagtcaagccgagagtgtctaagatgtttttgagagagagagagttggcttttcaaccttttcctatataattgcttcaaagtgtcctcaggatgatgattttttagaatagttagaccttaactcaacataaattcatttttaaaaatagatgacttgtgaaaatcctgaaggttgattaagctgtattatctcaaaggccatcccttttcctcttccacagctaaggattgtctaattaaacttctgtattgctaaccttaacaaaaagagtcttcccacac

SEQ ID NO: 97086 - DNA, 1021 bp, Homo sapiens
gtagcttgcccttcagcattctgtcatgtgaggatgctgcaagaagaccctcacaagaccaaatgccagtgccttgatcttggactaacagcctccagaactctgaggaataaatttctgttctttacaagttagtctgtgatattctgttatagcagcacaaagtggaccaagtgccttttcatgtactatgtccttaaccacttgtgtttattcctgctgtagcatgtaatgtaattgttttggttacccaggagatgctaagttccctgagaatggagagcttgtccattgcatcttcatgtccagcccagtacctgatgcatggtaggcactcaattaatacttgaaacaatgtgtgaatgagaagcgtgcagtaatagcacaaatagattaaggcctaggcaaatgggttgataagtagtaaggaagggactgatggggatcttggaaggtgagagcaagttgggtgggtggcagaatagttaattatcactctactgagtgcaaggttttattctctgttatttgctcatcttatttctctcattctactttctcttaattgggaatttagaattattaatgatttgtttgtagttgaaatatcactgtcaacatataaatactccaaaggcagctatatcctgtgctattaatttcaagttaattagaattattgaataatttgagggtggcagtgtattattaacactattaacgttgtttataaatatagagcaaattgggtttttaaaaattattctcattcttgtttttattatttttgatatgcaattttacatatttttggggtacggtgtgatagttcagtacatgtatataatgcataaagatgaaactagggtaattagccatctatcacctcagacatgtattatttatttgtgttgggagcattcaaaacccactcttccagctaattgaaaatacacaataaattgttgttagttataggtgcctgacagtactgtagagtactaggactgttcttcctttc

SEQ ID NO: 97087 - DNA, 1023 bp, Homo sapiens
tctcctttggatatataaccggtagttgggttgctggatcatatggtagttctatttttagtttgcccgtgtgttttttgaaataagacctgttaaaactacataaacttgactttttattatccagataagacttgttcattgcggaaaaattatagctatgacaatatgtaatttaatagttaatatatgaacataagaaaaaataaaaatcccctgaaataattattactcagagattaccactaagcaattttgggtaaatatattgccaggcatttttagtgtgtgtgtctaaatatatatctactttaaacgtaaagtacactgtataccttcttgtaaccggatcttaacttaaaatatgaatgtgcctgttaacatttccgtagctcatctggttttagcatagcggtagtgagcagttgcatgcacccttgacagtatgccacatgacatacaagctgggccatatttctgctctttctccagagctgcagaggtcatctagacacaggaagacacaacctagaaaaatgggggagttaatactacaactctcacaatggggggtgggagttggtggataaatgctgcggcatccctgtcctgtgttgagacagttacaagatccatgctatgtggttctgcaggggctccccatgcagttgcctgcagcagtaaccagctcattcctgaaaattgtgttggtttttctcctttgtctatcttactttctccaaagcagcttacatccgggtctttatctcagtgactctttctagagaatcccaaattaagaaaacgtcaaccctgtattattgaacaatccgatttatcttaatttttgttataaaaagaattataatggatatctatgtataaattcctctacatatgggtctagttaattatttttaaataataaatgctaagtcaaggatatgtttttaatttttattgtaaatagaattataatagatatctatgtatcagtacctttatatatggatctagttaatt

SEQ ID NO: 97088 - DNA, 1168 bp, Homo sapiens
gatgcaaaaaataaataaatgaataaataaaaagacgcaatttctgttaaccaaggcaaaaaaaaaaaaaaattaaggaaggaagcctaagggatcttgtcagtgagataatcattgagttatgtaacagtaagaactggttacccatctggacctgtggattgttctgtagattacaggatttggaggtcctttctaaacctaaaattcagtgtttctaggtaatagctcatttgggggaatctattccaaatgcctgtgatgtttttctttcattactcattcttcgtcacccagagtacccagcggaaggcacagtggaagagcccagctggcctaggtttgatttccactttctctacttatcagctgtgtagcctttaattaattacggttcctctctgagactgtctacaaaataattgatacttaccttgatgcatgtattaatattagaatacaggctaagctactgtatataaaagtaaagcaaaacacactagcttagatatgagagaaatgataggaatttatttatctcatacatacaatccagagggaagcagatcagggctggtgggagacttctgataccagactccatagaaacttccatttcagggccagtggtgactgcttcagttttcattatctcccttcaataggaatggagaaagggtgagaggaactcattcacactgaccttttaggggcaccgtccccaagtgacacacacaaactttgcttccaccagagcttcccaccagaattgtactagccaaggaggctggatgagaagcttatctttagctattgctttactagcagtggttcttctgcttcaaatgattctcgcaaagattagaaataattcattaattcatttatctatattgaattgtgaaatatcttaacaaagtatttagcaagctgcctgatacatggtaaataccaaaaagatggaatcagccttcttacttttccctagtaccttactacttgcaaagtgtggtccgtggcctaatagcatgagtatcaactgggagctttagagatgcagaatttcatccccaagcccagacctcagcctgcattttaacagttggtgaagctctgagctggcatgttcttttataaatctttaatggcgtctgctggcctctgctgg

SEQ ID NO: 97089 - DNA, 1092 bp, Homo sapiens
tctccccagagtactccttgtgcctgtttaaagaaaacctacaattttaaggagaaaggaagaaaaacgcagaaaagctccatatattctatataaagtttgtggccccggtatttgagattcataaaaaggtttaaaggattgtccagcacttctgtttgaactgttaggccagatttctgttttggtgtctctggcttgctagtatcatctatgatgcaagaatctcttatttttctctctgtttttctgaaatcaaccatacaaatgaatttctcaggttgctgaatattttattaaatctgtaacagtcaggaattctacttatggctaatgctgcctttcactcaacttacgggtaatttataaatactggtgcatgatgtatgacatttcaatcgcaggctgaaatgcataaaaatgcaggcaattttatgcatctggtaaggtatatcttataggagattcatgcatattgaaagaaactttttattatcagtttaactacattaatatatcacattcctttctttcataggctgccaaaatggcaaattatgccaagtttcagaaaatgtgtgatctcctgtttgttatgtttgccgtggtttttatcaccacacgactgggtatatttcctctctggtgagtatgccagtctccttcctgatagagccaccctttccaaataagctttctgaaccattttccttttgaattttactgtaagtatttacaggtttaaatatattgggggggaggggaaatacctcaagaagctgcttgatttcttcttccagaagagggttgcactctttactaatgatttccacaggatagttggaaaaggatgtggcttgcatggcttctgaagccacagaaagccatctgtcatagaaggcactagtctagaatatgactcaagaacctcagctgtgaaggttggaattaagaaagaaaccgtggtgttgcaaacaagtatatgacaggaatctcctgtaccaggggttcacagagggttgtccctggattagcagtagcagcatcacctaagaacctgttagaaatgcacattcttggccccaccccagg

SEQ ID NO: 97090 - DNA, 1047 bp, Homo sapiens
ttttccttccaggttttcagatggagctgatgcatgtgtaaggacagccctggcatggcaggcagtgcacgacaggcttgctggcagcatgtcactcatgcctgcccttcccctttactctcatgctacctcgccctcacagaaggtgatgaaattctcttaggctctctcgcctctggtccctgtctgataaatgtgtggatctgactctattttcggtggatttgtctagaatttgtgctaaggggatccgttggtggctgtaccatctctttctctccaccactttttatccgatcctgtgaagagctattgcttcctgcttctgtctaccttgacctcttcctgatagcatgccagcctcttaagaggcacaagcaattgtgatagaggccagactgaggactaggatgacagcatcttccattagagctgtactcactacagttgtgtctgtaatacataagagggtctcaggaaaaacacaatgaaaacctttcaagactgattcaattaagtgcctcccaggagagactgagccaccaacaatggaaaattcaatattggctcgcagaaagacgcttagtcacataaatgtcctttttctctaatgtgtaaggaaaaaattctgcggcgtccttttgaaaatctgacatttgcttttttaaaaagtgctacctctttcaaattctttaataccagtattcatgggaaattcattaggggtgatgtgaaattataaaatgaagggctgcagtgtctaaaaccttttgttctgatacacatttgaaatcctgcatgaaattacccatgcttatgactccaggcagggaccaaaaagaagagtgtctgttgagcttgaaatgcgagtgtggatgccaaggattttgctctgtgtcttttatgtgaataaagaaatataatgtgcatcttcttttcaaaaactgaattcaatattaagcagcattcagggaatgagcagttttcttttgtcctaaaagtgccattgtaatagttgaacatcatatgtacagtttataaacagct

SEQ ID NO: 97091 - DNA, 1005 bp, Homo sapiens
ccaccacgcccggctaattttttgtatttttagtagagacggggtttcaccgtgttagccaggatggtctctatctcctgacctcatgatccgcccacctcggcctcccaaagtgctgggatttacaggtgtgagccaccgttcccggcctgttactgttttctggttaggaatcattctttatatgaactacatgtgggtggagataagtacaccttttttttttcaggctatcagctgctacgaacacactgcccccattttgttgggctttacttattgtctgaaggagtttacaaacgcatgcttcagaccctcgcttcaaaagacaatgtctgcaaaatcctgggaggataagcgtaagctttgagcagctctcagtaaaggagggtgaggaaagagtggtccctgaattatctatgagttgggacagtttggcaacctcaaaagttaaggattttaaagcttgaggctctgctgtcctcaataaagtggatagaggaggaggacaaaatttaaaacattgaattttgcctgataaatatcattcaggcacacacaatcataaatgacccataatcatcatgtctctactgagagcaggaatggatcaacagaaagttattcagaattgttattcaaagttagagattttttaaaaatgagtactgatgggaaatagagaacaaaagggggaaaagcttacagaagtggttcccaaacttgtttacacattgaaatcatctggggattgtttaaaaattccaatgcccaggctccaccccagaataattaaattttaatctctggagatatgtggcaagcggcattgcttttgaagctccccaggtgattcaagtgagcaggcaggttgggaaccatcagcctattgaacaggctctttgaagcatatgagacacaggtgggaagtggagaaaccagatttctgaattattcagataaagggaaatgagttttgcaatggaaagcaccattacgaataaa

SEQ ID NO: 97092 - DNA, 1005 bp, Homo sapiens
tagcaattccctctctacttgtcagtggagtccctcagagatgagttcagtgaattatcagaatgaccaagattttctactttaactgagttaattgattagacccagaaactttgaagctaaaacaatctcacaaccagagcctcacattggtatgtgtttggtctctgtttttctcacctctgcaaaacataccattgaaatctctaagggaaggggaaaaggagaaaaaggtaaggaagcccatggtaatctgacagcattccccacttgggcccaggagcacttggcctgccattggccttgctaggagtgatcctacaatggaaatgagcaaacctagcccttcagggaggagcacacaaatgtagggaggtttcagagccatttctgccatcctgcctctatgaggatgggaggctggttttatactcttttagaaaactggaaaagtaagtccctggaatctcagtctttcttaggtttctacctgcctagcaggagtcagccttatctatccttttcttaaagtaggggatatttagagatacacatctgcctcagtcctttcaaagagaaaagcaaagaaaagggcacagggctggcactcccatttcccagttgaatttaaaaagatctttggttttgtgtcttgaatattttgtgtacatgacaaagtagtaatgaaaggaattatataattttcagtaatggagacaattctgttgggatttaagggtcaagtggggtgggccaaagtggggaaaccacataaataaaaccaaatgggttatttaagcaggcagggcctggcatatggctaccagaaaccagcttatgagcccaagggataacacattgcagggaattacaggccaaagggaaagatctgcagaaatgctgaacagagatattgatgtgtgtcctccatcataatgtggggacggatcggctctgagcataagcctgggtgaagaacggagaaagggatgggagagcctgaca

SEQ ID NO: 97093 - DNA, 1050 bp, Homo sapiens
tcgtgatccgcccacctcggcctcccaaagtgctgggattacaggcatgagccacggcacccagactgcattcattgttctgtaatcatttttgtcaaaaatccttccaatactcatttcaaggcatcatcaaaatgatgtatttcaattatcagtgcttttccaggggaagccttacaaaattaaggaccctctaatgactctcctactagatataagcctaggtctcactcatattctcacttccactgtgtttttccctgtgctaggcatatggcttgtacttaagtaatgtttaggagttaatctctttttttgcagtgtattggcattgaatggcattcttcgcgcttatttaaagcccaaaagcaacttcaaagatcatacaggcctttttacaagtagatatgaatcacaaccaaaaaatgaatgaaaattaatgaaagaaatgatggcaaaagtgaagggggaaacatatgatccaacaattccacttctgggtatatgcccgaaagatacatactcagagcgatatttgtggacccgtgttcatagtagcattatttgcaatggccaaaaggtagaagcaacccaagttccctttcaatggatgaatggataaaatatgacttatacgtattataattcagccttaaaaaggaaggaaattctgacacatgccacaacatggatgaaccttgaagatgaaacaagcctgtcacaaaaggacaaatactatatgaatctacttttatgcggtgcctaaagtagtcaaattcacagagacaggaaggagaatggtggttgatgcaggctggaagaatgggtgccgaatcttggttttgaaagatgaaaagtgtgctgagcatgtatggcagtgatggttacacaacaatgtgaatgtacttaaagccagtgaaccgtacacttaaaaaagtcaagatggtaaattttatgttatatttattttatcatttttaaagaagtgaatagggaaaaatatattaattaacctaaaaccaaatgaaagtcacaccatcagggtaattc

SEQ ID NO: 97094 - DNA, 1050 bp, Homo sapiens
ttaaagaagtcaagaagtctagccctccatgatacttacattccttcataaatgactttgtcgcctacattttatctctccaatgaaggggaacttattgctctggcaatgttctcatcctcttcagttttttaacattgggatctgtttccccttgtgtatgactgcatgtgcttctagcatgccataccttgatgatttcttaggtgctggttatactcacctgcttctactccacaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgc

SEQ ID NO: 97095 - DNA, 2452 bp, Homo sapiens
aggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccat

SEQ ID NO: 97096 - DNA, 1050 bp, Homo sapiens
cttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtgtaagtgccctttactgtaaatgctaaccagctcgtgtgggtaaaacatcacatctcacctgatgaggttaataaaggctcacatcatcccagtagattgttacaagcctcgtcaactcccagtatcattgtgatcattgagaaagtaatgttacgttaacttggatagactgtagtatctctttgaaaattaagattaaaacctcaatgctaaattttatgtagcactttattctggaaaacatggtttatagagatcatctgaaatatatcaggttatgcttatttttaaaaaaattttaaaagaggcacctaggataaacacccaaagcacaacacaaaacttcccttctctgtgtatgcacccctcatcggagtttggc

SEQ ID NO: 97097 - DNA, 1047 bp, Homo sapiens
ccttctttctgcaccatcccctttccaactccccatcccactgagagccacttttatcgaccaataaaatcctctgcgcatacaccgcccttcaatccatttatatgacctgattctgcctggatgccggacaagaaccagggtgccaagaggacagggactcggatgccactgcagggcccacacaaagcctgtttttgccagagaggagcaaccagctagttccagcattcagcaggctgagtgaaacaagccacgccagttcctgcccaaaaagggggtcaatgtcaagggaacaatcccatctcaaaaggacaaaagtaatgaagaaataaggggatttcatggtgattgccagggctcttcagattgggtggttaaaggcaccttatggacaggtgatctgagctaagaccttactgacaggagcagccagtggggaaatcttgcataggagcaatccagacagaggcagtgggaacctgaaagagaaaggctgcaaggtgggactatgcttctaaattcaaggaataacaagaaggccagtgtggatgaagcataatgaacaaaaggaaggcgcaggccataagactgaaaagttagcaagggacagatcatatagggcccatatcctattcccgtggtaaggagggcaagttttaggctaagagtagtgggaaacatttcagggatttgagaagggagtagcgtaatcttattggttgtcatctttaataagagaaaggacatgagctaaacaatggaacaaatacaaatttgtatgtataactggaaaaagccttctcaaactcctagtgtgtcagtagtgtctgcattgcgcgacaaggcaggaagatgggcacatggccatgggaggatataaaggattacatattactgaagatttaacccccaagcaagaaagtcaaagtcctgatggagaatgagaggtggaaggttttgctgtaagtatgctgagatctgggacaggaaatgcctccaggtcacttcaaggaaagcaacttgaaaaaaatatgagaaactggc

SEQ ID NO: 97098 - DNA, 1023 bp, Homo sapiens
ctgtgctccttagcagagtatgtgtagggtggaatgtggggtcagaggagagaacagcccttatccgtctagagtcttttatgatttaggtcctcttatttctcttcctaacgccagtctgctgaggttcaaaacgtgtcaccccaggctggattggggagagggaaagaaagacatataccagccacctgctccttgtccttgctgctttatctctagtcattcaagaacaaatattaagcagccattgtagtaaattgaatggaaaactaactccaattgtctgcccctctctgtctctatgccctttgcaatgggacactaagttcctcctattatgaagtggaagctctcctcacccctttaatctgggctggcccatgactggctttgatcagctggatgtggctgaaatgatgggatgtccatattaagctgtacctccagaggcctcgagctcttccactcactcttgtggctcctctgccataccctgagaagagcctggttagactaccagctgatgaaatacggcctcagccaacagctagctcccagccagccccctgcccagaaaagcccagatgcatggctctgccaagccctgtgtagatgacctgcttttacatgagtgaggtcaggggacacctgaagatccatccagctaaactacagatttgtgaaccaaataaagtctctgtcatttgaagccactgggtttctgtttgttacacagcattattgtgacaaaggataaacgataccaacctatttctgacctccaaaatcaaggctttttgcacattcaaacattcctccgagaagctcaacaaatagccaagttctaattctcagtctggattcagctgggatgccctgctgcccttacaacggcccagtggcagacaggagcaagatggaaggattttaattcagcagatgtccaggaggtctgagggaaagctagtcagcccactgggaatggcacacatgaggagtttggggataggagtgccctaccaa

SEQ ID NO: 97099 - DNA, 1102 bp, Homo sapiens
gctgtcactctttatttaaaaaaatgaaatcttttatttaaaaaaatgacttgatagaaactgggaaatgataaaagatgttttttcttgggagcaattgcagcctctcagcattatttctggcttttgattcattgtactgaattcctgtgaaagctgaatattaaaagaaaatggatttttaaaaacaaatccttttaaaggccaggtgtagtggctcatccctgtaatccctacactttaggaagccaaggtgggcagatcccttgtgcccaggagttcgggatcagcctgggcaacatagcaagaccctgtctctatttctttaaaaaaaatacaaaacaattccttttaaagaaaactcataaaatccatggcaaaactaaaaagcaaatgactggatactgtttctgggactttactttttataaaagtgattctcatgagcatccttttaccattgtaactactgtggatacagaaattcacttacatcaaacactttttattaatgtccttggtcttatggagtcagtcctcagttttggcagaagctttggaagtaacaccaagtttgcctgtctctgagtgcgtctgtctctagttatttggcatcagtggctgtttacttgtaaaggttctctgtgggcactaacgctttggagatgaaaaaggatttcaacacttagagaacaagtcttctcagaggggttcattgaatcttgttagtagatttactgctagtcctttctacctgaaatgaattcctcctatactacattgttctagaataatcttctgtgcatatggatcccatctgttattttctctgcttaagaactcatacagatatgctctagcttcccacgccagatcgtaattcctcctagaatgtattccctatttcctgcacacgtcatctagccaactaaattttaaattacttgaaaaaaattatgtcttagaatagtgttgtgcacaaaaagtggaccccacatactcatgaaattgatatacgcatccccttttacatatcactacccacccctcactgggccactctcactaatgatgtagagatcactaacacctttctacaaat

SEQ ID NO: 97100 - DNA, 1047 bp, Homo sapiens
agtaagagttgctattccctgtccattctgatacttccactggctgcatttaattttaactttataaaataaaacaaaatttttaagcaggataatctttagttttacacacattgttctacctgttcgagacctgatgaataagaaaatattgtcttgttcacaacttttaagtcacatggccgagcactttttaatagagcagattgttctttgaggatggacccttgctatagctatttcattttcttgataaatctatttgttgtatacttactgcttccttatttacttttgttcaagttagagtcctttaatggcccaaatgtaatatcatgtatgtgtttcaggctatgactgcctcaggagtggaagacattttgactgagttctgtgttggctcagtactgggaagatgtgagctaaaacacatatgctctttccagaatgggtttatgatttagttaggccttgaagcataacattaaagaaactagcaatacaagaccacatgcattcacgaatgctacagacaccacgagtgcaggcagctgacagcttcgaggaggcaagaagacgtaactgtctagtcaaggaaagatggcaaagggcactccaggcaggaaaaatggcgggagcaaagggctgggggaggactgtgggaaatgtgtcaggaacaataaagacacctgttgcatgagcaaaaaaataggggaagaaaaaattgttcagggagttgaggctagattttagggctgatgtaggaattttatcacataggctatgaggaatcattcatgatatctgagctttcacatgcattatttcaaggattgaataaaaaagaataggatggtagagttggagtgaggaggttgctaaacatgagtggcagagggacagaaacccatggagaaagacgggaaactaatgactcaaggtgggaggggaggatgcaggcttcgctgataaggaaggagaaaaattaggatcccggctgagagattacctttagatggagcttcacaaacaagaagtgtgaggatt

SEQ ID NO: 97101 - DNA, 1138 bp, Homo sapiens
tgcccctgtacaagtaatccttaatttattggaattcataaaaatggttctcagctcattacacctatgctatcatcttaaagcctttgtagctgacagacactcaggtgaactgctgagctggcacagcgctgtgccctggtgactcagttcctatttctggggaatttatattttgagaatctgatttcttatacagatgtttgggtttttttctctctagataaatatcttccaatctaattagtgctagattttaaaaagcaagccccaaaaacctcttatttagcttttcaattttctctaaattggatattctcttatggtataatctgatagtacatgatagtatattaaaatagaatatacaggatacattttggaccagatgccctttgctgttgtttctctgctgtggtcatggaccttgtttcctaagcaatctgtacaagagagctggaaatctgataatgggtgaatttcttttcctttgaccaccttcactggagacttgtcccagtgtaccagctggtacaactacatacaaggacaatactgttattcgtgactttgagtctcatttgattaatagcccctgtaaataccactcttggaatagcaaccacattttctaatgcctgccatttcacttggaaaattctagatatttctttcataattgtaagttattaaggctgggcattgaaaactgttcttttttcaggctgggcatggtggcttacgcctgtaatcccagcactttgggaggcagaggcaggcggatcacttgaggtcaggaattcaagactagcctgggtaacatggtgaaaccctgcctctactgaaaatacaaaagttagctggacatgttacctttaatcccagctactcagaaagctgaggcaaaagaattgcttgaagccaggaggcagtttgcagtgagctgggatctcaccactgtacttccaggcttggtgacaaatcaagaatctgtctcaaaaaaaaagaaaattgttccttttttttttttaattccagtggtcagaaatgaaaagtcagtcagaccaaagtgttgcagataaaaatgacttaacagtttttaaaaaaagtttaaatagttaaaacaaaatatataagt

SEQ ID NO: 97102 - DNA, 1113 bp, Homo sapiens
actaatgatgttgagcatctttttgtggacttaatggccatttttatatattctttggagaaatgtcctttcagattttttgcccattattgaattgggtggtttttagttgcaggagttctaaatacattctatgtattcaacctttatcagataaatgattgcaaatattttctcccattctttaggttgtcttttccttctcttgatagtgttctttgaaggacaaaagtttttaattttaacaaagtccaatttatctagtttttcttttgttgactgtatttttgatgtcatattgaaactataatatattttaaaacgaatttgtaacttctgcatttggaaatgttggttacatgactgtatatacttagcagtgcagatattgatcaaagatggagtaagaaagggtatctccattgaaagctttgacacactaaatagtttaatctcttttcaggtgagaaattgcagtttattttcactaatattgaccctaagaatcctgagagcccatttatgttttccttacatctcaatgaagcaagggactatgaaggtatgtactaatatctcctaactggtatttaagattggcgttccaaaatgttatttcaatcagcatataaagtaatatggaggaaagtaatagctccagactctattgcttcctttttcagtcttgcttcttggagtatagtcttctaaaggaagtgaatatagtcttgatttatagatactgtctaagatccttaataagtagcatctcttcaggatggcacagtgccacagtgtctgaacaatctaaaaacaaagatcattgcatttatgtgcaaatatgaattgtccttttagataacttttttaaaaggtgaagctttaaagaaaatggctgcttaaatgtgaatattagaatttatccaagtagatgattttaaaatcaaatgtaaagtcaccagaatttaacaatttattttcccaaaaataatttttgaaatacgaatcctgcaaatctcacacattgataataaaggttagttactgattctgcagctggccaaaaggcctttgatttataaggaatatatatcattgataataatgtgaaca

SEQ ID NO: 97103 - DNA, 2604 bp, Homo sapiens
aatttaaaaatcagccaggcgtgatgtggtgtgtgcctgtagtcccaggtactagggatgctaaggtgggaggctgcaatgagtagtgattgtgccactgtattccagcctgggcaacagtgagaccctgtttcaaaaaaatataaaaataaaataaataatagagtttagttatctttgttggtagtttttatttctgtgcttatttggagtggggagctgcaagggtcatgatcttttgattttctgtttcttgatttaatttggtattctcattttaagaagcttttctgtctcattttttttaaagatgagtaagtaggaaagaatagattaggttttttttcttttttgtcttttataattttgaatcattagaaaatgcttatcagtcaaaacattctttattaatctttatgaaagtcagtaaactttggccttttcttagatacatgtcagagagccaagcatattctagctaataccttgtgcttcttacagagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaagtaagtttcctcttataaacatactgatctaaaatggaaagtggtgacggttcacctttattaagtacatcttgcctgttccagttcattgctaaaaatggattacagtaccccagggcataaccagccactcatctctgcaagatgtcattaaagttaactaactgggttttattttcttttgtcttacttaaagggccttctcttgttatttttaatataatcagtaataatgaaattgataggaggttttaattaagcagagtgagaaatggtgtccctaaataaaatttgctttggacaagccatagtgtactttatgcaacaaatatttattgaccatacattctctgccaggtaatgttaagcgttctttttatgctgcaaaatctcttatgtataaagaactttcatattcaaatgaatgcatcttttagaaaggagccttgtttgctcacaaactaggtagtctattcttcaaatctgaaaatagcaaagtttgttttgtaaatgctttttcttgtggagttcttatccaagtctaaattgtgaaattatttttctcattacttagggactattgtgctactttaaagtatatttagggactattgtgctaacttaaaaaaaaaaaaaagaaaaaactaaactagcatgaaataaggctgacctctcataagaaatagttatgttaaaggaagagaacattttcccatgaagcaattggttatctagaaaaaaagcacagtagtataaatgaagtctatttctatgccagccatacaaatccctggcctatttacttatgctactacataataaagtaagacaaggcttattcttctcactatctgtatacattttcctgagcagtttttccttccaacttgaatgaacagaagcttcttttagccaactggtagatatagaaacaataaatggaagcagatttataggcttggcatcattttatagttgattttaagtttaaaaaattaactcagtgagcattaatttgctattatttaaaacatttaatattgtgtgtgttttttaatcagctatttctactgctaataaagcgaatgcagagaggttgaaaaggctgcagaaatctgcagacttgtataaagatcgacttggactagaaattcgaaaaatttatggtaagtttgttaatataaataaaatataggagattacaaaagtatgtcttttcttaagtagaggaaaattttaaaaatattttcaactaaaataatgaccacattaactttttagaaaataggaaaaaattacaatttttaaattattctaatgtagctactgatgctgtagttatttatcattcggtattttaataaatgtatttttggcatgattgtcaacatgcaaataatttttgttcttcctatcagcattgtattctgagcatttcctcagttgctatagtcttcataatggtaatttttaagtagtgatgtaataattcattctattaatatagcataatttattcaaccatttacctattgtttagcacatattttgcttctaccaacatttggattctgccatttttttcagttttagaaatacagtcatccccacttattcacggtttctgttacccatgttcaaccgtggtctgatgatattaaatggatgagtatggtacaataagatattgtgagagggagagaagctacattaatataacttttattacagtacgttgttgtaattgttctgttttattattagttgttgttaatctctttctgtgcctaatttacaacataaactttatcataggtatgaatgtataggaaaatacatagtatggacagtccctgacttatgatagttcaacttacaattttttgactttataatcagtttatcagggtgttaaatgcatttttgccttacaatgtttttgacttttgatgtgtt

SEQ ID NO: 97104 - DNA, 1109 bp, Homo sapiens
tcctgtgcagttacacttacctactaacaagctgctaggaggtaaaggtgtcctgaattattgctgcacgttaacaacagttaagcccaggtggcttgatctacccttgaatacctagaattaaagataagttgctattttctagcaaaggacaaattgccaaaatactgtatacccgattggaatatgtgggtgatttgatttcagtaacttaaaaaatgcaatatgtattctgtttttagcattgtcctacataatggtagaggacgaactggcacttttcgataaaagcataaatgaattttggaataaattcaaaagtacggacacctcctgtcagatggcgggactaagagatacctacaaggattccatcaaagcatttgcaggtacctagtgttaacttgtaacatgctggttttgctgttctagtttattttttagtgttattgcagctgaattgaaagttcaatttctctttcagaaaagctgtctgtgaaattaaaggaagaagaacgaatggttgagatgtttctggaatatcaaaatcgtatgtgaaaaagtataaatcatggggttttttttagataaaacatctttatcatgaaatctctcatacaagtaagacaatgtattttgtgtacacaagtgtgtatatgttgtgtgtgtgtatatatatatgtgtatatatatgtatatatatgtgtatatatatatgtatatatatgtgtatatatatatgtatatatatgtgtatatatatacatatatgtgtatatatatacatatatatgtgtgtgtgtatatatatatatatacacacacacacacacacacacacacacacacacgtacatgtagtggctcatgcctgtaatcccaacactttgggaggccaagttgggtggatccctcgagctcaggagttgaagaccagcccaagcaacatggtgaaaccctgtctctacaaaagatttaaaaaaaaaattaaaaattaaaatatatatatatacatatatatagacacatacacacacaaatacatacacattaacacatatacatgtgcttatatataggaataaacattgacatactatacagtttaa

SEQ ID NO: 97105 - DNA, 1057 bp, Homo sapiens
ggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactg

SEQ ID NO: 97106 - DNA, 1050 bp, Homo sapiens
tgactgttaatccaatgccaaatattttatgtttttattatggcagtactctacttccctcatcactctatgttattcggagtaattaatactagctgttgcaaccagcatatcctgaaatctcaggggtgtaacataatgaagccttattgagcactcataaaggccaacgctggtttcacagccctcctgcatcttgcagctgtgctgcctggaacacatggcttccaaggttgctgcagcagcacaggagacacggaggaggcacgtgtgcttttcattgcttcagcccagtagtgacacatggcacctccaactgacagtacgttggctagaactggtcacatggtcctaacccagctgcaagggagactgggaaatgtagggaagcacttgtttatttggtaagcacaaactgtctctgtcaaagaaggaagtatcttgcttcataaaagaaaaagttttgattttaacttgtttttacattgcaggtagaaaaccgacccctaaaccttgtacagaatatgaatataagtgtggcaatgggcattgcattccacatgacaatgtgtgtgatgatgccgatgactgtggtgactggtccgatgaactgggttgcagtaagtaaacacttgtttttatagttcattgtagtaactcaggtttacctaattaaaacatgcaataacataatgtagacactgaccacattttctccttaatgtactttttgcttgaattccagtcaagcccatagctagctgtgactgagtgcttatcctagaccagacattgtgtcaaacattctacatgcctggtagcaatcttatgagttagatgttattatctctttcttatgtacaaatgagcaacgaacttagaggttaaacgaattggccaggtcttactgtcattaagaggttgactcaggatttgaactctggtctgtttcactgcagagcaagtcctcttcccagtccactgggtgcctcttagcactttaaggctacatattttgtttattagtctgcacattatggtgggaggatg

SEQ ID NO: 97107 - DNA, 1095 bp, Homo sapiens
ataggcacaaaataaaattcccccaaactaaaaacaacacatcaataacagtaacaaacacaaagtttgaagactattttccagtaggagaatagggacagaggaaggtatgcttaacaggtcagggtgttcagttcttatctcttaagtctgtatgcaataaagagatatttaagaatttgggagacagtaatagtcaaaagaagaagtgctccatgtagtagtactgactgataagtacattaggaaataagtcctctaaaaagaaatcatgatcctgctatccaggattcactgatgtcaattaggagctttcattcttgatgccttccaagctgataaccaaatgtccctgctctcagagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcagtaagttcctgtgggaggaccaaggcatgaccagagcagggagacacgaggaaacttccatggggactgagagaggacatggagctttctttttcagctgatgggatgctcccccttggcactccctgcaaactctggcactgcaaggcagagtatagctgtgtggcttgcaggtggaaccagactctgtttctgaagtggctaatacctccttttgatacatagaatgtctaaccaaccagaatatgataccaagaacttatattttatatatctactgctttctcacttgagccacagagaaatgttatgaggtagggaaggtgggtgtgaaccaattccattttacagatgaggaaactgaggttcacattaagtggatggttacattactgtttagtgtcagacctaacacttcaacccaggttttttacttcaaaccctgtccttccccaaccccacccacaaagttatactgtaaaacaaa

SEQ ID NO: 97108 - DNA, 1194 bp, Homo sapiens
gagaggcattaatgcagatcatagcatctaagatgcagaggtagacgattgtagtgattaaataagatatctgagattaagaatctagcatacatttatcgtgagaaagaccctcaacagtttttattgccctccaacttcccaaacaatacttttatatcaccctggcagacaatctcaaccaatcactgctcctagaacacagctcaaaacacccactctttatttgtttattgttttttttttgtggaggaaatttattcatcatattaagagcacattttcagtttgtatttggatcttaagaaacctgttctatcttgccaagttatgttttctctgaaaatacaccattgtaactgagatttaattgatcctcttctagggccacgagagagctcatgcatgtcatttcttggaattcagtgttgacttcttctctccagataactgttgcccctggtgctttgctaaagaagtgctgtatgttctctgtgcaggtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtggtgtgttgagtcgctttatgcctctttttccgacttctatgttgattgtatacgatcatgattctgtgggtatttcctgaatatcatgaactaaaaaccagttcaaagtcctagaaggaaactcaggctccatcctttttctatttttatgaagtttttttttttttttttttagaaatcttaaggtttttacaaggcaaatggttgaagtagacaataagttgtctctactggtggctcttcaccatgtgctgggcattgaatcccctttgagagctaacattgaggaggaaacgagaggtttccacccccatttttaacagggactctcagttgtcatatttatttatgtttccatttaaaaggcaaaaaaaaaaaaaaaagactgagcacagtggctcatgcctgtaatcccaacagtttgggaggctgaggcaggtcgatcgcttgagcccaggagtccaacaccagcctaggcaacatggcaaaagcctgtc

SEQ ID NO: 97109 - DNA, 1195 bp, Homo sapiens
tgttgagctcatgccatctcgtgagaggcaaatgtgtgtatctctttgtggttccatgttcagtgatgtcacactggaagcctgagcttgaccatggtgtgaacagtcacactggaacatgctacaaatcagagcatttagaaaatttttcctgagtcctgtttgaccagcacactggccaggctcttttcttctcctcttctttctcatttctcctgtattagttgttgaaaccactgatgaaggagtaagttggtgaggaagttgaaaaatagtgacttttcaataatccacagtctttggaagtctttgttgtctgtcttagcatgattcattaagaattggcactgtttagtagaaatgttgactttgaaccattatagtgagttggtcgttgatattttaggatctctaagaactgctttttacctacaggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccaggtaagaaaacactgatgagctttttaaaagttaaaaattaaaaaattctaaccatgttttcatcttgataggaaattaatttttcaacttgggttaatatgcagatacatttaatgtttctgcaggtttattttctgctttgtatctgatattcaaatgatagattcagaacagaatatctaattattttaaaaatttatagtatcatttttatggaaagaggaattgcaagggaagagagtt

SEQ ID NO: 97110 - DNA, 1064 bp, Homo sapiens
agctgtctcatagatctgatgtataccaaaattacaaaagttgtatttaattagtttatcaactaaggaaaaaatgaatgcaattatttttaatagctatagacctactaattatctatagctattaaatggtagcatttaatggtagcatttctaatggtagcagccagcccctgaggaagttgtgtggaatgccaaatattggattcttctagaattggcgattagtggggtagacgaagatgatgggggaaaggggatcaaggacactggtgatcttgtcgaaatggttgacctggcatttaggtagataaagaaggaagcaaaaccccaagtgggtaatagttgaggtttattgccaacctctctgaaagtggtactggatctcatgatacaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggtgagtacaacagaggatttgggaaaaggaaacaggggagactgaatatggattctcaacccttcacgacttagactttccaacctgtcctctaactacaaagttaccataaaatcactattcctgatatagcaaaaggttaccaaagtttcttggtatataagatggggacacacatttttttggaccaattctttgcttagatagtcattagagagaacagaagatgggcaaatattcaggccatcatttaacattattgccaaataaggtactcaagaatgaagggaaccaggttgattctctttgaattcttgtaatgactttttgcctgaagcatccctctgctagaactcgttggcctgttcttc

SEQ ID NO: 97111 - DNA, 1897 bp, Homo sapiens
tttgttctgaatttgtaaagttctccctttttttcttcttggttctccattgatcagcatgcactttcatttttcccataggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtaagtgcactccaggtgctgcttgtcctgcaagtagacacaatggggtcaacacacatggatgactgagtgtttctaatgcatatgagactctaatgtctttgtgtgtgcttgtgtgtgtgtctgcctgtatgtgtccaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtatgccatcatcttccttgttatatttctgtctgcttatttctggaaaaaatggggcctgaaattatgttcatagatagccaatgtgttatgggcttataaaactatggctacagattcaaaaatgaaagcatattgagtgattttacgtgggaaggagggtgcagcgcatagctccctttgatggcagaaaggttggcaacatactaggaagtcaacaccctgacttactagatctcctttggacaagttgtgtaagtagaaatgaagtttcttttgccatgttactggcaatttgcaattaaagaatattgtccttttttttttttttaaaggactatgaggttccctgtgaattaattattgactccttttgtatgactaggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgtaggtgtctctggttactcatgtgggtgttaagaagaggtttt

SEQ ID NO: 97112 - DNA, 1073 bp, Homo sapiens
ccaatctccattacagaaattgtcagtgaaggtgttaaactcagggtgagtcagctcctgtgcaatggcccacgcttagatgtttgagtatatccttgaccagaatatcacatgcagggactagtggtttagctcccttttcttcaccgtgccacctgaaaaggttgactgactcatgtgagctccgtcttcattatcaatgaaaggggcacagtgacattttcctgacctgctgcttggtgtcgttgtgatgatcaaatcagaaaatagaagtgaaaaatctctgtaagggatagagggctgtataaatgtgagacattataattaggagaatattagtgtttaaatgttcaaaattttcactatgaatccatgaaactaatgaaaattccaatcctttagattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcagtaagtatttgtcactgaaatacattcatgggtgtataatgcatattcacacataactcacatttgtaagcacacacccacacacagtttcacgtacatacacgtgcatacaaattgaagttacctgaaatatttaaaaaatgataatgaagtcttaaacatggttaagtgccaagggctaatttggcatctgaaaggccagattgacttcagagtaagtttattccctttctcttcccattactttcaattccttactttgcttttacttcatagaactccctgttttctattgtttgtgttacttattagaatataacctctgtacgggcaggcattttgtctgtcttgtttgctgctcaatactcggtgattagaatagtgcttggcacataaaaggtgctcagggcatatgagttggatgcctgctgggaaagtgctaatgggatggaatttt

SEQ ID NO: 97113 - DNA, 1055 bp, Homo sapiens
tatgttttcccaactgaatcttccttttatccataaaaatgttccctcctgaaattttaggtgagttggaagtaggaacttgggaggtgattttgctgctcttactctcattttctattgagctaatttcctcatttccctgaagtgcaatatagattatctgaatctcatgcaaatcctctctcatccatccctaatcgtgctttggaatttgttttgtacataagttctccttcatctcagtttcctttggttccccttatgaaagtcagttctaataagtgattttatgctataggttttgacactccacggagatatcagatacagaaaaacattgattgccaatgatgggacagctcttggagttggctttccaattggcataactgttgatcctgctcgtgggtgagtattcataaatggcacgtgtcttccatgcagcattgttcttgttaatgtcagggtctgacaaaatggaagatttcaaatttaggacatcttctgatttcatatgtcaacatttgaaaaataatagatctcagtgagaaagagaaatagctctgacctatatttaatgtgcaggatattgtttgtattttgtcctatggtcttcaaatgaacaacactggatttaaaattaattccaaacaagcaagaattttaggaattttaaaatagcattataagaattgacaatatattctgactttgaaaggacacggaaagctctaagggattatgtaacatttgcaatagagcttgcaggatgagaagccttctagtaggtggagaatgggttgcaaccaggcagtgactcttgaggccaagggatccatgaaggcacagaagtatggcggcacttagcaggattgtggggagagccggaaccagaggcttagagtagggagctgttgaccacatgggagatacaacagataaggtcatttggggacaaatcaaggagggcctttaatatcatgctaagaagttgaactttattcttttgagtgataaggagcaagtagggattttttttaaaaaatttcaacttt

SEQ ID NO: 97114 - DNA, 1114 bp, Homo sapiens
tatttttagtagagacggggtttcaccatgttggccaggctggtcttgaacacctgacctcaagtgatccacccgccttgacctcccaaagtgttgggattataggcatgagccaccacgcctggctggcaaaaataaattatttgagctttctattgctctattttgtttcctcctaattatcaatactaccttgttgctataaaagtgttttaggtaatttacaaaataatatataagaagataaataaaagttgcataaggaattcaacataaagggaagattatggtaagcagagaattttactatgtttcctcatctaatcttcaatgctatttcagttctcaaccaaatttatagtttgcctctgttcttagatggaaatctttctatggctccagtacagtttttctaacagcaaaacagaaagtagaaacttgattctaattcctttgatactctcttcttcaagataagtgttctttttactctaattcccagaagaaattctagatgaggcacaggtatgaaatcacatgaagtaagtcagaggtaacttgactagtgttggtttgctccactctgagagaagggtaaaacatggaagggattattaattcacaataattttgaaagtgaaacttcccaaaacaaggagaagtttttggagggggatagttagcagagccctgacaatccactgctttaggtgggcaccagctggcaagacggtttttctctggagcattcagaaagatactgaagatgagcaaggcgcacagcagcctgctggctaatttagagcacctatctatactaaaaagcactctctgtagactaagaacacagcctatgtagagttcggtactatctgaggtttcatgcatcccttggtgatcttggaatgtatcccccatggatgagtgcagatgactgtttttatttctgccaaatgaagaaatagggaaaaggtgtcccaggcagagaaaagagctctcactggaacagcgcttgagtttacaaagatctttcactagcatctaatttaatcctcacaacattcctgagggcaggcagttctggtagccatttgtgatgagagggaaatttgca

SEQ ID NO: 97115 - DNA, 1007 bp, Homo sapiens
attaatagagatattattcgttgcatgcaaacactataacattttgtaatgttgccaactaagcaaatggatagagctttttcttaattgcaaaaacttttgaaaccaaaacgaaactatgcactaaccaaacaatgaagtcatcttagaatgttcagtgtgacaaaatcttgtatacttttctcagaaaaccctgctgttgatttggtggttagctacatgaggagacaaaattttctaatccccacaagtaattataggacaagttagatggtttaatctagatttttatataatatccatgtttgcattcatttatttgctctagaattcactctttattcacttttgtctttaggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaagtaagacttttttttaaaattatgttgccttgacatggttatgatgagggaaaaacaacagtaacatgatgtagctgatatgcatgttgctgatatgcaaaatttaaaatgatcccttgtttaaacatggtaggtgtccaactgggtgttgctatctctccttcatctgaatcatcctcttcataaagtacataagagcaattgattgtttactttattttaagagcacattgatttattagcttggcaatacaatttttgaaatgtcatataattaaaaattaagtttctaattactgcatgcagtaatagtccatagaggggccagtttgatgtaactttgataactcatgattatacaacaaaaaagctggatttttctgcttcagttttatgttgtttattagagctcccttttaagtcatataaggaaggcagtttttgcctgctgatcctgaagggaa

SEQ ID NO: 97116 - DNA, 1050 bp, Homo sapiens
aactctctaccatagctgagggcctcagaaaacagaaatatttaagacatgattcctgctgtccagaagcctacaacctattaaatagtaaggaagataaccaaagtacaaaaataaatacagtaaaaggaagaatgtaagcatagtttactctagactagtatttagaaacacagttaaatataacccaagaaagagtctattttaagtactcatgaaaaccagctaactattaaggttaagaatgaagtgattaaaatcattcatatggggcttcctcccctccccaccaacttactatagtttggaattacaccttctttctgttaccaaaagtattgaatcaaaagttttaaagagttgttttgtgttttctcccagtatcattgacatttttgcatttttttcttgaacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtaagtacatttctgttgacctttggcctggctagttcctctgtcttgggtctgtttgctgttattcaccagtgagagaaggccctacctcatctgggtagctctcatggtaccttctgggccacatcatacccaagagacttgcgtgttcataactacgaatttatggctgttttagataggagggtggcctctgaatgcagatgtgtgattctgaattccaggtcaggtgatgcagagacctcacaatgtctttacggttccttttgcagtcttttcttgtggatgagagcagaggaaagtgcaggaaagttaaggggttgcttttcttagctttaatttagtgatatttctcaatccatctcccagaatttcagtttcttggctcctgatagttacatttcctctgcctcttacaactt

SEQ ID NO: 97117 - DNA, 2170 bp, Homo sapiens
atgaagttcaaagtaatcatagctatttaagctctattgtaatgttctggtgattctttcatagaaagatagataaactttattattgaatctgcaattggaagtacattaaaaacacaggaaaaggaaacaggatgttcttttgacacaggtactcatctgctagtcagcagttgtgcgttctgtacttcgtttgttgtcagagccactagctgccacaaagaaatatttctatgtactagagtgtgggagaagactctatatcatttagccttaaatattaatttggtcatagttgttactataaacctactattggatccaaaatcatttcctctgagtctagactataaaagggatcacaaattacattcacaagccgatttaccccatgttttccttctagcaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgtttcaaaaaatgagactaaattgaggccattagattgtcaaattaaatttggttctgttggtaatgtgctcattaatttttctaactttaatattttctaatttcaatcagaacttatcacaaaaaaatgaagtccagggatttgtgttgctgtgattaaagtgctgtgattggcatgtaatcctaattactgtcatttctttctttcctctttaatcaatgctcactctcagatgaaccccagccaggtatgattgtgaagtatttcagattcttatgatttcatatgtgttgtgtttgttctgaaaatgtcctgattatattaacttacttccctttctaacgcatgttctgtgttatgactcttacaaatatgttagagtacacatggaaatagaaggcatttgcatccccaggcatgtgaactgtcttagggtggctttaggcattttcattttggccctgaaagtaaggcatgacgatatgttaccggatctgtgtactctaatatttcaatgacctttcccctttgatttgttcacttcatagattttctggtcttttctcttaaatgtttgtctatcttccatttctgtatagatagtagaatttcagaggaagaaaacgagaaacaattttaagtgtctttgcatgctctatcaatgacacttttcttccttgatgtcaacaatattttcccaagggttctcattgcattaaatggagttatactattgggttgtagtgaagaaggtgatcatactccaatggatatgaaggatggtaaatcctcagacaaattagagcaaaccctgaacagcctgtggaactcacccaagtgcatgctgcacttagctcttgtctgggcatcatattgaaggtggcatgagactgcataataaatattgcataagagtgaatcaaagaagcaaagattcttgattttcttttttcattattctctttcttttttctagatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaata

SEQ ID NO: 97118 - DNA, 1003 bp, Homo sapiens
agtatgttaagttcaatagcatataaagaaaacaaaattaattgcagtatctggagaatctctgtttgttctaaatctctggaagtcatgtagtttgtcccagtgttaacagccttaatttactactgctttttctaggtatctattcttcactgattggttccgtcctgctaaaattatgagagcatggagtgacggatctcacctcttgcctgtaataaacactactcttggatggcccaatggcttggccatcgattgggcgtaagtaggaatcatcatccccgatacttagttctcttttactgcagaacacataatgaggcaggttgggtgatatgatggtgtaaggaaactggtactgcttgccctcgcggaattttaaataattaattggtgatgggagaaggatattgaacaagaacacaaaggacataaacatagttggccagctactgctggggtgaaaactaataaattcatgagtattctgagaaaattgctagagaaagctgaatgacaagatttagtggaaactcaagatgggggaggtgggtcccaagcagcatttaaagtagggtacagatttgttgaactgtaggcagtgtgtaatttcttacagggaacatcttgagtttaggaaatctttggagtcaattaatcaacaaatgcacctttgcttacatgcactttgggaggactttaaaagtataagctatggttctcaagaaattgatgatctatctaggaatataggaaaaggaatagagtaaataagcttataaagatgaaatgccaaggtaacttatgggagaaaaaaagggaagaaatatatttcaccttttaaacatagattactaccactgtttttcttaacttgttgatttcacaaggagaaaataaaatttctggctcaaagatagcaacattttaagttttctaagacaattgattgaaagccacttcatgaaaagtagccgtctctttctgggggacataaaac

SEQ ID NO: 97119 - DNA, 1100 bp, Homo sapiens
cataaccattttttaagttactaatatgtcaatataaagatgtaaacaaatttaatccttttattgttggacatttaggaggtttgcaacttcctttgttataaataatgttgcgatgaaaatctttatacataaatctttgtctacttctttgattagttccttaggaaaaaaatccttgaagtaaaagtactaaattaaagatcaagtatttttaaaaagcaagatacgtgttgtcaaactgctttcccaatgagttccatcaagatacacactaatcaactgtgtatgaaaatcactttcttcccacggatgttcaaataaatatttttatattatcattgggagaatgtttacctaattttctaatttgcatttctttgattatctaattagttgaataatttttcattttatcaaaaatttatatttcttcggttaaatatctgcatggcataagtttttaaaatttctgtctattattgcagaatgtgacagtgcgcattttcgctgtggaagtgggcattgcatccctgcagactggaggtgtgatgggaccaaagactgttcagatgacgcggatgaaattggctgcggtaagtgaggaggggccaggctaagttctattttgagtaacctaagtgcttcctggtgatttcagctgtaacaaagagaagagctatgccttttagtgacagagccaggtctgggcccaagtcttttgagatctgtgtggttgaatagagaactgatggcattaacaataatttcactcccttctgaggtaggggttcaattcacattgatgatagagcatcagtttctatctcacccttatcccttgaccacaactttgatatggaaacatatttgggtgcagttttctggagtctgtaggtgattatttctaatattcactctgtaaattttgtgtacccacaagaacaaacaaaaaataatgttatctgaactactgtgatttgtaagtcaaagaggagtccatttttatgtaaaggatgtagaataacttgtgtcaattaccataaagaaatcacagaattggttagtgtgatttatgttttttaaaaattctagtttta

SEQ ID NO: 97120 - DNA, 1012 bp, Homo sapiens
cagtttcatttttcatatgtgtgattttaaataattgactttgaagtgttttataaaatgacttttgagtctctattttgtgttcttttcatgatgtgtttaacttggtattttagtttggcaaaaacaaacaaatccccccaccccactcctcaaaaatgggacttgtaataaaagttgcttaagaaatagcattaattatatatattttcaaaacaggcaatatatattgttctgataatttcctcctaaatactcagtctctaaatttatatttttcttttctccatagcaatatgaaactgtctgtaagaggactgttctttatgattgttataatttttcaaccagaagatactacctttacaacctcagatactaagggagacaaatgtactgaacttacaaatgtattatgttggattactaacaatagacctaattgataaaagtgatttaatatatgttgtgttaatagctaaacctccaaagcccctaatctcccatggaaatattgctttgtagaacaaaatccaatgagaagttctgggattccagagtgaatttgtacattccttaggggcatttttgcaagggaggttgttgtgttttaaaggtagttgataagagacctgcaccaccaaccccagacctgcaccaccaaccaccatcatgcattagtctatagaaggtatttgggtgtacgtactcctgtaccactcggtaccaccatttagccaagcgaagtttctgaccatttgcagcatacattataaatcaggatgtcactaccagacaatcagatttgaacattccatgaacaaagtagcctatataccctagaaatagatcacttaactatgtttatgtcatgctgttgatatgcctgcatttacacaaatcaggatagcacattgcttatttattttaggagtaggtacttgatctgtatatttacctaattttggttaattagccaaaaattgaaatgggtaatttagcatgattgctt

SEQ ID NO: 97121 - DNA, 1017 bp, Homo sapiens
ctttggtatggatagacatccttctgatattcataagttggctgacagttcactacaattcccataccttgcccacataaacaaggccagtccccttttgaagatttagagtcacctgcttatttccaaaactttacactatagtgatgatagccaagggtaacaaattgtatggagcactctaccctgtctagtgtcaaattgatagaatagtcaaggattcagttaatgaaactgaaacaagacaggaacagcaaaccaacctgctagtctctttctgtgcaacattttaactgtctggttttccttacagatcatcaaataggtggcaggaattcttttgggttttttttttaatccagtttacaaaccactgaatagactgctttgtcccaattattgattcagagccctgatgttttcttagagcaaaacaatactataaggacatttcaagaagtcaaagatttggggacaaaacccacaatgcaaattgatgcattatcatgtagacacatcatttaagtgcaaaaataaatgaataaataaataaggaccaaaagaatatgatgccagattcactaaagccacaaataaattcataactactatatgcaattgtcctaggatcagtggaagaaaaaagaaaaataagatatggtccttttttgctctgcctctccctctccctctccctctccctctccctctccctccccctctcccctctcccctctcccctctcccctctcccctctccctctcggtctccctctccctctctttccacggtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcactgtgttggccgggctggtctccagctcctaaccgcgagtgatccgccagccttggcc

SEQ ID NO: 97122 - DNA, 1100 bp, Homo sapiens
taatatacatggcagttataatttgtctagaccataatgattactattaatagggaatcctgtttttctatttttaaaaaaatttagagatgggggtctcactatgttgcccaggctggattcaaactcctaggctcaagtaaccctcctgcctcagcctcctgaatagctgggactaaggtgtgtgccactgtgcctagctctgtttttctttaaagttactgtgtaataaaaaaagaatttgcaaatgcataaaattgaatatacacatgtcccaagtcaattgtcaaatgattggtttttatgtaccaaaattctgcatttttttttcaaggtcacttctgatataagaatttacttcttccctaatatttggttcagtgaagtgttgaaagaatttgctaagtaatcattgaaagctaagattctagtgaaaaacaaaatgcatggtttaaaaattgaacatactaactgaaagacagtggaagttagatgcttcttgctgtaaataattaaacccaacagtgcagacgagagaacatggcaccaagagggacttgggctaagaaggatcatattgtattgaacactttcgtttccctgtaagggaaatcaaaagggtctttaatagttgttgctgattgtgaatatgtgcaacaaaatcccactgtaatccagatttatttttcaagcattttgctgtgattgaaggaaggagaaagggataggaagaggatggagttttattaaagctgtagttacttcttccctttaggaggtctaagtgtgacttgtcacagtgacctgggactttgattccctccagggccttcctgttctatgggcacattggtggatcaaagacaattgacttttgttttgttttgttttgttttgtttttggagagaagcagtggttctgctaactcagaacaagaacgacaagagtcatgtaggatgtttttctgagtttctctaacagtgctcgtttttttttttttttttgaccgccccctcttttccttttgaggtggggccaaggggtcaaacctccatttttctatctgtaaaaaagagaatcggcctttatgaagtgcttt

SEQ ID NO: 97123 - DNA, 1041 bp, Homo sapiens
gtcacctttgaagttccccccagaccctcctaagaacgttggattcattgaggtaaataactgttgcaggtcttctaatcttttctcacctgaatctgaattcatctcagaacacccctgacacagcccactggcttctagagaagctgtctgttccatgcttggaatggaagtattgaaaaacttcatggctcatttcctttgtatcccagcctcaactctttgttgacctcattgggacttacagtttgttgatcctaccgcctcttcaccatccctcaaatccctcacctatttacttcctcagcttatattttatggccatcattaatttcacttccctgcatacatacgcgctcagcagcttggcccctttatctggctctgttgtgcttggcaaggccctgatcctggttaaatccagttctccacatctgcaactctgtagctaaacatggcaggagaaaaacacaactatactgactagcctcgcttgacattcatgaagccaatctcaagcttaggacttgcttcctagtctgtctattgcctctcttgcttccttatatcttctcctctttcctcaaacctctgacatcaccttctcacatgtagagtgagctttttaaaactgtgaaaatggaagcaaccagaagagaattccataaacttctataactcaaccatcatcatttgaacttcgtcttatatcttctgtctttcctcctattactctggaagaattttcccagttcttaagtccaaccatttcattcatgttctagatctcattccctctcacctctctgcaattgtcccctctttcttttatgaaatcctctgttccacattaccttctaactatcactctattttttcggttccactttacagtaaaattcttgtacagatgtgcctatatccactgtaattacctttcaattttttctcaaatccatgccattttgctttagccctcatccttgatagatatttttttggtcaaagtcactcatgacttccatgttgttaaatccaatg

SEQ ID NO: 97124 - DNA, 1040 bp, Homo sapiens
gtgcacgttcccaaacctgtgaacaccaaagactggatttacaagtaatggtgaccttgaagtaattgtcctcattgatttcacttgaaggatcctatgtgcattctgactaaacaaaggtgttttcttcctgcatatactactccttatcatatgtctttctatacctttagcactttttcagtctctgagataaaagaggaacagtgagactgatggaatcatcttggtcttctggccatcaagactcatctagccagatgttttcactgatctttactggcataaactgctcttgagagagaagaatttaaatgtagtatggttaacaattttgactttcttaactttattcctaggcttccttactgtgtactctgaaatctccctgcacagggtcttgactctggtgctagtgatcctggactgatggcagcatttgtgatggccttagccccaggtaactgaatcccaggtcttcctgcaatggtgtctttatatcctggattttttgttgttgttgttggaaagccttaattttatttaactttttttcaatcagtgagacttgttagagtctctgttgtttctttaaacctttgccaagacttgtcatataactttatttgcaaaccaagaggattcccttgtgatattatacctggtgtcttcatttctgtttgtggaaaatatgtctgttgcactggctgtcctttcagatcttgctgtggctttcctggccctggctgcacaccagagatatgctgttaatttatggctcagaacctggtcctcaggctggtgagtccaaagttattattgctatttttaaaaaggcttcaagaaaaaagtattataaatactggagctgactagtaggtgagatgccttatgatgtcttcttagcaattgttgatcatttcagtctagctctgttttacaaagggcagaggtcaattcaagcttattcaagcaaaagggggaatttttgtaaggatacgctaggttaggatctagatctagagagccgtaaggaactg

SEQ ID NO: 97125 - DNA, 1037 bp, Homo sapiens
caccactgcactccagcctgatgatagagtgagactccatctcaaaaaaaaaaaaaaataggttattgagataaaatatgtaaataatacactaaaatgacaaattctacaaaaaactgtaattgccagaccttattaaaaagaaaaatatagctgggtacagtggcacatgcctatagtcccagctactctggaagctgagccaggagtatcacttgagcccaggagtttgtgtccggcttgggcaaggtattgagactttgtctctataagaacaatttttaaaaagaaataaaaatattaaaatgtatcataattatttgagtaatgttcataaatactaacaactacatattttagtaagtaaacataacccaagaaaatcacattttcagtttgagttgtcttttgtttgttctttttcatagagcttatgaaacttctaaaatgtatcgtgattttaaattaagaagtgcactaattcagaacaagcaactaagactgttgccacaagaacatgtatatgataaaataaatggagtttggaatttatccagtgatcaggtattgtgcaaagagctagtgaaccttttgggacagtgttttggtaatcatttttccattcatcattggatttatatagtcaattctaattgttaaaattagcattataggaaagcgtattacttttcaataagtacaagttaggttgatgataacatccctattttctttcaatacaatgaaatatctgataatcctggaatgtctccttaattaatgaataaaaaatttgcggtgctatgctaggtggtaaagatctaactatggaacagagtaactccgctcctatccttataaagaatacaatctaatgtatattcatggggattattacatatgttttgtttctcttactacaactcctttgccttaacctatccaaggttttgaataataattttagtaaggtctaacatttaggcactgtgttaggattgatttacatgggatatttaatcagatctccattttac

SEQ ID NO: 97126 - DNA, 1070 bp, Homo sapiens
tctctgaagcattcggagctcacttctcctctctctgggttataacatctctttcctgattacaggttccttaagaattgactggaaatcaagttaggtttatatatgaaacctcatcctggttttctcacaagatactgggtgctactgggagctcagttttgaacagttggaagccattttgaatattacctctgtcagggagtaaatatgtggaagaacactgctgaggaaataattgccttaattttttgtttttattttgtcttttttacttccctcttttcaatcaccacgcttttctttcaaactgacctatctaaagtccctcttatgaatgtaaagtacaaatccatgatattttttatgcacagttgtcttagaagatatattttaaatactacattaaagatacctttcaatttttatctacttatggctaaatgaataagaaaacccattggttttaatgtagtaaaatacaattataaatcagtgaaatacaggacttgattatgctcctagatactgcctggactgtaaggatgcttatgattggggtattaggctcattcctagcagtatgctgagtatctacatgtttacttcagcgacttgaaattttaagattttccctccacaatatgataggtgagaaccatgtcccattttagtgtgcagatccaaaggaaaagaggaagagaccgggcgtggtggctcacacctataatcctagcactttgggaggctgaagcgggcagatcacctgaggtcgggagttcaagaccagcctgaccaacatggagaaaccctgtctctactaaaaatacaaaattagccaggcgtggtggagcatgcctgtaatcccagctactcaggaggctgagacaggagaatcgcttgaacccaggaggcggcggttgcagtgagccgagatcacaccactgcactccagcctgggcaacaagagtgaagctccatctcaaaaaaaaaaaaaaagaaaagaaaagaggaagaaacccttctaataaaaagtcatttagacataaatcatgagagttcagggtact

SEQ ID NO: 97127 - DNA, 1025 bp, Homo sapiens
tttcttcatatttgggacataaccctcctagttgagagcaaagaacttgtattgaatttagtgtcattatataagacactacattgaagctcttattgaaattattaatctttatttttcagtttgtagaactgggatgattttcattaaaaaactgattaagtccgggcgcggtggctcacacctgtaatcccagcactttgggaggctgaaaggcgggcagatcacctgaggtcaggagttcgagaccagcctgaccaacatggagaaaccccatctctaacaaaaatacaaaattagctgggcgtggtggcacatgcctgtaatcccagctacttgggaggctgaggcaggagaattgcttgaactggggaggcagaggttgcagtgagctgagatcgcgccgttgcattccagcctgggcaacaagagcgaaaactccgtctcaaaggaaaaaaaaaaagaaaaaaaagattaagtagactaattatttatttttttataaaggtattggtggcatggatggaacacaacagcagatttttaaaatgttagcagaggtactaggaggaatcaattgtgtaaaagcctcggttcttacgccttattaccacaaagtaggtaagttattgggtaggttattagttactttcagaaaatcaaactaatttgaatagaatcatcttatcagttggaattttttaaagttttttgaatttttttcaagttgttattattattaaaattttcaaacggagatagaaagagcaatagaataaatcctcaagttcccgtggcccagtgttgataaccaagagcgttttctattctttagaaaaaaaaaaaaaaaaattaaggtcagtcctccaccaattctaagtaaaacccagattcagattcactgaacatttctggatcttcaaaagattctgtcctctccattcagtgtgtgaaaataagggaaatgactctttaatttctatttcattgttttaagttcatctgaaaaactaagttggtctatc

SEQ ID NO: 97128 - DNA, 1027 bp, Homo sapiens
actgttatatcaagtgcttagtatatgagatttctgataatatgcaggtttattgactcctagatgttcctattcagttttaaaacatttgggaaattgtcagaatatcaactgttcatttcttagctctctagtattgaataatttcactgaatcatagtattttataaccattataaccttgtattatttgaaaatcttaaaatatcttttacctgtatttttcaaacagtttaagattggattataatgaggcctgaatttcattgaagaagacaatatatttttctttattcagtaatattttatattcgagtaatgtggggagaacactagaattatatattggattcagtttttgtttatattttttttcctatttgttacccaagaactgttatttaaaaaaaattgcaagctaattttcagtctttcaaccaaaaacttttttttttttgcttctagacttaaatcaactatgttattgatgtcagaggacctaactggcgagcaagccctggcagtgttgggagcaatgggagatatggaaagcagaaactcatgtctgattaaaaggtatcttttctgaaatttacgacgttaagtttgttgtcattcacaagcacctatttttttctaaggaaaaatggttttcttctttaatctaccagttgttttgaagaaataaggaattaatgcttaagccactgtttatgttctactttgtttttcttttctttttttttttgtttttttgagacagagtctcactctgttgcccaggctggagtgcagtggcactatctctgcttactgcaacctctgcttccctggttcaagcaattctcttgcctcagcctcctgagtagctgggactacaggcgcccaccaccatgccccagctaattttgtttgtttgtttgtttgtttgtttttgagacagagtcttgctctgttgcccaggcttgagtgcagtggtgccatctcggctcactgcaacctctgccccagacgggttcaagcgatt

SEQ ID NO: 97129 - DNA, 1023 bp, Homo sapiens
attatatgacttcttttatttatttattttctaaagaaaggaattatttgagctctttaagggcacaagaaaaaggggcaagaaattatcctgaaagcaaataaacctgagaccatacttctgaaaaattaaaaaaaaaaagtatatatatatgtatgtataaatatatatggctctgaattaatgcctacactttttagaaactttgaaggtgattatttattttaaacaattttcctctttttcgaaaagacagctctgagtttgtgggctttttttttccttttatggtaaatttgaaaactttatgtaaatgtcagatttaaaacacttttaaaatggggtgcagaaagaagcccctttttctggacatttattttttgatcaaattctgctatctggtttagactaagaaaaagtctttagttaatgcagaaaaaatgtattactttaatttgaattttggaatcattttgatattaatgatgtaagcataaccatgttaaaccaattcttttatagaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgt

SEQ ID NO: 97130 - DNA, 1001 bp, Homo sapiens
caagtaatccatccgcctccgcctcccaaagtgctgggattacaggcgtgagccactgtgcactgtgcccagcctgacttttgcttttttttttgagacagagtctcgctgtcttgcccatactggagtgcagtggcgtgatctcggctcactgcaacctccgcctcccgggttcaagcaattcttctgcctcagcttcctgagtagctgggattacaggcatgtgccaccacacccagctgatttttgtattttttatagagatggggtttcaccatgttggttaggctggtcccaaactcctgacctcatgatctgcccaccttggcctcccaaagtgctagtattacaggcgtgagccaccgtgcccagacctttttgcttttaatgttaggactaaacttcaattttcatgttgcttaagtgtcggtgattttccctggtttaatgcataaatggtcaccataagaactcggtatttttatttctgtagggaaaaacttgcatcctgaaatttactacagacagtattcagagaaaactgctgttattgggagtttgtacttctagcagcagacaagaaaacttttgaactttgttttagaataatggcttaaaatgatcacacgcttactgaaatttgattatataacacttataaacaccaatcttttatattaaaatgattattttaaaaacatgaatgatggccgggggtggtggctcacacctgaaatcccagcactttgggaggccgaggcgggtggatcacctgaggtcgggagttccagaccagcctgaccaacatggagaaaccccgtctctccgtttctacttagaatacaaaaattagctgggcattggtggtgcatgcctgtaatcccaactactcgggaggctgaggcaggagaatcgcttgaacccgggaggtggaggttgcagtgatccgagatcacgccattgcactccagcctgggaaacgagcgaaactccatctcaaa

SEQ ID NO: 97131 - DNA, 1224 bp, Homo sapiens
atatactatttaacaatagttaaatagtatattaactatatactattctttttcttcttacatgatttttgcttcttaaaaatctcacattttaatcagaactctcatttttgttttctaggagcacagggatcagttgtccttgtttttttttggtcttttcttcatttgaaggtaatctgcttattgagttcactaatcatacagagtaaatacaattttctgtttgagctattaatctgtattccggttgataaatagaaagttgattacataataatggttaaggcttaactttcaagtcttttctaattgcttcacaaaatgcaatctaatctctaaaaagaaagcactaataatccatgtgatttacctcatagaaataaatatcaaaataaattcaaactatatttctaatattgtttcacagaattttttttccagaaatttgtgaaagatctttgctattttagtctgcttgtctgaaactgtattttactcacagattaagtattggagccatgggaataaaggttcaacgtcctcgatgtttttttgacattgccattaacaatcaacctggtaagaatattagttgacatttataaatgggtgtttaatattttaaattagtaaagaagtttaaccaactaccttctttttcagctggaagagttgtctttgaattattttctgatgtgtgccccaaaacatgcgagaactttcgttgtctttgtacaggtttgttcacattttcaactgccctaatagtagtctcagttgactatggcttgcttgcttgcttggttttttttttttttttttttttttttttgagacaggatcttgcaacgttgtccaactggactagaactcctgggctcatcaatccttacacataagcgtcctcagctgggatacaggtgtgagctaccacacctggcatagcttgctttaattttttatttactctattttagatttctccatgcatattacttttctcttaacatgaagattacacagcagtgactagggcgtgaaagtaattcttagaaatattatggctgggcagccaggcgcagtggctcatgtctgtaatcccagcactctgggaggccgaggggggtggctcacgaggtcaggagttccagacgagcctggccaagatggtgaaaccccatctctactaaaaatacaaaaattagccaaatgtggtggcgc

SEQ ID NO: 97132 - DNA, 1002 bp, Homo sapiens
tttacaacatgatttgaaagggtttcaatgatctgtacttaattcttagaattttaatgatagaataggaacttccgtaggtcaatcttaacttttattaaaggagattcagcaatatttcttacaacatccaaattttaggtcattttttctatgaacatttttaaaaaatctttgatattctaaaatttgactataatattttccaaaaatttaagttttcttgctggaatttttttgttgatgtgaagaccatttggaaaatggtctataagcatatttaatgtggaaataatttaatatttttcatccttcacttttgacatttagtgaaatgttgtttaaaattctacatgatttgttcttaatattctaacccaagattggaaaacaaattcctccttttgcggtaagtgatgctatggcagaggttaagttaatgagtccagactaaataatactctgtgtgctcagaaatgaaacagatgaaatgtaaaagaatctaatctggactgtctcactcttttttttaagagatgggatctcactgtgttgcccgggctggaatgcagtggcttttcatgggtgtgatcatagtgcactttaggttcaagctcctgagctccagtgatcctcctgcttcaacctgctgagtagctaggactacagccacactactgtgctcagctgtttcttgctttttaaagatagtttcatttttttatttaaataaagtggtgttatcttttccaaaaattgtgaaggacaaatataaatggaaaggaaggggattgagataatatttgggttttataagcaaataatagaaaattaataatatttgaatcttaaaaagatgagaggggaggctgggcacggtggctcatgcctgtaatcccagcactttgggaggccgaggcgggcggatcacgatgtcaggaaattgagaccatcctggctaacacggtgaaatgccgtctctactaaaaatacaaaaattag

SEQ ID NO: 97133 - DNA, 1048 bp, Homo sapiens
ggttagaaataacactgaaatgtctattttagttacataaaagttttcagcagtaagtagatattgcttttataattagaacaagtttgataaatacattatgtggaaagcattttgccttctgttctacttaagattgaggtaatatgattatattaagatagcagttgatgtctttgttttcaactttgtttccaatacagttattttctttttctttttagagatgctaactttgtttttctctgactttgtttttattcttctatctgatgatttccaaaagaacaacgaaaccaactcctcatttagatgggtaaatattattttatttattttacaacctgttttaaattaaccttgaaataaaaagcttttatttaataattttttacttgacactttaggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaaggtaaaaaggaagtacatatttctgagaatacttacacatacaaaataagcagagatactctaaatagttgacatgaaattcatactcaagctgaaagaaaaatgaggtttttgttttaaaatgtatttctgtgcttttattttttacttttttaagttgacaaaacttgtgtatacttactgtgaacaatatgatgttttgaagtatgtatatgttgtggaatggctaaattgagctaattaacatttattgcctcacataattacccctttttgtggtgagaagaacacttaaaatcttagtggttttgggttttttttttgttgtttgtttgtttgttttgagacagagtctcactctgtcacccaggctggagtgcagtggcatgatcttggctcactgcaacctccgtctcccgggttgaagcaattctcctgccttagcctcccaagtagctgggactacaagcgcccaccaccacacccagctaacttctgtatt

SEQ ID NO: 97134 - DNA, 1033 bp, Homo sapiens
caactgtgatgtatttctcataggaaagaatctcagtgcaaaataaatagaaatcagactggtgattaaagcttttttaattgtggggtaaagagttaccatattttaacaagtatattttatgtttaagtgtagtatttttattttgcttgcacaattttatgtttttatttcattgtgaatttattttctgtgttagatttccttaaaatttgattttttccccctgcatatccctcaggtttattagtttagcatatataagtagatttttcaggttatatgttttttcatacccactctgtctcaccagcagcataggtattggattcaggttaacagttgggctcgtgagacaaaattagcttcaccaggcactaagattacttacccttaagaaaggatatagggcaggaaacggcatggctggtacatcaacagcatagaggcactgtcatgatttccaggcacagcttgcgtatatcccaaacatctcacacttgataatgtacctgttccttagaaacataactgggtaaggaaggattatcttagttcagtgaagccattacatctacggtctcttcagcttttataccttgttcccattctcaagtgcagcaacatctcatcagtactggaaaagcagtctgcacagtgaaccagaagtccttggtcaagtacaagtaacttcagccagattttcatgtatcttgggtttagtatattcctgtaaattatcagttacaaatttcaaggatgattcaggcacagcagcacatgtgcctgtagtcctagctactcaggagactgagagaaagaggattactagagcccaggagtttgaggccagcctgtgcaacatagcaagaccccatcttcataaataaacaaggttaggcatggtagcccacacctgtaatcccaacacttacggaggttgagacaggaagatcccttgagcccaggagttcgagactagcctaggcaacatggggagaacttgtctctacaaaaataaaaattaaaaaaa

SEQ ID NO: 97135 - DNA, 1473 bp, Homo sapiens
aagagctatttcccttcattcatttcattagccagtggtgcagtttgtaccacaaaggcaagataaatgctttatactttatgagtatcactgtgaactaatgtatttctaatataatctgatatatctcaatttattgtagttctcatgtatatatcaatattgtcccatctttggccccagttagcctcttcaaatccaccatgatttgaatgagtatacctttagatgggtcaagctcctcccaatttgtagtatcttcttctaattcttgttatgttacaccttctagcttcacttatttatattaattgatcctttaaactctgagtttttttttttttaccctttttaaagttactgcttccttaactgaaataaaatttcaatttaaaatgactttttgtagagtccccaaaacattctattcatcatgggcaattgacttccctctgttatgagtctcctcttgagctaaatttcttaattattagaagactgcttgggcactgaaatataagcccatgccagtgaaatccatttcttatctctccatgttgctgtaaagcagtttttctgttatttccctgcactagttctgccaatcttgataataagagggaaagtggaaaactacaagattagaacatgggactcttcattgttattctgtgcttttaaaaaaaattcttattcagatgtttgttaacattagtttagcattttagactcacctattttttaaagttctttggattaatagataaaactttgaccagtgaattctggagatctggactctaatcctgagtcttgactcctttcctgtacttcccagttcacatagctggatgatctaagtgctaaatactgaacttagtgagaatctgcagaaaatttaaatctccttccacaaagtttgtctaaaaattgttgatcaaaacctttttgtttttattaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagaggtcttaattttacttttctaatgctagctttatattctgatttcctttctgtaaatctgttaggattttgggtcaattatatgaaactgttaaaatagtgagaaatatagcatggagcgtaggacttttgatattccacagtctatagattaaattttgggtacgttcattttcttttgaaagaaaacctatcagttcatttttttgtgtactcaatgaaataatacagctttggtgttacagatttgtgtgttttataggaggattatgggatttatgaaaattgcagaaaacca

SEQ ID NO: 97136 - DNA, 1147 bp, Homo sapiens
caggcatgagccaccgcacccggcccagattcatttttattaaagtaacatgtctggccaacaaaagtttttaaaaaaatgtgttaactttctgtttgcttccttctagtaatccacctaactcccagcctgcttcataccagagacgacttttagttactagatctggcaggaaaattaaaggaagaggaccaagggtaggtgattctttccccagagatcttcacaatattgcatttgtcttccttaaataattttagggtgtttcttaaatattattttaatgtgcaagtaactaaaatttaggggagatgcaggcattgaattatatattctctttcttaagcagcttctgtatgttggtacttcccaacagaaaatccatgagatatgaatagattttacatttacatggtataaaatgggatcgaggtctttcttgtctcccgtgtttcttggcaatcactgtatctctattcttgttaaaaataaataaaaattaaccctattcttgtattttattctttttttatttactagagtgtcctcatcagaatttaaatatcttgtgctttcaaaactttatagaaacttggctatactttcctgtcttatgtcttcacttcctacttattcctcaagcattttagttgtcttccactaccgttgttctgctgaaaacagcacttgatacataatcagctccatgtcacaaattccagtggattcttttcagtcttcatcttacttaatcttgctccttgtaatattctttccaccccccccttttttttttttgagatggagtctcagtttgttgcccagactggagtgcagtggcatgatctcggctcactttaacctctgcctcccaggttcaagcagtcctgcctcagctccccctagtagctgggattacaggcacatgccaccatgcccggctaatttttgtatttttagtagatacaaggtttcaccatgttggccaggctggtctcaaaactcctgacctcaggtgatccacctgcctgagacagggtctcattttcacccaggctggagtgcagtggtacaatcaaggatcactgcagcctcaaccttccagtctcaagcaatcctcccacctcaccctcccaagtagctggga

SEQ ID NO: 97137 - DNA, 1015 bp, Homo sapiens
caccaccacctgtgcagttccttcccaagaataatctgattctcccctttcagtttataccttaactatgcaagtaacttaactatggtaagatacatgaatatatcttacccatcaccgaatactgtcatttctgcctcctaaatattcagaaattcatgtgtttcaagctttacccctgccatgttaattcaactccatcatattgtctgagctgtaaattttgatagttctcaatttttttaaatctcagtacctctttcatgttaaaaattactgaggacccaaaagaacttctgttggtgtgggttatatctatcaatatttactctttcaggaattagtactgagaaatacttgaaacataagaatatataagcacacattccattagctgtgaaagtaatgatatcaaaacatgtaaactgaataacactattgtatgataatgaaataatgaaaatggaacaggcaaatattgtgatattattatgaaaatagttttgaccccgagtctttagatcctagatcccactttgagattcactgtctgatcttttttttaaaatagtagccagaattgtcatttaaaaatgaaagtctgatttttgtgccactcctttaccattgatcttagggtaaatccaaaataactacaatggcctatgacactacacaaaacctagtccttgcttacctcatcaatgttatgtagtactactttcccttgcagtttttagatttggccatgtttggtctgtcttctcatcatttctaaagcatgctatgtttcttcttaactcagaaccttcctgtcagcatcttttcccttttccttttatacccattctattatagctgcatatatgtttaacatatgtgattatatgttcattcacatgctctccaagtcctgtagaatatgagttccaggaaagcacactcatatatcttggctcactgatgttctctcagtatgtaataagagtgtttggtcatcctaagggttgaataa

SEQ ID NO: 97138 - DNA, 3824 bp, Homo sapiens
ctttgaaacattaagtatatataacatttagattggaacttggcaacttatgagttgctctagcattacttggttaggactcttccatggagaagacgtatggctagcagctaaagtttttgtgattaatgtttcttggaatttgcaacatgacaacttaagtttctctgcctcattgatttcctatatgaaaattgggaaattttagtaattttcagggtatagaaatatcagacgttttattttaacctggaaacatatacttttaagctactgtttcaatgctttttatattttttttattttgtaccccttactacctcctgaccctcaccccagtacttccctccctcccagcacccatgcgagtccctctatacttctatacattaatttttccctattttaattttctttagcgttatcgaactccttccagatccagatcaagggatcgtttcagacgtagtgagactcctccacattggaggcaagagatgcagagagctcaaagaatgagggtatcaagtggtgaaagatggatcaagggggataagtaagatttaactattattatttcaaatgtaatgataagtgtttgcttttactattatacataaagttattgtcattttagttattgctgaataccttaagaaaagtagaatatcattttagctaataatatctacagttcttttcctaataacatttccccaattctttttcttattttttaggagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagtagtagatgtttattataaaatccaaggtgattgattccttagagactgaccacaaacccacattagggataattgagtctgagtgcccaagctatataacgttatgtagtttaagcaagttattgtttgtcttaatttcagttaactgcattttaaaattgttgttataaactatttgagctttaagaaaggtgctatttaagaaaggatttctaataacagttaaatattttttttaagtccatgctaagtaaaaattcttacatgttgtctgatcccagagctttatctactaaaaattatacat

SEQ ID NO: 97139 - DNA, 1017 bp, Homo sapiens
ttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaacagtttggttttgtattttttaaattgtattatccagccttttaaaaattaaaagctaaataatgaaaataaaccaattaaaacatacttttactctcagatatacaggtatttacattatgaaaaaactgaacaaagttttaacaatactgagctttaagaatttagccagcagggaaaatttccaggtttgagaatgttctaatgtaaatatttaatcataatacttcagattgtagtgtgtcttttgcccagcaaa

SEQ ID NO: 97140 - DNA, 1052 bp, Homo sapiens
actacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagcaattgaaaagtgtatcacttaagattaggttcagcagcataaaactaaaaccccaaataccagaggcttaaaaaaaaaaaagagagagaatttttttttcctctcacatgaaagaattccagaggtaagtatttcagggttgctgtgttagtctaccaacctcagcacttggcattcaacccatgatccaaggttgctggtgaagctctagccctcacagcagcactctggccagcaagaaagagggcagtgagaaagttacatcccctgtctaaagaaatttcccagaagttgtacccaacacttctatttaaatgtcactggccaaacttagtcataatgccttacttgtaaatagcaaggaaggatggaaaatatagctttcattccaggtagtcatgtgcccaggaaaagttgg

SEQ ID NO: 97141 - DNA, 1122 bp, Homo sapiens
gcacacaaggccaccctgtgtggcacctgtgacagcaggcatgccagattgcctgccattggttaaggagacagctgccaagacctgaagggacaccactgcttatcgagggtatctttctataaggattctactgctaccatcttttacagataggtgtcaagtaaaagttgtctgtgttgggaaattcccagaaaggtgatctgttgggtgagttcctccctggcctcctacagagccagctaaggacaagctgaaggataatggcagcatggcaggaacaggcgatctgaattaggtgacagggaatgattttcagcctcagcgttgcagtattgtgtgcctgaatcaaaataccaccactccctattttttgtgtgctaaattttaaaggattattacattaccacactgtggaatctcttttgtttgttatcctttaaaaaaatgctgttttctttttttctttttaaaagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatatatatatacacacacacatatatgtgttcatatatatgtatacatatatatgtgtatatatacgtatgtatacatatatgtgtatatatacgtatgtatgtatacatatgtgtatatatagtatgtatgtatacatgtatgtgt

SEQ ID NO: 97142 - DNA, 3186 bp, Homo sapiens
cacgctgtactgtattgttttcaaaactctaagatttcatggatctttgattttttttttaaatttcacttgtcctttttttttttttgagaactactacaacacgatgtgtgtgtgtattcacacacatttttggaaaatatctgaaaaaaaacccaaagcacttcacatgaatggagggccaaaggaagggctggggtacagacgccgtccagaaatacttaaaaataaatgtttatactaacacaaactagcagccattcccctacaacctggagtactttttaacccaatctgtttgggattgagggcgggactccagggtccctgggaggccccggcagccgcgcatgctcagagcacagggaccgctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaaggtgagtaactctcggtggctaatgagaagctacaaaagggtccgctttgctggtgcgcgactgcgcgtttccgttctttactgcttctcgcggcgtccgtccgcccctcgccttcctcacgttcaggccgagcgccgcgtgggccgcagccggaggcggcggagccgagggggcgcgggcggcggcgaggctgcccccgcgaggaatgcgggatcctggggttccccgcacgtggctggtgcccaggcagttccgcggttgcttagagacgggactgtggctgccctcatccccattgcgtcttttttttttttttttttttttacctccaccgccttctagtctcaccgaaggcttgtggccatctctgtaaagtttctggggaggtgggcacggggtaaacgccggagggttctgtggagcctatgggactgactggaggccaaagaactttgggccgcagatgtacaccagcgtcactcttttggtctgttagggccttcatcgctcacatcaggtttcagtgtgaaacgggaaaacgtgggtaatatttcatttacagtcgtacattctggaaaagtatctgatgaaacgcagttccaaaattaggccaaataggttttgcagggtctaaatagttattttatttcatcgtttgctttgtagggggccctagatcacggtagtaacttaggagtgtagattgtgatagacaagacaatgcataaaattgagtaatttctctagggggatgtggatcacacagtaccccgttgcaagtgcttcctatgtgtatccatggtatcgaatgcaattgcagtgtgtcaggggatgcttccaggaagtgtacctacatcagttcataactagagtcaactaatggcaatattctcgatgatttgttcacataacttttgtacagttgggatgactgggtggcttagtagagtcctggaggcaagtactttgtaagtagaagacttggtttgtaatttctagcaaactaatagcacagcttccttttttcattgcagtgctaatgtcaggaatacgaaacaggaaactggctatccaatgtattagtaaattagtaggcatactccccagtttaatgttgtgttagtatgaccacattctcccatttttgttttcgtatgttccttagcatagagtatctaaggaactgtaacatttttcaccttaaagttatgatgtctaacttggtaacaaggtttgggtaagtcagttgtgactacattttaaaagaaatgaggccgggcgcggtggctcacacctgtaatcccagcactttgggaggccgaggcgggtggatcgccagaggtcaggagttcaagaccagtctgaccaacatggtgaaaccccgtctctactaaaaatacaaaaattagtcagccgcagccgtggtggtgggcgcctgtaatcccagctactcaggaggcgaaggcggaatcgctggaacctgggaggcagaggttgcagtgagccgagatcgcaccattgcactccagcctgggcaacaaaagcgagactccgtctcaaaaaaaaaaaaaaaaaaagaggtgaacccataccaaacaaatgcacagagagccatggtaatatacagatagatagttatctgtttaaaactggaaatggttggtaagtgattggagtttttttccctaaagcttgcttgaccagctaagtgaagataaacagtttcttgttatagaagatggggtagtgatttactgaaagacaagttttttatagtttttagattttttcatcacttattccaaagtgttgctttgttgagatatttgagaactgagtaaagaaactgaacccgtgaaaatagaaattcttgattttttaagaaaacgggatattaatactttgtaaacattatctttctattcttgagttttatataaaaaataactttatgctaatttgggaaattttacagatagccgcaatggctgaaaatggtgataatgaaaagatggctgccctggaggccaaaatctgtcatcaaattgaggtatgattcctgtgctataaactgcaaaaacaagttccttgaaagaaaatacagaaagaacatttaattctagtacatggacatattcaacatttggtttgcctttgattcttagatgaacatataatagcatacagttttatattggtggagccaggttgtgaaacttaagatgtacaaacatttcaaaaggtaacactataaactagagttacttaatctttttaaaattttagtttcatagtctcatataaaattttagcttcatagtctcatataaaatgagaataatagtagttccctcctcataaggtagtttggaggattagtgaatataatgttaagtacttagaagaattcctgacacataagtaacataaaagtccttggtaaagtaccttccctgttaaataacactatatttttgatgatcttagtttttttctgcccagtcagttctcagctattgtaactttaatatagtttttttttttttttttttttttgagatggagtctcactctgttggccacgctggagtgcagtggcactatcctggctcactacaacagtattggctcactgcagcctctgcctcctg

SEQ ID NO: 97143 - DNA, 1074 bp, Homo sapiens
tggtggtacatgcctgtaatcccagctactcaggaggctgaggcaggagaatcacttgaacctgggaagcggaggttgcggcaagctgagttcatgccactgcactccagcctgagcgacagagtaagactctgtctcaaaaaaaaataagaattgagtgattaaccaatttcttccagttctttttatttaaccatctgttctttccacactgatttgcaagagccttttcatataatctttaaatatattcttctttaaggttttctagtctattgacacatctgttacactattttagtaattgacattttagttttatctttttgctaatttgtaaacattattgtatatttggggaaagtgttttgccttttgtaacttatgtatttttaaataacagaacttggtactgtagagtaatgtcaggattggagtccatattatacagtgttctgaaatacattgtaattatctcacagtattattttggcgacttcaatttgccacgggacaagtttctaaaggaacagataaaactggatgaaggctgggtacctttggagataatgataaaattcaacaggtaacaagcttttaaaaataatctttaggttttctgtttacaatgagtgctactgctgagtcttatgtttttatatgtactcttcaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattgtaagtgggcctgtaatgcatttaaatatcttacatttatttagaaagtaaagtacggaagaataagggctcaggaatcacagcctcactaattactgtatgtcctttcgtaatattcttaacctaagtttcttttgttttgttttgttttgagacagtctcatcctgttgctcacgttggagtgcagtggtgtgatcatggcccactgcagtcttgacctcctgg

SEQ ID NO: 97144 - DNA, 1152 bp, Homo sapiens
atgacttttatttttgacttaataagatactgatgtgtatttccatttagaaagttacaggtaaaaatttttatttggggaaaataatgactataaaatttttttttttctttttttgagaccgagtctcactgttgcccaggctggagtgcagtggcgcgatctcggctcactgcaagctccacctcccagattcatgccattcttctgcctcagcctcccgagtagctgggactacaggcgcctgccaccacgtccggctaattttttgtatttttttttagcagagacggggtttcaccatgttagccaggatgctctcgatctcttgacctggtgatccgcctgcctcggcctcccaaagtgctgggattacaggtgtcagccactgcgcccggcctaaaaattttttaaagtatgataaatactgcctagaattattttccaagatagtttaatagccagatttatgtagtttataactaattaaataccagttgtataagagatcaaataatattgaaagccattttggaataaaggatgacaaaggaaaacaccaacactatgaaactactttatttatttattattattattattttttgagatggagtttcgctcttgctgccccggcggaagaaactactttaaaatagcattttggtttctagtctttttcttgtatagctataaggtggtgtgagtcatttctggtctgttgttgcttttaagaaactttttgatcactttgtatatttttatagaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgtttattaaattagtttctacttgatcatttgttattgccactagatgtgatgtctgatattttctgaattatactaaattagtttctacttgatcatttactttgttgttattgtcactatatgtgatgtctgatagtttctgaattatacta

SEQ ID NO: 97145 - DNA, 1488 bp, Homo sapiens
agcattccttttctactgttcagtaaaattcattcaaactggtaaagacatggaaggtttgcagggtagaaaaaattactttggacaaagaaattaattgtgggactaaaaaccaagggtatggcttttgttttctgtctctggtataggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcatttattctgatttttctttaacagtttggttgttgaacccatttacttgagcaaaaactttaatcagtgttcaaaaacattgacaagagacttaaaaaaagttctttacagagtgctcaattgtgtctctacaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggtaagttttttttaagtcctttggtagtttcatgagaaaatttctacttccataaataaatgatttgccagagagaatagggatttggcttttcaactcctggataagtgccattcttggattattaacgatttacctcggttatgctgttgtataagtcagggacaggatatttggaagatgaatctagaggtcaggtctgtactaagagaaaagccttttctcattggtgcaaggaagttgttgcatctttttcaacagtatcattattagtaattgtgctcagtattaaactagagcagtacttacgttgaatttaacaaaaattaattgttacgttataggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaacagtttttgattttttttttctttttgtacccaaagcatttaggaaagaactagaatattagctattgacgatgggcctttcccacaggccatttatggtgtctcctaggctggctttgtatatttacacag

SEQ ID NO: 97146 - DNA, 1035 bp, Homo sapiens
agctactcgggaggctgaggcaagagaatcgcttgaactcaggaggcagaggttgcagtgagctgagattgccccactgaactccagcctgcgcgataagagtgagactcagtctcgaaaaagaaaaaaaaaggaaagctttgtgacaagtaattatttctagtgttaccaactttcctgtgtaaatatacaaagccagcctaggagacaccataaatggcctgtgggaaaggcccatcgtcaatagctaatattctagttctttcctaaatgctttgggtacaaaaagaaaaaaaaaatcaaaaactgtttttgctcttttcatatagtatatattttattagttagtttgtactaatacattctcatattacaaaggcaatttaatggaagaatcttccttttgatatttgaatcatctgaaataacacaaacagaacaatacattcaaagaaatctcatttgcataacaaaaagacaagttaaacaacaaaaaaatttttcctttctcacaggtggacattgaagtggacctaattcggttttccttttaaaagccccgcaaacaaaagtcgtttaaaacctatttaaaatgaataaaaaattggtttactaaactactggtctccagcaccattttctgttttctgttgtttggatgcaggttcttctttgtctgtttcttctcttgctcttttcacaggtcctataacgtaacaattaatttttgttaaattcaacgtaagtactgctctagtttaatactgagcacaattactaataatgatactgttgaaaaagatgcaacaacttccttgcaccaatgagaaaaggcttttctcttagtacagacctgacctctagattcatcttccaaatatcctgtccctgacttatacaacagcataaccgaggtaaatcgttaataatccaagaatggcacttatccaggagttgaaaagccaaatccctattctctctggcaaatcatttatttatggaagtagaaattttctcatgaaactaccaaaggac

SEQ ID NO: 97147 - DNA, 1100 bp, Homo sapiens
ttcctcaaagatttttttcagacaggaactgttgccagaggagagactataactcaggagtagaaaagtgtgttgtaactaggattactgtatgttttggtttctctgagtaagtcttagttgatcccttttgtcccattgtcccggtgtggcctgatgtacttaagggaggcagtaaggccaggttttcagaacacttgagcctggagctaaacagatctgagttcagaaatcacctattcttacttttgcagcatataacacatggagaggtgtataagttgtagtccaggaaactgggggaaggggcagtacatttttttagtgtcagtataacacaatagttaggaacagagattctgaagccagaccagattctctgggttcagatccaagttctgctgcctcccagctgttttcttggtcaaggtaattgagtttcatcatcaaggtaattgagcttttgtcatctatactatcctcacctgtactctaagtgtaagggactgagagtaccaattgtacttcataagaattgtgaggattacatgagttaatatttacaaagcacttagatcagtgtctgacatgtgtaattgctatgtgttagctattattatttaaatcatacatgtattcaaagattttaaagtgcttttgtaggaaaaatacttaattcatgtaaatacagtacgtaagaacccagttggaaataatacattctagttacatggtaatgtgataaccttttaaaaagcataaaatataacagctaaaaagaactatactgctaataataagtagtggtacatgtaggcaagcaacaggacacaacatagctagtaaataaatcctcactcactatatatgaaagcaaacaccagtaaacattggtatccaaacctgtgtccccaagaacaccctcaggtttgatgattcactaggaaatctcacaggactcagcatctagtcttattcatggctatgatgtattacagtgaaaggatatagagcaaaatcagcaaggagaaaggtgcattaggcagagaatggggtaaaccagggccaggcttctggagtcttctgccagtagaataaca

SEQ ID NO: 97148 - DNA, 1038 bp, Homo sapiens
ttgatagagttgccaaatttatgttgacaaaaaaggatttttttaaaaactatttactcttaccattctttcttaaaaatatttcagcatcaaagaaagaaccgatatgagtatatggcaatgtttttaacaagctgaggaaaaactaaacgttttgacttttttttattttacctcagagactgggcacagttttgtcattcttggcattgctagcagagactattttttgagaaacactggtgggtattagcttcctttatggtgcctcttactacataccaaatcattaccccttatcttttacaaaaataatctggaatggcatttggggaggactaagtaatgcaacacaagaaattattttagaaagagtcatttgcacaaattagattttagtcaccggcttgcttacttattctttttttttttattttttagcatgtatgctctatacaatccataacacttatgatgacattgaaaataaagtcgttgcagatctaggatgtggttgtggagtacttagcatcggaactgcaatgttaggagcagggtacgtaatgcaatatatgctatttgggtattgggtggctttaataaggagcatcaatgggattaactgaattatatttatgagactccacagaatgagatatagggagcaaaaatctgatactgaatacattttgaatgggcagaagatctaaacaaactacaaaaattaaataaaaatggtgaaagcagcagttccttttatacaaacctgagtttccaacccctgccgggtttggaaattatgctgttacacttgactgggcacagtggctcatgcctgtaatcccaacactttgggaggccaaggtggacagattacttgagcccaggagtttgagaccagcctgggcaacatggtgaaatcccatgtctacaaaaaatacaaaaattagctggatgtggtggtgtgcgcctgtggtcccagctacttgggaggctgaggtgggaggattgcttgagcagtgcaagatggcaccacta

SEQ ID NO: 97149 - DNA, 1041 bp, Homo sapiens
ctagagggtaatgagcacgcgacaggcggcgaggactggcggtgggtcagcaagtagcgcaggctttgcaggcggaggggatggggcaatgaggcccccaggtggccagcggaaccccggctcaagataaacgctgcagctcggcgccgggccgctgggcggcgaacgcgtgcgcgcgtgcggcctggcgcttccggcaccggccgaggtgcgggtcgcctccagaggtgcgtggtcgtggcgcgagggatcctgaggctgctccagcagtgcgccgccgccgtctcctggggcggcttgggttagccgggaggtgggtcagaggctcgccccgtgccctgcgtccgggcgtctccttagggcgcgtcttcgggtccggccagcggtgctgaaaaagggagaaggttgggggtagggaggaaacaagatcccagttcaatagatttctccgcagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcaggtagggcggctggttcaccacgccccggctttcggcgttagtccagtctactctgtgataaaaatagaacagttatttggatacagagaatgtctagagaaattctgccctaagatcacctgtcgcgttagagaggccttccttgacactgcagctcaaggcacaccctccacagacatacacactatcattttactgtctagttttctgcatatcccttaacactgccagacatctttttaatgtgtttttttctcttctcacattacaatctctgaggacaaggaatttgttagacttgttcatacttgaattcccagtgcccagaagagtcgctggtactatttaggagctcagtaaacatttactaaataaggatcagtttcccattgctactaattgcctacgcaaggattcttgtgctatatactctgc

SEQ ID NO: 97150 - DNA, 1217 bp, Homo sapiens
tgatctcaaactcctcacctcaagtaatccgcctgcctcggcctcccaaagtgctgggattacaggcgtgagccaccgcgcctggccttctgttcttctttggattgcttttcctacagtttttgttttccttaagttggggtttcattctgtcgcccgctggactttgataacagtaggaatgtacatctcagacaaaatgcagatgcctaaagtacatctgaaagatgatgtgaataattcctgtagtctatgcaaataaagaaataattgcccttattaaagatttcctataaggtgagtactttatttcagtagctcttaacttagaaagttgggagcctagcttggtccacaggcgcccaggagagaggggcgggaggaaggctctgcagcccgagggggcgtgtgtaggggcggggctgcgggcggaggagcgcggacgctccgggtatcgcgagagttgggcgggccgagcaatcgcagcagtctattccctcactctccctggaggagccgctggccctggactctccaaattctgagctctcatcatggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggtgagtggagccctccccgcgggcgaggcgaccctgggccggggacgtcgcgggagggcctggagcggagcactgggagcccactctgagctgtcaaggggagggtgcgggggagggt

SEQ ID NO: 97151 - DNA, 1751 bp, Homo sapiens
acctctgtctaaaaggagacaacaaatgcccttttgacagaagcgatgcatcagatgttgggacttatgagaaaagacatttcagagtttgcagtgagttacagagagttggtacatgtagggtcgtggcttggaacatgatgtcaatgtcagggacagtctgagaaaaaaggaaaaagtgaaaggggcgattttggatgggcagtagttgaaagaatattagcaactacaggttgctatcagttattaaacttcttcaattttcaggtcttaggattaatgacagagtacaatctttttataaatggtcacctttttcttcggagtacttgtaaggttactgttactccaaaatgtttgtacctactatgtgcaagcaaggcttcttggatattaaaaatgaatgaaacattgaccaaccccttactctacttgcactggagtagaaagtaataaattccttaaacaataacttggtagctagaggagggagatgaggtttctgtgcagagggagtaagaaaaagtcttcagaaaggaggtattttgaatttgctaataataataacaacataattgcagctaacatttgagttttttttttttttttttgagacggagtttctctcttgttgcccaagctggagtgcaatggcgcgacctcggctcactgaaacctccgccccctgggttcaagcgattctcctgcctcagcctcccaagtagctgggattacagtcatgcactaccacgcctggctaattttgtatttttttagtagagacagggtttctccatgtcggtcaggctagtcccgaactcccgacctcaggtgatccgcccgcgtcggcctcccaagtgctgggattacaggcgtgagccaccgcgcccggccaacatttgagttcttgaactgtatgtctgatactttaaaagtactttttaaaatttaatatttgaataggtaaaatatatagctaaaaagtacacacacacacacacacacacacacacacacacacacacggaagtttttctcacatctagtcttctatctgtccagttccttcccgcttagtttctcttggtgcagaacaagcaaagatgtttcctagtttttcagtctctttttatgcaaagggttacatactttccactgttctacatcttgcattttttggttatcttagatgtatttttcctattaaaaaatcagtgtcgtcattctatttttttaaaaaaactgctgcatagtgttccatgttttcaatttgccattctttaatttctttttttatttttatttttattttttgtgcgtgtgaatttgccattcttgatttaatgtctcttcatgggcatttggctttccagtataaaattaaaaacgtggtgtatctgtcttttccccacctggtcaagagagtcagtgggataaattctcaaaagtgtgatttccaaattgccctccctaaggcttagtactaattactctgtgagactgcctgttttccaacagcctcatcaacagagtagtagtaaaattttggacttttatctatttggttaaaagtggccaaattctagctgttttatgtgatttaacttatttattctttgactctgagattattacttttattattctcattgtacagaagaggaaagtagggcagagttaaaaaccttgctcaagttcacacaggcagtaagctaggcatgctggctccagggctctggagccagactaat

SEQ ID NO: 97152 - DNA, 1332 bp, Homo sapiens
tctggcaaccctctatgagttggtacattatatatatatatatatatattttttttttttttttttttttttttttgagagagagagttttgctcttgttgcccaggctggattgcagtggcacgatcttggctcaccgcaacctctgcctcccgggttcaagtgattctctacctcagccttccaaatagctgggattacagggatgcgccaccacacccggctaattttttttttttcttgtgtttttagtaaagacagggtttctccatgttggtcaggctggtcttgaactcctgaccttaggtgatccacccgcctcggcctcccaaagtgctgggattacaggcatgagccaccacacccggccggatacataatatttaaagatttattattatctttgtctgaaaccagagctattgcctgtatgtgtcagcagttgccatgtccagtttcataaagggcaagattgaacaataaacagtattgtggccatgcaattactctgaattttttctaactgcttggattggatagagtaattttcctgggctatacagctaatttactgcctcaagagaaataggtgatgttgaccagctctgcaacctaaaagactgcctctggaacctttttagaactggaaatcatcaacagcttgtaacagtgttctcatgggcaaagctggactacactggcatgaacagaatgtttgaacttttctaagtttttggtattttaaaaacccctttagattgccaaagattgaatgtgtgttgattttggggtttttattctaactgccataagtttgtaaatttcatggtttagtcacttttagaggaaggattcctttttttcagctgtatttgtgctcttagtaaatgagaataaatctttctgtgccataatccttttcaccagtgtctgactgttgcctgtaggatgttcttgattggagatggagaagaatcttgaatctatcacagctgtatttatatttaattttcaaattagcaattatagaactgtggggaggatttagttatttttgactgagtagtattgatataatcaatgtggcagtattagcagatatacaaaccaaaggaagaaaacaattgaggattcatttgtgggatgaaatcacaaaggctatggaaattgtgtgctaataactgtatgtggctgggcgcggtggctcacgcctgcaatcccagcactttgggaggccgaggtgggcagatcacgaagtcaggagattgagatcatcctggctaacatggtgaaaccccgtctctactaaaaatacaaaaaattagtcaggcg

SEQ ID NO: 97153 - DNA, 1418 bp, Homo sapiens
tgtaatgtctgactagctggttttgggctctgatgggatactaactggaaactgggattttaaacatttagttctcaaattttggtgcagagaatgaggagtttcatgttctgtcctatattacagatatttttgtctccttgcttgttcttcctcacatattctaagctccttaaaagataaggaccacattttgctattagccagaggccagcacctactaagtctcttgtacttaggaggtgtcagtaattttgaattaaattggataaaaaagtggctgctatacccaaaaagttactgtaagattacattgctttagttactcatgaggtggcattgattattaaatccatagcagcttttttcagagtgctttcattctttttttagtttcagaagtaatacacattgattataacataaaaataagtggataaagtaaaaagtaaaggtgcctttctccatcctacccctcagtaagaaatttccttttcttttaaggttacttatgtgtttaaaagagattagttataatttatccagcatttctagattttttttttttttagtgacaggttctcgcagtgtctcccaggctggagtgcagtggtgtgatatcacagctcactgcagcctctacctcccaggctcaagtgatctcccacctcaccctcccaagtagctgtgactgtaggcgcacaccaccacacacagctaaatttctttttgtattttttgtagagatggtatttcaccatgttggccaggctggtcttgaactcctggcttcaagcagtctacctgcctcagcctcccaaagagctgggattataggcgtgagccacagtgtggtgcctggcctgtgttgtgggaggtttttaggttttctgatctgtggtagccagaaattgaaccacgtgaatgtctggttgaatagtgttactctcttcagtagcttgcttttttccccttaacatatttatggatactatctcaaaagtagaactgcttcatttttaaagttaaatagtatttcattgtatttccatgtttttgtaatgtactatgatttttgcggtcagtccctactgatagacatttaaattgtttccagacttgggctgttgtaaacattgttgcagtcagtattcttgtatacacttgttcatatgtgtgtgagcttatgtatgaggatacattcctagaagttatatcttggttgaaggaaatttgcaaattcaactttgatagaaccctccaaagaaattaatttacattcctgccaacaatgtatgaaacaatttgtttccccatattctggcagtatatatggtggtatcagtgtttctgatctttgctgctctcataagtgaaaagttatatcccatttcatctgttatctccctgtcccactg

SEQ ID NO: 97154 - DNA, 1028 bp, Homo sapiens
cattggcaaatagttttttaatgacaataggaagaaaacctgtaaggtagatgttcttctttgtctctgaaactgttaatgcattaccatagttttggaaattatatttctcatcatggactcaatttcccatcctgtaattaggtactctaaaagaaagaggtttaggtttttgtaaagtggaactttaacactggtaattagagttaaccctttttttgtcattgagaaagtgggaagtgattacttggatttatttagaataatattgagtaggaattttaacttagattaagagtttctgtattgataaatcttaagtttttttaatattataaacttacatacacaggagagagtttataaaatgtatatgtacagtttaaagaatttcagtacaatggacattcatgtaccactatccaccttatgaaatacaacataaagtgttgataagtattttatattaccttatttctaatctgaaatgaattcaagctaacatagttataaaatctcagggtaaagaagttttctggttgtttttttaagacttaaaaaagcaatagagagtatttaagggattatgtgttgagattaggaagaggttaaaaaggttcatctttaatgctggtattaaaatactatatataataaattcttaaaccaagataatttctcgttttcattaaaacattgtcatttaatgttttaggaccgtgcagcctggattttttgagtcagtgctgattttgatattttaattgtttcttgaaaccattgaaaattatgggaattgcagaatttttgttattttggctagactacattttcctccaggttgactcatctgggaataatatgcagattctttcttggactttggtttgagaaaatgtcttcacgggtatggagaaaaggatgaaaaattaagagatcctgctctaaatcaccatttaattattgggtcaaatggatgtaaatttatacttttgataaatttttgccagattgttctcatatataat

SEQ ID NO: 97155 - DNA, 2258 bp, Homo sapiens
tgtattgttatacaaaacattcatacgcctttcccaagcactctgctttcgataactgcatgcttggtattacgagagcacagactgtcaaaccagaaggtgaattccgctacataattattatctaccatattacctctctgactttctttactgtaattttcaggttcctttaaagttcggatcatgtcttattaattcttgtgccccacattcccttggatattttagatgcccacctactttgtagatttcattatttggtataaacatgctgtgtattctcggattgttagtgctaaacataagcacaaaagtgttatttgaagctatcttatattattcattctagggctcccactccattagaatattcacctatttatagatactagttaatgaaaagaccatactgagattttgaatggaatatttttttctgatttgaagtttgttttaattaggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttgtctaaatatttaatttgaacagttgtaacttttctgtattaaaaccaaaaaaacctctcaaactttactcattattgaaaaaaattattttgaactaaaacagtattattctttttaagaaaagtaataaaagtagtaaaaatttagaggcaaaaaagaatagattgaccaaagaagagaatgcatttttcttaaatggaatttgattagcttattaaggttctggttctaactcatgaaaaatgtacagttgctattcaagagtagcccaaaactttactgcctcaatattttagtaaactatggtttaaaactaaaaagagatccttctgaaacaccatttgtaataactgtattaaatctgagttttcactggagaattcctattgaagtatcaacctattaggtccaaacttatttgagataaatgttggaggctgggcacggaggcttatgcctataaatcccagcagtttgggaggccgaggtgggtggatcacctgaggtcgggagttttgaggccaaaatggccaacatggtgaaacctcgtctttactaaaatacaaaaattagctgggcgtgctggcaggcgcctgtaagcccagctacttgggaagctgaggcaggagaattgcttgaatctgagaagtggaggttgcagtgaggtgagattgcgccactgcactccagcctgagcaacagagcgagaatcccgtctcaaaaaaaaaaaaaaaagttggactttgccaagataactgttagaatgaggtgtcctaacgtaacaaaacttagctttttgatatttgtatttctcagaataatttgaaaataaagcaatatgtagcaactatgaaggacaactatttttcttctcctccaaaggtttcataggcgcaacaggaactttgggacaagtggattcttcagatgaggtgagatttaaagttcaaaactttttaaaaagtacaattttgtgcttttttatacttttttattattttatacttctttatagttctgaaactgtatagatttgtaggcattatgtagtttaagtttctcattctatagacaaggacactgaagcccataatggcttctgggaagcctagatcacacaattacttagtgagagaacgaggtgtgtaactagatttttacttcttgtttataattcatttttctttttcacagtttaaaagtgggtagaaagaggtagagatttctcctcagaggctatccccaaatttacccgtatagttgtcatatgtacaatgaaattatttttgaaaatttcgctaagtttaggataatttattaaaagactatgaaatggaactgtttttctaatcgtataataaagttacattttacatgtcagggatttttttttaaaactatgtactgggaaaaagaccatcaatttgaaatttcaatttttatagtgtttattaataataaataggaaaaatcattgttatatttctatattttattacataatttataagagaaaaattgctgttatatttgcttataatcttgttgcttattcaacttaaattttatatttctaatacatttaattaaaatctaaaaaataaaattacatttaaacatatatatcttttttcttttggaaatt

SEQ ID NO: 97156 - DNA, 1005 bp, Homo sapiens
cccggctaattttttgtatttttagtagagacggggtttttccgtgttagccaggatggtcttgatctcctgacctcgtaatctgccctggcctcccaaactgctgggtttacaggcgtgagccatggctcccagccaagagttgacttttaactttgtaaagcagaagaaaatatactgaaattttattagtattcattgtaggttaaagaacaaaatatatttttgaatttaattactaatgaggctatgaaactactgtgactcttccgctagtctctttttggggttgtgtatcctgttttaatctggtttgttttttgtttattagtggaaaacattattttattaggactaatggcctacatggaataaaaattctgttggtggctaggcatcataagcaagaagcaatgttaattgagtttgcgcgatttatttggaaagaaagataagaagttccatcaacccctttaaaaatgaatatgattattatttaaaatttgcttttacttttgttcttctcaaagtattttttaacatatattaaaatggtcaaaatgcaataattattatagaatagaatagattaaggtgaaaatagatgaagggataagatagatggaaagaggttgatagaggaagagtacttaaatatagatgttcttgaacaaataactattttatgccatttaaatattcattaaggcttttaatgtcatgttgcattttacttggaactgtaggcacaaatgacatatttgctttagtatttatatttgaaatatagtgaagagctaggtatggcttcaggattagaatttctacaccattaccttataggcccatgggattgttaagcaaacccttttcatgattttattgttgtaatttaagatatcataaaggaagataggatgagaataaatggacaatgacattttaattactactatagagtaggaattgtaacaattaaaagatattttggctgggcgcagtagc

SEQ ID NO: 97157 - DNA, 1071 bp, Homo sapiens
tatactcttacataattgagaaataatcactttgcaaaataagttactgtgtagatatgctttgaatattcttgtctttattcaagacacaatccaagtgaacaacagctttccaaaaataatagcaaaagtaggacagttgaaataaaaaatcagagatacttttcataagtgaataggtaaaagaaaaaaggctgggtgcagtggctcatgcctgtaattccagaactttgggaggccgaggtgggcgatccctaggtcaggagatcgagatcagcctggccaatatggtgaaaccccgtctctactaaaaatacaaaaattagcccagcatgatggcacgcgtttgtagtcccatcaactggggaggctgaggcaggagaatcgcttgaacccgggaggtggaggttgaagtgagccgagatcgcgccactgcaccccagcctgcgcgacagagtgagactccgtctcaaaaaaaaaaaaaaaaagttaattttacttttggaggcataaggtttaattttaatttggtatcataaattacattaatggtaagggtagggcagggaatcacataaactgttggtgggaaaggccttagaaatatttaatgtatttcttttccagtgcaggaattgattttacaacattcctgacagttggtaagcctctccataaatacttccaatcgtagggagcttacctagtttatgaggcaacttattcccttgatagctctaattattaaattcttctcaatattgtgttaaatattgtaactttcgcatatttcttgttttgccttctagaaagatttttatttccagatgacacttttaaatatttacttttagatattaatattttctgtcgcgcatagttctttcttttcactgtctagtaaactcattttcttttaaaatctatgtcctcatttagtgcacagtgatgggacatcttttgataagcataccgtgtcttcattaaggcccaaagctttttgttatttttttagcagctatcctaaattgttggcaggagccacagaggtcaaacaaaatgcccaacatt

SEQ ID NO: 97158 - DNA, 1047 bp, Homo sapiens
ggcgtgtgcctgtaatcccagctacttgggaggctgaggcaggagaattgcttgaactggggaggcggaggttgcagtgagctgagatcatgccattgcactcaggcttggggacagagcaagactccgttttgggggaaaaaaattttttttttttctttaaccatcaaaatattttgcaaatgttccaaaaaagtgaaagactacctcaccatcgagattttttttaagttatcttgggcattattataaattagtaatagctgtaaaatgttaacatgatatattgaaaatgattttaaattaaaaattaaaactaatgtgttttttcctttctattaaaatgtttacaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaaggtaactcagaattatattcactagttctattattatcagtattattattctagtattattagtgtacttcatatacttagtaatattactaataatgatacttagtattattaatcatattctagtattagtgaactttgtataactagtcttgaaaacaccttatgtttaaaaaaattataaaataatacatgtttgttacggacatctttgaaaatttccagtgaagtttaaagaaaaagttaaaagcacttgtagttttgttattcacaaatacctgttgttagcactttgctatatttcttttctttttgtgtaatgactatatttatagatacaataaatactttttaaaaagttgccatagtgtacatgtcaaaaacatgcattttaataagtgcaggtattaatatcatggctataccataatttatttagtcatttccttattagacatgtttctgc

SEQ ID NO: 97159 - DNA, 1028 bp, Homo sapiens
caacctgccataatgtttctgtacctcttcccattctcatttctctatagttactcatcttaactttacctcccttaaattctatatatatgtatatgtgtgtatatatgtatatatgtatatacacacatatataaatacatacataatttttattattattttttgagacagagtcttgctctgtaccccaggctggagtgcagtggtacgatcttggcttactgcaacctccgcctcctgggttcagttcaagcagttctgcctcagcctcctgagtagctgggataacaggtgtacatcaccatgtctggctaatttttgtatttttagtagagatggggttttgccatggtgcccaggctagtcttgaactcctgacctcaggtgatccccctgcctcagccacccagagtgctgggattacaggtatgagacaccacgcttggccaataatatatagtatttaaatatttgctatgtacctggtactgtgctgaatactatttatgtattgtttcaattaagcttctgaacaagtctctgagattggcattattattatccttgctttaaagatgagtacattgaggcttaggaaagttaagcaatttgccataggttatacagccagcaaatgacacagttaagaaggatttcctggctcctaatgtcagaactcttactattcttaaccttgacacagccagtccctgtcaaagactctttgataggatgtgtctttacttgttggcactaggagctaaactttaaaaataacaacaaacaatacttcagattaattaaatcttaggacctctccattctctgaggaggagaaatcttatagttgagccttgctttgttccactcttgcctctttgtgcatatcagctcctgttttctccttatactgataatctgtctgttctcaggtgtgacaccatgtcctgaaaattgatatgaactcagtgcaaggcataatgcgttatatataatagctagctaattatgatagctaccatctc

SEQ ID NO: 97160 - DNA, 2072 bp, Homo sapiens
atatgctttgtggttccaaacatagctcataatttttcatgtcccagaaattttagaatttatcttttgaaacagtctttgtaaagtggaatctaaaaccatgtgttgtatgacataggaatgtctgtagatgctcataatcccagactgcctttcctccctgcatatcaaactacttattgaactatattgtttggatgtctataaacacctcaaacacacagtgtccatagcgaagactcattattgctccattaatctggctgcttttacattatcttgtgtgtgtgtgtatgtacatgagcacatgaatgtgtgttttgattccactgtctaactatctaaacagctgtgcagcctaaaaacctaggagttgtctttgacttctttttattccttgcagatatagcacacattaccaactctgtccttcaaatcttctgaatatctttacatagcctcttcatcactgcatctttttgccaccaccatagttcaaaccatggccatctctaagcctcttatctctagttgttgtcactctccttcagtcactttttacattacacttcttataatgttctctctcttaaaaccccctagtggctttccattctcttcatgtgaactctaaagtcctgacgctggtttataagaccctgtagcctcatttgtaccatgcatcctctgtattctttcttcaagtgattctaaccttttcttaggtactgctccttccgcgtatagcaccatctgctccaccatcactagttttatctggttaatcctaattcctgctttattttataggcctcagtttaaacttcacttcctcaggagagtcttttttttttttttgagatggagccttgctctgtcacttaggctggagtgcagtggcacaatctcggctcactgcaacctccgcctcccgggttcaagtgattctcctgcctcagcctcctgagtagttgggattacaggtgcctgccaccacgcccagctaactttgtgtttttagtagaggtgggggttttaccatgttggcgaggctggtctcgaactcctgacttcaggtgattcgcccattttggcctcccaaagtgctgggattacaggcgtgagccaccatggccagccaagtcttttcttgaattgtagtctcgctttatttgttcttatgagtccctctacttttcccattgcagcccttatcacattctgccttcttagatgttaatctccatgaagacagagatcatctaaatcttgatttatttatcactttattctcagagattagttgaaaacttgacccttagtaggtgctcaataaatatttgttgatgagtgaatttaattttacactgaatcattgctctttatatctgtaatgaggaaagtaccagtttgagtaaaaatagaagtcctaatcattttatttcattaatgattccaaggcgttttttacaagaacagtagtatttaagcagtgtcatgaaaatagtgagtttgattaattatattctgcttattcatcctctggtttcaattatatagaacagtgattctcaatttttaacttaaaaaaaatcccaacattccttagcactgttgcatcaatatcaatggctcactagctcagaagtggaacagtagttgtcagtcatggccaggggttagtataaataatttgtaaaaagcccctagtccttacttcctcattgagttagaccctctctcgtccattgagaagtactgaaagagagtgtacttaacttcagtggaccctgttcttagatattgttaaacttatttaatatttggtaaaataattctgtggactgaaacctaagtttaatgtgtggaaattaaaaagtgcagtagaggccctcctgactgatgagtatgacaggtagataggtagttgaataagttggttaaagtgaggaatcatttaaaaaatatgagccgggtgtggtggcacatacttgtaatcccagctactgaggaggctgaggtgggaagactgcttgagcccaggagtttgagtccagcgtgggcaacatagt

SEQ ID NO: 97161 - DNA, 1678 bp, Homo sapiens
actattatttataggaaaaaatgttatttctctgtttaaattttctactgtaaaatataaaacttaaggattaagtaatttaaaaggaaacttcacttgataaattactgtctttgtatgattgcactgaatgctatttgattcttgaaaacattaagggctagttaaaaaaagtaatactacccagatagctcagtcagtagagcatcatacttttaatgctcgattaactaatgacatgaagattggataagaggatgacatgtttctagaattttactgatacttgctttctgaggagaaaaataagctgcaaaatcttcatctggtggcaactataggttactacagacttgatagaagattaatgtggtcttgactcttcagagcacttaactatttgtcagacatagtgttaacctatgatacagagcattttatgtacatcatttcacttgcctcttcagaacagtactgggaagtaggttgtattatgcttatttttacatgtggagaaactgagactcataaaatttaagtaatttgctcaaggtcataaaactagtaagttagcatgcatactgacttttttgggggttgaggggtggtagtagtgggaaaataggagagagacaatcagaacatgattattaaatatgctgtatttgtgaatggaattgacttgtcacctttttaaagagtcttagtacctacttgtcaaattgttctccagaagggtggtaccagtttacacttgcgctaagagcatgtaatggtacctcattgcccaaatgcttgatgaaataggagaactttcggttttaaaagtttatttatctgtgagttacctgctactttagtttggttgtgacagattatttatgataacttataagtgccattaatttgttttcaatgagaggtatggaatagaatgtatcaaatactattttataaagacaaatctcatatagcatagattaaaacaggatgagaatgttagtaaggtgaccaggtaagtgatttcggtctggattgtggcaatggaaataagcatgaagctatattataatatcaagcaagaattgacaggacatggagatgagtaaggtgaaggagaagtcaagaatgaatgtgagactttcagctttttaaaaaggcatatttatataatttacataggtagctgatgagtttaactcacgtggatttgatgctttctgcacttacacattatacgtgatgccccaaaatatctgtttttaacttaaaaaaggagataaaattcaccatttaaccattttaaagtgtatactattcagtggtttatagtgtattcacaaagtttaccactactaccactatctaattccagagtatttccatcacccccaaaagaaattgcatacctcccaattccaacctcccctcatctcttggaaaccactaatcttctttcaacctttataaatctacctagtttggacatttcatataaatggaatcctataatatgtggccttttgtgtctgacttctttcactcaatgtaatgttttcaaggttcagctgtgttgtagcatgtatcagtacttcattcctttgtctggctaatatttcattgtatggatatacaacatttcatttgtcctttaatcaattgatagatatttgggttg

SEQ ID NO: 97162 - DNA, 10718 bp, Homo sapiens
atgtccaatacttttttgtcagccccaaagaaactctgtacccattaaacaatgacattagggaatttataataaattggggggggtgtctcttgaaatggagtctgatttaaatctatttaaaatctatttctgctttcattcatttttagaaatgtattgtaaaaaaggaagcgtattgacttacttaattttcatatttgtcactggttgtttatgaagggagagtttcttgaaatggcaaatataatcttaaaatctatacattttaccattttatatatacacaatgcatataattacatataatttaatgttgaaaatatatgtttatatatcataaatttattatatataacttactattttaggaaactcaagagtatacccgaaatgttgttagatattgccttgaagctcttcaagactggtttgatgctattaacttcgtagacgaggtatgtatatttttgatgtatgtaaattttttgatgtatgtaaagacatttaagaaaagtgttagatttcatttaatgttgaaaataatgaatactttttcataggcgagggaaggaagtaatgaacatattattaggctttgaaaaagaaatctaaaggggagactagttctttagttctttgacatttaggagattctggagcgcactaatatgtctgcttatttcctacagaagagtggcatgatttgtttttccattattaagtatatgtgtctcattatttctcagggtgaaatagtttcagttgaatatataaaagtgacaatgcaaatgtgaataggataggggagattaatgaaaagggtatcatacaactctattaattggacagtgttctgtttgtcagagtaggaaaagatggacttgaacaaaggtgattagtgttaataatgagaagagctggcacaggacatggtatgtatgaattgaacaagtaattgcttttattcgttggccaagtttaccatcagaagctccttttattcctcctatgaagtagggtcagaatatgccatatgcaaaagaaagaccatgtttcagacagctcacccccactttatctgatttctgaacctgggcacacagaaccgttgctgtgtgtttgtgtgtatatgtggagggcaggcaaattttatctcttgtgtgtgtgtgtgtgtgtgtgtgttttttttcctttctgtttaaaaaatttttgacacaatcacaaatttattgaaaagttgagtggacaaagaactttctattcttgaacgatttgagagttcagttgttgacttgatgcctcactacccccatgcatttcagtgtttcctacaaacaaggatattttcttatatagccagaatgcaactataaaaatcattaatatattattaacatttaattcttataactcattcatgttttaccagttgtcccatgataccttttatagaaaaaggatctggttcagaattgcattttgttatcatgtctctaatctccttctgggacattttcccagtctttctttgcattttaggacagtgacttttttttttttgagacagagtctcactctgttccccaggctggagtgcagtggcacaatcttggctcactgcaacctctgcctcccaggttcaaacaattctcctgtctcagcctcccgagtagctgggattacaggtatgtgccaccgcacccagctgatttttttgtatttttagtagggacggagtttcaccatgttggccaggctggcctggaactcctgacctcaggtgattcacccgcctcagcctcccaaagtgctgggattaccagtgtgagccactgctcctggccaggacagtgacattttgaagaatgcctctcaatttgggtttgtttcatgattagattcagattatgtatctttttcaggaatattatggaagtgatgtagtcttttcattgcatcctatctggtagtttgtgatttgtgttctttactaatgatgttccctttgatcacttgattagggtggtacctgctagactccttcatcataaaattaccctttttctcatttaattaataaagtattttgtgatccagttttcaattcattcatttatttttgtctctagagattcatagtttctattttattcaatgggttataagctattgctgttactatttgatgctcagattatttcagatttggccaatgagagcccctttaagcttagtttctgcttgtcccatcattttttgagaacttccatgttttctggcccatcaggatgtttcagactcatagtttccccacccatttctggaatcaatcatttctttatggatccctggttacttttagtgtggaacagtatttagaaaaatctaggtgctgcttgtgctcattgctattggggtatcactgctcccaggacttcacagtgaacagaggagtatatgtacataagtacatatacatatttgcatctatatttttctgtctatagtgaaagctgtgagttcaaactgatatttttaattccagtttaacactgtaggagttattctagttttcttcaacagtgggaaacctggcttccattatctttaatatatttacttatctataaatacatatttatgtatgaccaatctcatatataaatatgagaagcaactctcatctcagttgcctctctttcccctgcatggatgccctcttttctctgctttgactctgagtcctcatcctattcccccttttcccacacgtggacaccctcctcatcctgcctgggctctgacccccactttggactgcccttctgtggagaagccctgttcaccctcttcgtgcttgaaactcccgcaccagactcctcctctttttggatgccctcctcattctgccttggctctgatgcctcctgctctttgcacatgtggataatctccttacccagcttggattttgattccctattccaggctggccccctgtattgttgccctccttacctcagtcaggctttgattccccatgccaggtcagtccccatttggaggccctcctcacccagattggctctgatgctctacactggtctgccctgctgtgtgggtcccctctgactctgtccacatctgatgccctatgctaggccacaccccctatgcctgagcaacccccaacatctcaacccctcaattaccccagcagttgccctcctcagtctgagctctgacttccctctcagtttcctaacctttagatgcttatttttaccctgctccctctctttacctcccagtggctttaggaatggtttaggaagggaagaaccctttgttatctttaattctaatccctcctgccctgaattaatttttctttacccctcattacccctcccccaacatttgtgtcagctcttagccttcaacctagattttgtacatttggattttgattctgccctgaccaactcaccttgattctttgccttgtctaattgttggtctttaggcttaaattttgtttatgcaaatggtaatgagtcagtcttcagagagaacattgtccagccttcacggagcaccatcccacttccaacctgcttccctccttcttcaccctgtccagggtcagtccctcagctggagctttaactgaagcttttctcaatccagttttctttggtatttgaaacttcaggaattattgttgaaatagtagcatcagtaagacaacagtaagattgaactgggagaaaattatacacaagaaaatgatatttaaattaatcatgcttggaatcatgagtgtagtgaaggacagttagaatcatgtatgacatacagagcagctgaactctaggaaatagtgtatctgtttttcacacagaaatatttttaggaagatattgaatgttatcaaaaatttaaatggattcttaaaagaagagaaattaagtatagaacttaaagaatcaaataatatgttatttatttatttattatttttttcgagatggagtttttgctcttgttgcccaggctggggtgcaatgacacaatcttggctcactgcaacctccacctcctgggttcaagcgattctcctgcctcagtctcctgagtaactgggactacaggcgtgtgccaccacacccagctaatttttgtatttttagtagagatggggtttcaccatgtcagccaggctggtctcgaacttttgacctcaggtgatccacccacctcggcctcccaaagttctgggatgacaggcacgagccactgtgctgggtccatgtcatgtttttatatggtgcttaaaggttttattattcctcctttttttgtcattgggaagtggagatgcagagatattaaatgacttgcctattgttatgtagcaagttatggtacttctgggtccacagtcctcattttggaactccttgtctggtaatgttttaactgtattggttgttggcagtggaaagagctttaacgtaggcagatctgagtgtaaattgtggctctgccataattcaactagctatgtggccttggacagatttttttaagtttaattgttaatatatttttactttttttttttttttaacactgctgagcctatttcctcatctattgaaggtgataatattaaccagtgaggattgactaagaggcacatattacatgtgtgataaacattagttcttcttccatccttgtgggtggatgtcagaagttattatggtaatctagtacaaatcaagcaaataatttttttttttttttttaagacagggtctcgccatcttgcccaggctggtcttgaacacttgggctcaggtgattctcctgcctgggcctcccaaagtgttgagattacaggtgtgagccattgtgcctggccaataatatgttttgaactgaagtaagccagatcaaacaatcatatagaaacaggagatggaatacattttcctataagataggccatttaagagttcttaaaaacatgaatatcatgtagggcaacaattgtgagtttgtagcagggtgggtttggctagagtcctctggtaagaggaaagtagaacgtgcattcatccagcaaatatttattgaatgtttactatgttgtaaacataggggatacagtgataaaacagtccctgacttaaggaagtggaaaacaagtatatggttaatttgattcctgtgcttctgtaaagttgtgaccaggtgctatgtgggaccataaaagggagcacctgatttagcctgaagaacccaagaaaagcttcttagtagaagtgtcaactgagcaaagtcttaaagatacagtaatccagtgggagaagggatatatagcatttgcggcagggggaatagtgtatacaaaggcacagaagcttagtaagttagggatactacctatggtgcatgaatttatgtgacagaagatgaggctggagaggtaagctctttcttcttaggaattggaaggttatcaggaggctaaaaccatagggagtcattaaaagattgtgagtggaagaagttcaaggttaaattaatgtttaagtaagactaccttctggcagcatatagagggtaataggagatatgttagtcaaggttcttttaatgcaaggggaaaaaataatttaaagcagcctgagttaaagaagcagtaatttcatgtctaaaacaccaaaagcaatggcaacaaaagccaaaattgacaaatgggatctaattaaactaaagagcttctggacagcagaagaaactacgatcagagtgaacaggcaacctacagaatgggagaaaatttttgcagtctactcatctgacaaaggttcatccagaatctacaatgaacttaaacaaacttacaagaaaaaagcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaattagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccatgactgggtatatacccaaagggttataaatcatgcctctataaagacacatgcacacgtatgtttatagcggcactattcacaatagcaaagacttggaaccaacccaaatgtccaacaatgatagagtggattaagaaaacgtggcagatatacgccatggaatatgtgtatattccagccataaaaaatgatgagttcatgtcctttgtagggacatggatgaagctagaaaccatcattctcagcaaactattgcaaggacaaaaaaccaaacaccgcatgttctcactcataggtgggaattgaacaatgagaacacacggacacaggaaggggaacgtcacacaccagggcctgttgtggggtggagggaggggagagggacagcattaggagatatacctaatgttaaatgaagagttaatgggtgcagcacaccaacatggcacatgtatacatatgtaacaaacctgcacattgtgcacatgtaccctaaaacttaaagtataataataaagtaaaagcagtaatttattatgaatacatagggatgtctcagggttagggcacctggacctcagggatggactggaaatctgaataggaactcctgtcgcctgcctttgctttgccctgagtgtatgtgcctcattttttcttcccttcctgtgctttgcctatgtggtgaaatactgcctttttatagttgcctaacgttaccatttcaggcatactcccagattgtctgtgaatgtctctgaatcctagttcaaattttttaagagagaaagtcattgctcaagcgggggtagatgtcccctgccctgcctccagtcaagtatggctactataaacttgactgtcaggccccaatctctgtgtgtggttgaggtggcagagagtgggagagggagacacattctgagaagatgggaaggttgtgagctaggcagacaccacaaaaggtgttttatgcaggataatggtagaagtaggggttatcactaaaatctaggcactaggtgttgagggcctgagctaaggttagttaggtgcagtgtagacagaaagaagaaagtggatttaagagatacttaaaaaataagtaaacataatttgatacctcatcaaatataggaggcttgtgagaaggaggaagtctacatttcatatttaaattactgggaatctggagaagaaatattgaggaggattgagttttatggcaaagatactgagtttggtttggacacgctgtatttgtggtcctatggaatattaagtattgctgttcagtagacacctgaatgtaagatttggagttcaggagtgagatttccactgagatttggaactcatctgggtagagttagcagctgaagctgtgaatctggataaattcacatagaagactatagagtgaagaatggaatccaaggactctcagtatatataggaatagaagaagtgcttatcaagtagccagtctgtgacattagacaaggaaggaatatggactttaacgttatggagaatgtgaacataggatatgctaaagccctgaaagataaaatagggtccatggcttactagttaatagcaatatgtactgggtactgtgctgttttacttatttctcgcagctactaaactctttattattcctactttaaggatcagacaacttaggcacagagaggtaacttgcccatagttttacagctgggtggtagaaccaggattctgcacttaggaagcaggcacagtggttcacgcctttggtcccagcactttgggaggccgaggcaggtggatcacttgaggtcaggtgtttgagaccagcctgggcaacatggtgaaaccctgtctctactaaaaatacaaaaattagccggtgtggtaatacatgcctgtagtcccagctactcaggaggctgaggcaggagaattgcttgaacccgggaggcagaggttgcagtgagctgagatcgcgccaccgtactccagtctgggggacagtgcgagactcaaaaaaagggtctgcacctaggctgggcctggtggttcacgtctataattccaatcctttgggaggctgaggcgggcagattgcatgagcccaggagttcgagagcagtctgggcaacatggcaaaaaccctgtctctaccaaaaacagaaattagccaggcatggtggtgtgtgtctgtagtcccagctgctcagggggccgaggagggaggatgacttgagcccgggaggtggaggttgcagcgaactgtgatcgtgccaccatactccaccctgggccacagagtgagaccctgtctatttaaaaaaaaaaaaaaaaaaagagtctgcacttatccactgtgcttagtgcctcaaaggaaattgagggagattctgacttagctagttagtgtagaatatgttactaaggcgattatggtaatggagggcaaactttttaaaattttatttttaattgtggtaaaatacacagaaaacataaaattcactatcttaatcatttttaagtgtatagttcagtagtgttatgtgtatttgtattgtcgtgcagccaatctccataacttttttatctcataaaattgaaactatactcattaaatagctactccccatttcctcttcccccagcttctggcaaccaccattctactttgtatctctacgaatttggctgctctaagaacctcatataggtggaatcatatagttactgtctttttgtgactggcttattttacttagcataatatcccgaaggtttattcatgttacagaacattgttagactttcctttctttttatggagggcaaacttttatttattagaacaaatttttatagcctttacatattgaagaggatattattatcttactggttttgaaaaaaataattatttcagggatggtgacatatttagactccttataacctctataatgtaaattatatacattagcataattatctgaatgtccgggataaacatttttaacaagagaatatttaataagaacttaaaaagcattaaaaacaaacaataccttttcagttcttaactcatttgtttaagaaggacagctgtggtgtatttttgccctgtagtgattttgtgatccatgggattcacagatttaaaatacagtttttgtaatatttacaggaatgcctaaggtcattcacatattttttatgaagttttgttatggaggctggtgcgtttggtactgtttggaagcatcttatctaactggtgaaggaatctaacgatgccctgcatttatacctctgtttagggatgtggtcagagtcttcttacagttttgaatatgacagtggagtccagattagctccccagttcactacttttgaactttaggaagttagttaagttttctaagtttgaattttgctacttgtagaatgagaatattagtagctcctaccccatagcattcttctgaggattaaatgtggtaatgtgaataaagtgcttagcatggtgactggcacataggaagtgttcaatgaatgttatatgtgactgttattactgtcatgatgtttggtatacatgcgtttgaagagtcccaaatggtctactgtagctggaaatccattccatcccttgttttaataataattatttgctttagctgaattgaatttaggaaatattaatctgtactggatgcttcagaggattcaaagttgagtagaatacaatttctgccttcaagaaacttatacttaagtgtttaaaatggaaaaattttatctatagtgattttggaatctgcatcttctaaaatgttaagttttgaactaaaagtataggaataaatccaggtgagagtatggtttaaacattttacaaccatcttaaaatttctataaaatagtctttgacttgtgcattttgtttgtttattccagccagcacctaaccaagtcacttttcatctgccactacatcgttactatgctatgtttttgagtaaggtaagactgtcattaaacaattctgttcttttttttttaattttcagaaataagaattgaattagtaacttttttattgtaatttttaggctgtgaaatgtcaagaactagatttggattctgttttaccagatcaggaaatgttaatgaaactaatgattcacccactccaaattcaagtatgtattcaggcatttaaaaagttttgaagtggattccttgtttaagtgattcttcctttatttatatgcctttcattgttattatagctgagatgtttgaaaactttttttaaaaagttgttattgtatttttgctagattatgtttaggtatttttcattttatgagatttactttttagttttactttttccaggaattcttttcatgatatttgcttatggggtggt

SEQ ID NO: 97163 - DNA, 2791 bp, Homo sapiens
cgtcgaaaccctgtctctactaaaaatacaaaaattaggcaggtgtggtggcacacacctgtaaatcccagctactcgggagactgggggatgagaattgcttgagcctgggaggcagaggtggaggttgcagtgagctgaggttgcaccagcttgggtgagagtgagactctgtctcaaaaacaaaaaacaaaaaacaaaaaacaaaaaaaagtatagaaaaacatgattaatagaagaaggaaaactgaatattgagaaataaagcattttgttttcttttaaaggtttgtgcttctagacttgacccagattattttatttcatccgtctttgaaaggtaggcataattttattaagacaggtattaggaagtgtccagttaattttgttttaatttataaaaatatgtttcaaatatttcttcttgtagatttaaggtagtggatttgttgacaatggcatcacaacatcaaaatacagtacttgatgcagagcatgagaggtcgatgttagaaggcgctcttacatttcttgtgattcttttgagtcttcgtttacatttaggtaaaactcactgatactaatacttatgcattaactgttttcctccctttctccccctccctgtggtagtaactggcttagggaaaaaaggaaaggatgtagataaatgtaaacaatgtttcaaactcttgatatgttgtactgtaggtataccttttagaatatcctttgcttaagggaactgcaaacagcagttaaactgcagttatgtttggagcatagcttctttactctttaatttgaagcatcttatatttggtaaaacagcttagtaaaaagtgtggtaagtttttttctttataatttatgtatactcagatttgttaattccgtttttaataattttaggaatgtctgatgatgagattctcagggccgagatggtagcccagctgtgtatgaatgacaggacacacagttcattgctggacctcatatccttttaaaattttactttctgttagttgcaggatctaaaataagtattttttatgattaatagtttatcaattttttgattaattttttttcaaagttgaaaaataatatagaaaaagaagaacaccagttgtgtgctcaagtatgtattcaagcctggtgactgtttttttttttttttaacctcctgttattacctcttggggaactcttcttagactttagggtagatttcaggactgaatgatggctttggccaccccagcatttaacctcctagtggacagcattactgaacgttttataaaaggcagctaggtccattttgtctgtgtagccaggatgcaattcatggttaacagttaaaggtataccttacgattattattaccaggattttaaacattttgagggtttttctgtagaatttggtcttaaaggatttttgaatttatagatttttgtgtacaaacagggaacctgtggttctttgtataggactgaacatacaatgagaatctgattatctttttaagttaatgttaataaaattttacacaaagattatcaagtaattttgtgataaaaattctggccgaatttagtatttgtatatcttatgactatgtttggaagaattggctaaactttttattttgtgaaataagtcctattagaatgcctgtttgacaaccttgatttttgtaagcagcctcaatttgatactgtctgatgatttccttcagtcattatgaactatgtgtcagtgctattatagagtaaaaacgatctctgtgtctttcaattttaaagatttatgtgctttaatgtgaggagagaatctttttggtttgcctctttgcttatatttgcttagtatttttttctttggggatgaaattttgtgtttttggaaaaacaatctttgctcataaaaatcttggctaatttttcacaagttctttctgttttttaaggaaaagttatttacaaaatggtaaaaatgaagacacatttttaaaagtttttctatcgttttctgaaatttgataaatttatttcggggaaaatatacctgggaactactgcagcatacaatttattagtaggctcctagattaaacatattttcaaaaatcacaattaaaaacagttattattgatctgttgtattatatagccctcttgtggccagctttgtatattacaaccaattactatttgtctacttcagcaaaatgagaaactagagtaccttggaaaggctataaatctggctttttgttactaatatttttttcttgacatatatatcatattccagaaaatcctaatcccaaaagtggcattattccaggcagttacagctttgaatcagttttatcagctgtagctgattttaaggctcctgtttttgaacctggaggttctatgcaacaaggcatgtatactcccaaaggtatgtttatatacataaatggactctttcaaatatcagttcttgaatggtgaattcttctgtgtattaaaagaaaatgtttaccttttattcgttcaagctttggttttcttttctccattttgttataaatgtatgtctttattggtaaacagtgatactgctttcaattacttagaaatctatagctttatgttacactaagacttcttagatgactctaaactataaaggaaatttatatttgaactctaattcatttttataagtgatcataaccataaatgaaccagaaactataaaacaaaatgtatattaaaaaatatt

SEQ ID NO: 97164 - DNA, 1023 bp, Homo sapiens
tgatactttaagatgaatagcttgttacatgaaactagggacagtggttaacaatggttaacagtgtcttgtgctagaaggttgtaattatagtggatggttagggagaagcttaagcttcttaccatgttttcaaatgttaagaattttgctagagagaatgagagaaaaaaatctattaaggagatactcttaaggcggtggtttctaaaattattatctcagtttatcctttagatttttgccacatctaaatagcctctctactgaaatatacttagtatttcactattttttaaaatgagttaacttaaaaaaaaccttgcctcttcctaagcgtgattattagtgaggtgtcatgaattttatttgcaagttacaattttctaatatacattatacacattaaaaataattacataattattaaaatgaaaagctttatatacttaatacttaaaatcatcttgtgaaccatcagttgtacacattccacacacaagatagtggttcctaattatgcagaaggtaagaagacaaattatcagttttagcaaaggagcagaaaatcttttataaacaaaaaagacttataaagtgggtctcttcaaaatcaatagctcattaatttttttttttttttcttggagactgagtctcactctgttgcccaggctggtgtgcagtggcgtgatcttggctcactgcaaccttcgcctcctgggttcaagtgtttctcctgcctcagccacccgagtagctgggattacaggtgtgcgccaccacgcctggttaatttttgtatttttagtagagacggggtttcaccatgatggccaggcttgtctcaaactactgacctcaagtgatctgcccacctcagctgcccaaagtgctgggattacaggcatgagccaccgtgtccagcctcattaatctttaaatctagttttcatgtttttacttttaagtactttttttgtttaatactttttttgggaaatgaggtctgtctttgttgcc

SEQ ID NO: 97165 - DNA, 1057 bp, Homo sapiens
tgtgagctcaaatacgcattcaaaagattacatttatattttatccagcttttccaaccattcgtagtgggagaattttcaggtcgtctattttgcttaatcgttacagctggaaatttccttgctgagtacttcatgtgtattctttctgttcatttctctttgttagcactttaaagtttatatattttttaattttcagcttagctctctttactcatctttagccattaggaaaagaaatagtaatgttcattgtgtagagaatagatacctctttggcattttaagcaatttgattaaaaatagcactgcataaaatattgtgacagaaattggtgtctataaattacatttaaaccacagtttgattttgaggctatcatctaattctagttttgttttatttttacagtttaaaacagagtggaaaatttcctggaaatccctggcctccatataagaaaaggacatcactccatcctagctataaaggtcttatgagacttttgcactgtaaaactttacacattgtgctattcactctgctttacaaggtacagtagtaatttgaatagaaagactaagcttagaatttattttcaaataataatcctaaaggataatatttacataaaagtaccacttataaagcaaagtgtatttatgcatttaagatgtatgaagatatgttataatcacatgtatttgaaatccaagttgaacataacagaatagctacagcattctttgtgagaaactatttatcttatctagctaccgataaaagtatttatttatggattctgtagaacagtaagtgaaataccgtggaactacaggaggtgtggaatgagctacagggaccaaacaaccatcagaacccactaaaatgacaaaactagaatggcagttatgtgaggcagtgaatcttaggttggggggttctttttgctttttccctctaatcaggaaagtgacgtggaaggatttgagtgtggtttctatgtggcaagatcaaaaattgtttttgataaacattttaggaactaacaag

SEQ ID NO: 97166 - DNA, 1035 bp, Homo sapiens
gctctttttctttattaaaaaatgtagaatatctttttgtactgaaaagatatttgtatttgttttacaaataatggacagtctttgaatgtttacttagtgccagattttgtttgaaatgctttatatatacttgtagacattattttgtttaagctagcaaaaatccttataagtgaaagttctgttattattctcctttttcagatatgaaattgagttttagaagttaaataactagttcagatggggaagctaagtactgttataagtaataattaataagtgacaagtaattcatgaaaaattaaggaagccttatggcaaattatttattatgctctttcaagttatatttttcaattttttgtatgctaaatgtacaaatagtattttatgaaaaataaaaagacaatgttttagttgttacaagactattataaatgaatttttctcaactttaaaataactttcttgattttactactagtaataataaagttctccattgacattgcgttggcaagtcaactttttaaaaatcaattttagtaaaccacctttatcttctgacatgtttaatgtcaaaataaaactccctggaaacatcatttttatttcttttttttttttgaagtacctaatagagggatgttttcctctttagctctgaagttactcaattaaagctgtaatcccacaagctgtgaagtgaaaatttaattgaatttagctggtaatgttttatttatcaagaggagatagtatagtaatgatagtcagtggcctgggggtctgaggtctgtgttctagtgttgcttacactagctagctggttgtgtggctgagccttggttttctctccataacatagtggatcagaaaggatgacttctgtggtctcccagccttcagtctcctcctgctgctgcctctgctcctcacatcattggcaccacccactcactatttgttgaacacccattgctagacactatacaaagcaaatgacagatattaactcatgcaatcctt

SEQ ID NO: 97167 - DNA, 1104 bp, Homo sapiens
ttcctcagagaagcctttttactaaccacttgcattccttctacctttctcctccatataaatcccacactgacatacataagaatgtagctactcaaaatactcagaggctcagaactttaattttagagacatatttttaagaacattaatgtaccataaacatttattgtgctgccagttatatgccaggtgctgtgctaaacacatttgcatggattatcctatttggtaaacttatttatctgatggccttgtcatcaagagaagagtgtcagcaaattaggatataaaaatattcttattaaattattttattaaatacttatattcgtatgaatttttttagtggactctgacatacctttagaaaatttgtgaactggtatttctagatattaaagtacttttcgtctagaacagtaaaatatttttggatctctaaatgaaataccttttgtggaaaaaagtaattatgaggcattttcttccctttttaaagattttgatggatcatcaaaatctgtcagaacatgtactctgcatggttttatatctgattgaattaggacttgaaaattctgctgaagaagaatcagatgaagaggtaagtagtttttataatttaaaatttttagataggcagcccctatctggctccaaccaattgttgccaaaccaggcatgttatacttttcctagttatgacataccttaggaaaatgtatttgtgaattcatcttgaggtgtatttatgttttcatcagactcataagatcttttaaagaactactagaaaaggccctttgggatcttcaaatacgtacagttttttagggccttcattgatacattaaattctattatggaattattgaatttgaaatttgtaattcctatcacaaaaattaagaaaaatgtttaatgcatttttggtgttatgctaagaaaattgattattggcaaacaattaccagtaatcaataaataaccagtaaaactgaagttaggacttagctccaaaaattctaataatttgattagggattatttttgagtaacaaattcttcctgtaaaggtttgaaggtaatggcatgaatatt

SEQ ID NO: 97168 - DNA, 1437 bp, Homo sapiens
tttatgttagaattttcaaactttaaagttccttaaaagtgaaattaattactagttcagatttattagcttagaaaatttttttaaaaactaatttataattttcttaactggaaactttagcagtcttccagaagttagtaaggagtatcctattcttcatgaatgttgaccagaacagcttttcctcttttaaagtaatgaataatttagtttatgattctctttaatatggctgtagatactacttaagctttgtctgttttcagaaggttgaaaaggagatgttactgctgatgatctcctccttattactgtttctagattgagtgggattaaatatatttgagagagaggtcaagggagaaatttatttaaagagcaaatctattgaataaatctttgtatgaaactgagcattccctttagaaaatatagtactaatatgtttttaaaatgatgctaaataacttctcttgatttttctttgtttctctttgttaatggtagaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggtaatttttatttttaatgttttaaacgtgtgtatagttgaaaatttgatattttcttccttttggtcatttgaggataatcacctggatgtttaacaggaacagtcatagctgattagtttgtaacataaatggaatggagcatagtcagtgcttgtacatgtgatgtattgagtttattgatggacaggtgagactttctgaccccaatgtaaaattactaccttaaacctgtgtgtctctttggaaaaattgctactgcttttattgctgtagggatctaataattctcttactgttaaagttgaactgttcagctttaaatgagaatattaaaaatatttaaaatatttctcaaaataaaaatccaactgctttagtttcttttggtcttttctaatctttattaatatatgattgctgatttttaaaaagtgatgttttaaaacacattctgactaactta

SEQ ID NO: 97169 - DNA, 1180 bp, Homo sapiens
atgacgagttaatgggtgcagcacaccaacatggcacatgtatacatatgtaagaaacctgtacattgtgcacatgtaccctagaacttaaagtataataaaataaaattagccgttaagctacaaaaagaaaaaaaatattctttggaagtagataaggcatacataataaatataatatagtgaattaatccaagggaatatttagggctttgtaatacagttttattcttatgttgtgtttgagactccttcacattcttttactttatacaaaataaaccaaacttgaaatatgtcctagtagaaacggggaaacttactggcttctgttcattctctgttaggagaggcctattcttagggtaacagtaaatatgactattcctatcttttagactttgtttatatctaaacatcatagcttcttctagcaatcagtttactgttatttgtgcctgggattaaattgttagtctcttgctaaaaaaatatgttcttggtcttgctaccttctgacgtatacttaggaacttgtgttattggaaatccaaatattctatctaccttaattattatttcacattttaaagtacatcttggcttttatttttatctattaaaccagtgagtttgtaaccttttaaaattagtagaatccttttaaggacaatcaagtattagaagaaatttaatacataatacagaaaatagattgttctcacctgtgtgccaggggcttttcatacattatatactcctgaaatatagtagctaggtcttaagcgcatctgatacttaaaactttatttctgtttaatctaggcgacagaaggctagagagaggcagcagaaattgcttgcggagtttgcttcacgacagaaaagctttatggaaactgcaatggatgttggtaagtcaaaattattagtttagaactctcataattatacttattactttagggatgatgtagtccagtcttttactaatttaaaacattacacacttttgatttctagtgtttatttggtccttaaacaatatagtgatggaagatcagacttttattatagacttttattatattctgttgttagtagctgtaattgttaggaagttcttcctgatggtagcaatatagtatgctccttttgttctcttctgttaaacggtctt

SEQ ID NO: 97170 - DNA, 2004 bp, Homo sapiens
gaggtcgggagttcgagaccagcctgaccaacatggagaaaccctgtctctactaaaaatacaaaattagctggatgtggtggcacatgcctgtaatcccagctacttggaaggctgaggcaggagaatcacttgaacccgggaggcggaggttgtggtgagccgagattgcgccatcgcactccagcctgggcaacaagagtgaaacttaatctcaaaaaaaaaaacctcaaaaaacaaaacaaaaaaaaaacaaatttggaaaggatatatagtttgcttatatagtctgggtcccttctttattgtatattatattaagaccttgtaaatattaaggcatgtttttgggttattcttgtgactagatttgtactttataaagctgtatggaggttacatcatggagagaacaaatttgagttaaggagacgagttaagaaactgtttaagaaccacttctcccactccgtgggatatagacttgaatattatgtactggaaatgaagaggaaagaccaaaatcatgaattatttaggagacagaatccatatgatttgggaactgatattgtggtatgaaggtaagagtgtgatatagaatgactcttggctttctgacttggtgactaaatagattgtggagttattgaaccaagaggagggagatgattcatggagaagataacaatttacgtttttggcacattgattttatattgtctgtgggacattaaactggagatttctgagtggcatgagtacttgtatctaatggtcaggcaagagatctaagtttgcagggtagtcaaaattactgcttaaatcactaggaaaaatagttttaatgagaagagacttgcactgagaatagaaccttgaggattagaggaatagacattgaaggggtaagcaaagaaaaaaagatccttagaaggaaggctgagaaaaacagttaaagaggcaggaacgaaaccgagagagtagcattaaaccagaggaaagtaggcgtttcaagaagtaagttgttaatgtcagaaatcatagagagattcagtaccatactttatctcagcaacagtatagttcatactgaactatagtgtaatattgagagcatatattttatggagcggacaaaggctagttcataatatttattctctttcattatgagtatagaagtttgggagctacaacttcatggtattccaattttaaagatagtgcctgaagactatctagtcaggcattaattgatatcacaagaatagaaactccacattaatataaaaataggaaatcatgcagaggtttatgtggacatactaatatttaaatatgtttgtacttctttaaaattaattgtatttgtcttctttttattttgaagagttcatgtctcttggcagtatcaattggctgggaaggaggtgtttatgtacaaacctgtggtcacacattacatatagattgtcataaatcttacatggaatcattacgggtaagttgattgcaaaaattttttaaaggtgcatgtatctttccaggtattaaatctttttatagtatatacatcccaattccagctcatctttttaggtgattttgatcatcgtataaactatccagtctcactttaacacagacctgttcaacttcaaggattttcattttttaatttcagtttcattttagcaactagccagacgcagtggttcatgcctgtaatcccagcactgtgggaggccgagatgggcagatcacttgaggtcaggagttcgagaccagcctggccaacgtggccacctggccaacctggcaaaaccctgtctctactaaaaatacaaaaattagccgagcatggtggtgtgcacctgtaatcccagctacttgggaggctgaggcaggagaatcacttgactctgtgaggcagaggttgcagtgagctgaggttgcaccactgcactccagcctgggcaacagagagagactccatctcaa

SEQ ID NO: 97171 - DNA, 1099 bp, Homo sapiens
caatcagttgtatttagcagttagaccccttagaagtcactttttttgaggcttatttactcttaaaagctatttatcctagatcaaagaacatgagcattgggataatcttcccagtagtcagttacagattatgaaaacaggggtatggggtaagaggagggcaacccactttaatgtggcctgttttttgaattattctttatcttaaatccacatttcagattaattgcaccatcacttgaaagtttcatattgagagaagagtaagatacttaaacagtgtattggtgagggcaagtgttacgtaattgctatgatgtaagaagtgatttggtgaactttaacagttaaatgaaggattttgtttatttctttatgacatatattagagatgtcttttttctatggtttattaatttactataaaatgggtggtataatttttgttttctatgaatgtgtatatcacgcatctgtatgtttatttcgtcttttagaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagtgtaaggcataaatatcctggttaactcagctctgattttctgctttcattttaattcagtttataaattactctggacttttacatatttagtagaaattgcttttagaggttttgttctcttctatttatacttaaataaaagtaatagaacaaattattatcaaaggctatacttctctttaggctaaattctgagttttaatatacgtcttctaggtcaagaacccctataggtttagatggagttagcctcttttaagatgttcaaataggccaggcacggtggctcacacctgtaatcccagcactttgggaggctgaggtggacagataacttaaggtcaggagtttgagaccagcctggccaacatggcaaaaccccgt

SEQ ID NO: 97172 - DNA, 1175 bp, Homo sapiens
gacttgaggtcaatacagcaagtctgtggcagagtaggatctcttgagtcaaggtttactgtttttttcaattgctatcttcctttttcctctcctatgtttagcttttataggttctattatgtatatagttgatcatggctattctctctggtccactcctggaacagagggtaacaaaagagtaaatgaactatacatagcctttggaacccaggagaaatggaaccagatttagaataattgcagcaagcaaattagagctcaagataaggaacattagttggtctgagaatgcaaatactggacatgggttgatgtaaaaggatttaatggattggaaagtaactttgtagtctatatattcctagcctcttgtttatctagaatgtttttggggaagacataacatttagtattttgtttctggagagttactagttactacattcttgcaataaaagacactatgtgaaaacaaaacaatataatttaactttgccagggtgccaaggttttacagaacttccatatgatattgtgattataacattgtagacgattgggttgaatatggatcaactcagttctgttatacatatttatacacaatcacagacctacacacatttatgttgctcatttatttatgcctttaattttattagagttgaccttttaagaaaatctttattgaatgggaataatctgtcattggaattttcctgtagtatgataaatcaaacaatttgatttaaatataatttagtggaagttttagatccttatttcttggtttaagtttgtaagtaacttacagaaaaaagcttgcagtgatagtgggagaccttctggatcaagacattttggtttctctattttttagagaagcagggacagatgtcgaatgctttactaaggtgtaaacggagaaacagagaaaatatacttcccccatccttttctgaaacttaataaattctaaagcagcaaaacaataattctgaaaatgagtgtatataacactttaaaactttattatcttttgcttggaattccccaaaatattgcaaagctcttccagtgaggcggcattccttctctaagttttacttagtcattacaaagaaaacaaaggctgggcatggtggctcacaccataatctcagaacttg

SEQ ID NO: 97173 - DNA, 1004 bp, Homo sapiens
ccttgagctacaagaaatgagaggtcaaggctatagtgagctgtgattgagcgactgcacttcagcttgggcaacagagcaaaaccctgtctaaagaaataaaaaataagataaacaaattgactcagaaattaacaacatatattgaaggaaaaaagtatgttgtatttaaatacattgtaattttctcaaaacaggaaaccaggccttttatgcataacatataacttatttatgcataacatataacattcctaaaaggtgaacattaaaatatttagcaatatttaaatatttaagtagaatatttagcaataaacttactttgaattaagttttgaattaaatgtagtgatttttaaatgtataattcattagaacttgcacatttatttgtatttagtattagtaacgtgagtggaatacaaccctcatttcttagagctggatttctccctgctgaataagtaattttgtttgctcttcagagggtttgaattttggatatttagaaacaaagtatttctggtgagttttacagcttttctttttttttttttttttgtaagacagtacatgtcttttggttttaaattttatttgcatggtgaagccttggagaattttctgagggtatcagagaagaaactgttggaaaatccattcaaatttaaaatgatctaaaaattaatcaaaatcattacattcaagtttcaatatatttccaaaattttcattttattacacatgtcagtcatctatacagataatggaaaccaaattggggggaagaaggttttcttttttcaataccaatcattattttgttcttgaaacaatgaatgacatgaatttcagtaactgatttttccaaggatttttggactcaagtttcatatagtctagagatactggtgagtagcaggtggtttgtatagagaaaaatggaaagaaaatgaaacataagtaactgcaatgtaggtggagagacatctttaaatggt

SEQ ID NO: 97174 - DNA, 2286 bp, Homo sapiens
tagagattttcgcctcttttttttcttccaaactaatttgaatgtatttgtgttagaaaatatagaaaagagtctgcttttctttgacagcaaaaagctcggaaaacttccactcccagcatatctttatttttgcatcattcattgaggaggaaagaaacataatattgctgtgtgattttcagcagtcggacatgggacatatgacccatttgtgtgttctttagcatgtctcaaaggaccaattttgacatatatgaaacaaagaaaagttggtatttagagccatattgatttttaaaatcctagatattgctggatacagtggtgtgcgcctattcctggatacttgggaggctgaggcaggaggattgcttgagcacaggagttcaagtgcaacctgggcaacacagcaagacttcatctctcaaaaaaaatttttaagaaatgtaaaatcctagatattattacacattaatcctttggataggtagtttttgatttttaattcagaaagaatattgcataggagatcttccagtcataatctggaataattaattagattttactagtttttttcgagaattctttacaatgaaattcttagtaatatgtttgtcatccgttatatttggggattgagaaaacagaattgttcttatatttatattttaataaatatttttgcaaatatggtgaaatgttgacattctggttttgacattcatttgtaagtattgtttgtgtttctggttagctctcttaaaagtactatctaggaaatcttagtttttataagagaatatagccattaatttttttctacagattaggcaacagaagatttgtgaaaacaaaatgtattgatctcatttatattcccttgatgaaggaacacatgctggtctccgctcgctttctgtccactagtatgaaatccttgtccctgcttccttgctggtaggtttttagaagttcagtgagcaatgcaaatcgcctgaagggtggaaaattcccttgtcacacagatgcccttatcagcagcaaccagatggagctctgagctggaacgttatcggtgttaaattgctttttctcccaccctgagtagagaggattaaagcattcctttagaaatgggtggcaaatgtacagacttaggaatattaatattctttaacaatttgcatttataagtaaatacatggaaatataatctccaaaaaagtccatgttcaaaattcagccaaatcagtgcaaaatgttttgttttaaataaaataggataatagtctttcatgaattcacttgcaaagagtaagcttgaaactgtttttttttcttttttttttttttaagtgggagacagtatctcactattagggtcaaatgcatattagggtcagttttggttgtagaaaataaaggtatgtctaagtgtattcatactgttgaagaaaaatacaatttaaattatttctcagagttgtcatttattttggcataattaattggttcttttactgttactgtttttgggtaaatccttagattctgcattagtttgatttttgaaatgttgatttattaaatattgctattttgtaagctaataattgctaaataccttgcaatttcaggtctgtatgaacagtattgatggttagccatatcagtagttacacagtgtattttaatgaaactagttttagaagtccgtaagagagactgctgttaaattatatgtgttgttcatagccatttctatattagtgattttgtttcttaatattgatttccagataccatctaacctccaatgaatgataaccatttctctgatagaaaaattggtatgcctttgtgttttatatggcaataaccacctacacagtggctgacgttggagtaaaaattctttcttcatattcatatgcaggtttatgaaatatgttgcagtttttttttttttcttaaggcctagtttttagtatgtgccaagagttgggactttgcaacaattacaccatgatgtgtgcaattttttgcaggtgtaaatatgaacatataagtaaggatggataaattgttccctttgtatttctaaatatcagataaatatgattattactgatacaacataaaaactgcttttgcaaaaaataaagttgaagaactttattttttaggttgattcagacatgtcaataaagcagattaataaagaatcttcagtttaatgactgagatataatgttttacttacagaaccaatttagaact

SEQ ID NO: 97175 - DNA, 1281 bp, Homo sapiens
tgtgtcattcagttaacttttttcctagatttaagaattaattttaatcatatgttaagaagtatcatatctgattttgtaaaatatgacttttgatttccaaatatgtatgtgtggcagaataatttaattattgtcataattaaattactatgtgtggcagaataataattaaattattattctgtgtggcagaataatttaattattgtcatttataacaaaaaaagaaggggtgcatcagatacaaaagcaatacttagggtttttttttttcccagaataattttaaacatgatattttcttctaaatgtcatgagcagaattttgttgaaagccaagattggtagattattgttataattcaggtagaataaatttaaatagttggaattgtaacaaataatactctatttcagttactttttctttatgtagaatccaaagatgatgaattcactcttcagtctaaatgaggtttagagggacatactaggcaaagaaagaacttcacctaacagtgagttattaggatgttgtggttcatattacccagggtagaggattgaagataatagtaaagtttggttaggaagagaacacaatggtgagaagtacaaactggcaaggctgcagcgtaaagtcaaggacaagtatgtctgtgataggagatgaggaaaaccattcctgtattaagattgagtctaaggacagtccagattctagcacagattatttggatatgtatttcagaggttaccataaaagagagtgtgaagtaattgggacttaaacttggtgaattttaattgtcaggatgggaaacagatttccttatgaaataactagaaattttgtctgaattttgttctgtaacaaatgtgtgaactttctaattaccttttcttcaattttttcagatcagctgtttcatgtattagccttgcacatgcggctttatagcattgactctgagtataatccctggagaaagctcacccagttagaagagatgaatccacagtaagtataattgaaagactaaaatcaattaaaactctttatgaaaaacaggtgttaaatataaaaatggaattgaaatttcaatatatgtgattttttcacattttctttatgaagcacagaaatatatcataagaattgaaaacagtttaccattatgctgtctgtaaaaattgcatacaaattcccaccatgtgagaaaatcttttaaagaatcccactgatttttatgcagattaaatagtcaagtggaggca

SEQ ID NO: 97176 - DNA, 1020 bp, Homo sapiens
taattcttgctaaaatccattatttcattaggtgctgcaaaatggtgatttaaaaaaatgctttcttctgattaaatggaatgtttttataaagaactttaccatatcaactatttgttgactctgaaatacagtttggcaggatgaatacttgatacttttctgatttataaattttcaaagtaaggaatggatgccctattaacttccaacagtgaccaataagtttggtctttggtgtattttatgatctcatggattttatatatatttgatgtgtttcactccatttcaatctttcctctttttgatacaaattgttcccttttactttagtgagaatctttccaaactgacttttgtacttttgacatgagccaagtagtctttcatcatatcctcactttctggtacaagttggcccgggttcgttttgtacattttctattttatacttggaatcagccatttctccatttagttccttttaatggcaaatggtatttagagaccacagtctgggtgctagagggcatacatagctaataggttatcattgtttataggccatttcagtggacagagttaggaaatatttttttaaaggaaaaaaagatcctgtgttcttactggtatttctgatcaacataagattgcacagttttcattttatttcttttttgttacttgtatcttttttctcttaaagtcttgattcctaataatattaacataattatttgtataactaaagtatagcctcgattatgtttttaaaataccaatattactactaaccataaattatctttgtcattagaatatgtacttctagggatgtatagtcaaaaactgtgtttttaaatcacataaagtaacttttcccatgtgattatgccatcaacttgatttatagttcagctcatttcagtttttttcctcaatatttaaagactgcttttttcccccttgacttatattttattgtataaaatttatatttttctgaagtaaaaacta

SEQ ID NO: 97177 - DNA, 1055 bp, Homo sapiens
gatcatattaaaccctgtagttgaaatctttggttctcttttctacagaggggtgcatcaatccattcattcattccagttatgggccagtgatgtgctaggaaagatccatttctctctctgtccttagaatggctatttttatcttatcagccaataactgccaggattttttctgattattattggggaaaaaacttaccaaaaaaagtattatcacttaaacattttttggctaatatgagtgattaaaaatgggatcctaaagtaatggaaatctatttgatttctagcaaagttaagtatttttatatttattagctatttgtatacattctttgtgaatgatatattctggacctctgtccattttctgttggcatcttattgtttaaaattatatgaatgattctccatggtttaaaatattaaatcttattttgtcatagttgtttataagtgtttttcaaaatatgtttgccgtctacttttgtaattacttttcttgacccattgaagttttaaattttcatgtagccagatcaatcagaccttatatttcttattttttcctattactttcatacttagaatgcccatgtcttccaagagctgatgtatacttttataactagtattacaatgtgtaatccagtcttaggatttgcaatatctacctatattttcactttagagttttctcatgggatgatttttaaaactatataacgtacttggaattcattctcacctgtagtgttaggtgaagatctaaaatttatttgcaaataaccaagtagtatttttagtgattttatatcctagttattaaatactaagggttcctacattataggcctgattaggagctttcttctttgttctattgagctccaagcctgtttctctgacaataccatgatggtttattgtttaggtgatttattatgtctagttatcgggctgagttaggttcctctcatttctcttccccaaactctgactcccagtttttctttgctgttctcacttattctccagaaggtttttagaac

SEQ ID NO: 97178 - DNA, 1322 bp, Homo sapiens
tattttaagttctgctttggttatctctttttgaaactttgcaaatgttaaagattttatttgaattttgttagttataaagttgaaacattttattttattattaattttgagacagagtctcactttttcacccaggctggagtgcagcagcacaatcacagcccgctgcagccttgacctcctgggttcaagcaatcctcccacacaccactaagccctgctaattttttatattttttgtagtggcgggttttcaccatgttgtcaatctggtctcaaacttctgagctcaagtgatccgcctgcctcagcctcacaaagtgctgggattacaggcatgagccactgtgctcggctgaaacattttaataagagcagttaaccataccttttcaacaggaattgatttgggaactctgcctatctctttttaaagatgtgaaaacttacttattcgttattgctaagtttgtgataagtatcctataagccactccatttgtagtgaaactaattctttcattctctatgtaatactttaatttctgtaatctaagatcagaaacactcataatcaagttaatgtatcctaattgttcactttgataacacaacacattttctatacattttcttcatgttagagtcaagagaatatgagtctaaaatgtaatttttttgcaaaaaatatgactcctaaggtttttttttacatttcttctttgtgtattaaagtttttatttctgttccatagatatatatgtgacatataaaataaattagaaagagaagatatacaatactatgtaaagtgactacatttttcttttaggctgggatatgaagaacaacagcctgaggttccaattctttatcatgatgtaacatcccttttgctcatccagatcttaatgatgccacaacccttacgcaaaggtatgtctttataattcagattctttgattatatactatgtattttgaatattctagagattatagagacaaataggctgggtgtggtggctcatgcttgtaatccccgcactttaggaggctgaggtgggtggattgcttgagcacaggagctcgagaccagcctgggctattaatatagtgagatgctgtctcaaaaagagaaagagaagtaaatacagcagtaagtatgatggatactttttgtggtaataacagacattgttttttctattattagcaaatagtaatcgtatctaaaaaatgacaatgaaaaagtgttttttaaaattcttgtgggtctgttcagctttttagtcactaagaggtaaagacatgggaa

SEQ ID NO: 97179 - DNA, 2010 bp, Homo sapiens
aattccatgtttttattattgttccttatccacactgacaacctaaaagttttaaaccagaaataactttctctttgccccatattaacatttgctttcatagagtagctaggttctatagaaccattagatatataacaactctatttaaaaaataaatgtataaaagaagcagatgacatttaggagttatatttcaaagagatgtattttggggatatttagatataacagctaggaacctttttctctcttgtttctcttactcccttcactttttttcagttgactcagttaagaaagttttcttattgtctcaaagtaattgatgagggtgaccttttatgtaataggaaatgttcttgatgaaatattttcagaatttcctatttcatgtctaaaaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggtatgttaaaagagttgtactagcttgtcacggtggtgatatgctaataggtaagagaataatgaggactgttaaattttaggtcatctgtttttgacagcaattataaaacttgattaaattgaaaaaattgtttacttatgtagattgtatttataatggaagaaatatttcagctaacaaaggtaaggcattagtcaatacttttagtttgtttggggtcagcagatttttattgaataccttaagtaatcataggattagacttggtagatacaaaggaattttaaggtagacaaggaatttacatttttgtttgaagaactggcttatatttttaaaacaaattggactagcaaatctaaaaggtcatgtctttaactttaaaatttcttgggcctatgctaccagctcagctagttaaagggtttgtattgaagataagtagagtgggaacagcagtgagtggctgtgtatgccatggttggagtctcagaattctagaactacagttttttaaaattgaataatgtgatgaaagtagtattttggggagtaattctggtgtctttttagtggataaattaaagtaaggataaagggaagccagaaaatatttaggtggtgaaaaaaatctagactatttttctgattgtaaaacttggaaagtaactaatgtaagagacatttgagaaaaatataggacttggtgaccagatgtacatgactttaagatcttgaactccaatcattaggagagtagtgtctagtatatacagctacagtaggaacatgcggctgcttaaacaccattgctgatgccccattgcctatggaagaaggtatggactccttgcatggcactcaaggatcttcaccatcttgcttgcctttccatctcatcgtatagcctccctctgccattaccttgctcaaatcacaaaagaatgtttcataagtatgctatacatttttaaacttctagaacattacttattgctgttactaaagcaaccttcctacccttctgttgaattaataatcactgtttgctaagtaacatttacctttgctaagataaatgtgacttcctccatgaagatttgtctgatagtccatcttccttacatcctaatcccttttttttctgttgttctataaggctgtacttttgtgactttctctaacagttgccatgttcattacatttgtttctttaatgtatctgaatgggggctccacgaagcagaaattgttccttatttatccccggtttctagaaagtgcctcatatatactagtcacctaataaatatttgtagaacaattaagttgtggggtggtgtctttggcagaaatagaacgtattaaaggggagccaagtttcagggaaagtgagaattttaattttgaacatcaaagggac

SEQ ID NO: 97180 - DNA, 1476 bp, Homo sapiens
atgaactcgggaggcggagcttgcagtgagccaagatcgtgccactgcactccagcctgggtgacagagtgggactccgtctcaaaaaagaaataagtaaataaaaaataaaaaaataaaaaaaggaggcaggcatggtggtgagcacctgtaatcccagctactcgagaggctgagacaggagaattgcttgaacccaggaggcggaggttgcactgcgagagactgtctcagaaaaaaaagaagaaagaaatgcatgtgaaatcttccgtgtatgatattaatactttttttttctttttgttctaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgctt

SEQ ID NO: 97181 - DNA, 1146 bp, Homo sapiens
agtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttactgcttacatgtttttttttcccccaaagatattgacagtaatatatgtgagtgaacatggctgaaaagatcaaagcacaacataattagtagttgctttagggtggagtaagtgtaaagggtttgctttgctttttttcttttatttgcagagtgagttcttgcttcttcagtccttgtctcataatcaatgcacattctttgctaagtgtgtgtgtttggtagggggagaaggaaatgg

SEQ ID NO: 97182 - DNA, 1070 bp, Homo sapiens
tgattcaaaatgggcaaaagcttcccctcaagaagaaaaatttcagacctatgaaaacgacaacaatactaataaaaaaattgtatttacttcgaagcattcagaatgtcaacaaaacagctgccactttttattttgtaattacagagtggtattcagttaacagaacaacaattatttcatataagctgcatcagagacaactaaagatgaaaaactaccatccccatatataactaatttgtgctgtgcaccaacaagaacctgctttaaatttccatgccagtttataacccccatactgtaccaggcaaggttagtggctattgaaaataccaccaggacagggctatctaaagacacatttggtagtgtgttaactgtacaaaaaaagacactgtacagtgtaaaaacaaatcttacacagccttacattttaatttttttatttaaaaggagtgagttgtgtacaggggggttaaatgctttatagacaaggaaaaaaactaggctagaaccaacttattcatcatcatcttcttcatcttcctcctcataatcctcttcatcttctgtcctcctcttccttctttttcttgcttttttcagccttgacaactcccttttttgctgcatcaggctttcctttagctcgatatgtagctgtatcctttttgtatttttccttcagctttgcagccttcttttcacaaagctgcttgtcatctgcaaaagtgttattccacatctctaccagtttctttgcaacatcgctaataggcaggccaggatgctctcctttgatttttgggcaatactcagagcagaacagcaaaaaggccgaaggaggcctcttgggtgcattggaatcctcgaacttcttttttgtctcccctttaggagggatataggttttcatttctctttcataacggtctttgtccacctttgccatatcttcaaattttcctttatctttagcagacatggccttccacctctctgagcacttcttagaaaactctgagaagttgactgaggcatctgggtgcttcttcttacactcctcc

SEQ ID NO: 97183 - DNA, 1046 bp, Homo sapiens
gaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgagccggtctcatttgatcttttcttcttctgggtggctgtactaagcggtcgggtttccccgggaatttgatggttcctatagtctgcctgtgtcggaggcttctttggtttggaaggatctgggcaaatgtgttgggttcaggaatggacaaaggcaggcaattccgttttgtggtaaagaggtagggcaagattttccaatcacaatttgagtttctcatgcggccttaggattcacccgagactgtttgtcttccaagtttgtttttacctgacgaattccctgtggctttctatttgttggtactctcgggacaggtcac

SEQ ID NO: 97184 - DNA, 1020 bp, Homo sapiens
tgggaagatttatcttgtcttagagagctcccttgatctctcagggattggggcctccttgggaatatgctacagtcagcatcatcctagcttcttgttattgttcactagggaggcctcctaaaggaccccaaacaatgatgattagatagtttagacttgggggcagagtgaggggcccattctctgaaaaaaaaaaaatcatagaatcatagaggtattttcatttatgttacaggtttccctggtactggtaattcccagcagctttctacaattccaaaggtcagaaataaactgccaaaaaatttttactaaatcatgttctggtctgggatacagccctgaaatgcactttgagcaagaaagactttgtagaggagaaaaaaggtggaccaatgaggattgggctagaaccagaggaaagtgaacattcttggtttagataaatatccacaaccttctaaggttttcatgtgtactacagagaagctccaggctcctacatttccctgtgggtagttttaaaaagctactgtagcaaaacagaggctggtggtgactacgcttatcttttagaagagccatcattgcatttctgcagcacagaatatatacgtgttttttactcttagtggtggagtttatatgtgactcatgatgtttagttgttaatcatccaatgatactaaatactgcttagttagctcagtattccctttaggaaaccagatattgctaaagtcactgttcgacttaatggggaaaattccactaacatctaaaatatgtgatttataattcaaaaatgtaaatactgtattggtattacatactataaaaggacaattgtctacacaattacataacatgcatgtaaggatcaatatttaattaagactatttttgtattctcattgggagttagagcccaatattctcaattgggtgagaatttcagccaaatggtctatccattttcttttctttctttcttttttttttttgagacagatcttg

SEQ ID NO: 97185 - DNA, 1684 bp, Homo sapiens
gtatacaattatagttggagattttgacacccttctttcaataattggtaggattaagtggacctaaaatcagtaagatatagaagatttgaacaaaactatcaaccaacttgacctaattgacatttatagaactccccatgtaacaacaactgaatacatattctttacatgtgcatctaaaacatttaccaggatagaccatagtctgggcactaaaaagtacaaatatgtttaatagaattcaagtcatacaaagtatattctctgatcacaatggaattgaattagaaagcaacaacagaaagatctctgcaaaatccccaattatttgaaaactaagccatacacttctaaatacctcatgtgtcaaagaataaatgaaaagggagcttaggggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccggccttcagaaacaaaagaagtggagccagagccaactgaggacaaagatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcaacccaaacatctccttgcatttttattggctgaattgggtacaagtggttctatagatggtaataaccaacttgtaatcaaaggaagattccaacagaaacagatagaaaatgtcttgagaagatatatcaaggagtatgtcacttgtcacacatgccgatcaccggacacaatcctgcagaaggacatgcgactctatttcctacagtgcgaaacttgtcattctagatgttctgttgccattatcaaaattggcttccaggctgtcatgggcaagcgagcacagctccgtgccaaagctaactaatttgctaatcactgattttgcaaagcttgttgtggagatgtggctggacaggtttgccatcagagtggatataccattgtattaaaaacaagataaaaaagctgccaagatttttggcgagtggttggttggtctgaagtccttgcaagacgctgatgctcaagctgttgacatactcattgcctactttaacacctgtcagagaa

SEQ ID NO: 97186 - DNA, 1192 bp, Homo sapiens
cggacccgcagtccggaggcggggcctgcggcggcaggtgttaaatcacctcggcgccggccgagtggcctgaaagaccagcagggcaggagacggaaaaccaaatggcctggaagtaggttcgacggacttaaacagacttgattttgaccagacttttcctttcccgtgccactcctgaccctcccaaaccttctcaagatttcctggagtgggaacttccgttctgttccgattgctgagggtgtggtttagattataaggtttagatccacagtggtaaagaggtagtgcagagaaattttttttaaaaatcggagtatataaaggaaaacaaccctagcttaacttccaggacgcagagaaacatagtatctcaaaaggcgtcagctaagcccctacctatgaacggcctgggcctgggtggtacaaagcatgtggtcttttcctcatggaaccgggcgactttagaagtagcattgatggttgtttgctgtgacacctgtgtgagtgttaacatgaacagtcaacagagtggccgcagcgtgtagcgccatttaggggtgtaatagagtgtcactcaatattagctcctcacaggcaagaacgttttcactgaaagtaagagagtgcacttcctggtgctaccttcatttcctgccctgggtcccatgttttaggtgagacacattcttaaattgcccagctgtctatgtgatagggctgagacagatcatctttctgatcttccggattatcgtgtctattgcctttccattacactaaaaatccctcctctgccatactcttagtaggaaagggtgattttttttttccccgaaaggaaaagggagcctataaataaaccgtattatcttcctatccccttctgctaaccaaacacccaagagccacactgagagaggaaatggaaggagaattgtcagttcccaaatgtgaggtgaaagctgtgcttttctttctattatctggtctgattttgagttctctaccctgggatgttacccagtattaccagctgtttctcacagtgaccgattgtggtcatgaatccttggggattcatgatatttttataatacatgcactcagggaaactcagtaaaacacattagtgttaataagcaaaaaaaaaaaaaaaaagtcgcgtgtttgaaagaaagccatacac

SEQ ID NO: 97187 - DNA, 1013 bp, Homo sapiens
cccacctcagcctcccaaagtgtagggatttcaggtgggagccactgcacccagcacccccaacgccccacctcttttttttttttttttttctttttttgacacagggtctcactctaggctggaatgagtagcacagtctccactcactgcagcctccaactcccaggctcaagtgatcctcccccctctcagcctccccagtagctgggactacaggcacacaccaccatgcccagctaattttttgtattttcggtagagatgggtttttgccatgttgcccaggctgccctcgaactcctgagttcaagcaatccacccacctcagcctcacaaagtgctggggttacaggcgtgagccactgcgcccggcctgtatatgctttcgtacttatgtgatgaggtgtgttttaatgcctgcgctatcatcctcaggattctcactgggggagatctgctgttagtggttaattatggtttcagtaagtagtagagtgtacaacactgattcttctgccttctgggtcagatactaacagggctttttaataattcctctgcaaattttataaaaattgagcttagaataaccgttaacatcagtgtgttcattttgcttactttaatattctattgaaaggattatatatattgattgattcactataaaatactaatgtaaactaggaaatagaaagtttgatatgtgcttttgaaactgacttttttttttttttttttttgaagcagggtcgcactctgtcactatggctggagtgttgtggtgtggtcatggcccactgcagccttgaactcctgggctcaattaatccttttatctcagcctcctgagtagcttacaggcatatgctgccacgtctagccaattttaaaatttttttgtagagagatctttctatgttgcccaggctggtcttgaactcctgggctcaagcgatcctctcgtcttggcttcccaaagtgttgggattacacttatgagccaccac

SEQ ID NO: 97188 - DNA, 1249 bp, Homo sapiens
aaataaaggccaacatctggcctttatttgtttatgaaatgaaatatttaatatgctgtttctactttcttttctatccagctcttaataaagcatgtatttagaaatagagtccaaaattaaacgttaaccccagtaaatgttttagatttttataatcaaagtcatcacaacttcgttagtaatgtgacttcttatggcatattttgtttttacacattgaagccctagatcattctaaataatgttgggttgcaaattccataatccataatgagctattagaaaaaagtcagtttcaagttgttgctaacgtaagagttcttaatttcttgacattcttttacatagaagaaaatttaaatgttggtgaaacctttgttgaatgttttatttatgttgattattaatattactcttatagggccataggatgcttaagctaacattaaatttttatttactaaggaatgtgatttctatgtgttcacagaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggtacgtatcaactgtgaactgttactggaggttcatgaagcagtgtggaaagatgttttaacaatggttgtttctggcttaataagattgtaaggatattattaataggcaatttttgccaaaaatcagcgttcattgctttttaagtatggatcaatttttttttaagttgaggaagagaagcaaatgtacaagtttaagaactttttctaatgatttattcattataagatgtgttagagtagatagctacaaaaatattttaaatatttgttaaatattatgtaatttttatgctcagaagtttaaaatatattctgtagtttctgacatctgacacatctctagcaagacagaagtatacagatttaaaaaatcaacataattaaaaattggactataaaccttggaagattattttatatatattaattttagggtgtgtgtttatgtcattctaggaggtggaatcaaattctcctgcagcactggcaggtcttagaccacacagtgattatataattggagcagatacagtcatgaatgaggtaa

SEQ ID NO: 97189 - DNA, 1098 bp, Homo sapiens
gcagataacatacttaatgatatggattagctcatataatcaaggaaacagctgaagaaccagatgtagaaaggacaggactcagaaaacctagggatttagataggaagaagtatttggcaatgtcatcagcattcattctactaaacccatttttgttttttctctgactcccaaggtttgcagccatgggcaagagaaattggcctggctttgaccatgagccattcccttggtttgggcagggcagacactctgattgacaatcctaccagcactgcacacaacagcagagaagtaattccccaaagggaggaaagagaaaggaatgttgagaagacatcagactagaaagaagcaatgtgatcacatcttactagaaaaatgcctctggtggcagtgggaggatgaaatagaagagatctgggttgaacatacatgactgatttgtgtcaggttctgaaagagaactatggaatgtgtaaatgatgtcatcatacagacgtgcttagagctcttcagtggaaaggctgtatcgatgtcatttgtttagcgagtaatcatcaaatgtctgccatgtgccggcagctatgaaggcagtaaacagacaaggtctctgcccttcaggaccttaacattttgttgggggagatagatagtaaataaatatgcagtgtgttggatggtgatgaattcttgaaaaataaaggagtaagggtgatatccacagtggagggcagggtgttgttttctgtggggtggtctgggagacctctgcttagatgacattatctaaaagaatagaaatttgtttgtttttatcttttaaaatctcaaagaagggagtgcatgttcagggcaacttgaatctatgctcttgggttacccgccccccccaaaaaaaacacctcaaagaaatacaagctgtgatagataacaacgttaagaaaaaaatgtttttatagcctaggatgtggcattggatatggttatttgcatcgaatacctacacgcccatttgaggaaggaaagaaaatttctcttccaggacaaatggctggtacacctattacacctcttaaagatgggtttacagag

SEQ ID NO: 97190 - DNA, 1002 bp, Homo sapiens
tgcactcatgaggttggaaatcttgagaagtctatcatgtattaagacttccagctgatttctttcctgagcaatgaaagttaaaacaaataaaccagctgggaattcaggaaagcagtggtggtttaaaggttgaataaaatgatttccaggtggtgaggaaagaggagagagtagaatctcttctagtgtggaagtatgaagaacagcatgtgcaacttggggtagaagccatgtgtctcaagactagaagtgacaggagagagagatgcttacagtgcatggtccgtgacatgtaccaaaattaggagggagtgtctggaggcagacgtgccagatgaagcttgtgacagctcatgtgtgaaccaaatatctatctgcagggcaagtaagagccaatatttatattttctttgaaataaacttaagtaatctttgtgtttttttttctttttttggaaggtccagctgtcctcagttaatcccccgtctttgtcaccaccaggaactacaggaattgaacagagtctgactggactttctattagctcaactccaccagctgtcagtagtgttctcagtacaggtgtgcagaaaaatatattctgttttcagtctattttatgtaatattattgcatagaattttaaaaattgaccagacacagtggctcacacctgtaatcccagcactttgggaggccaaggcaggattgcttgagctcaggagttctaaaccagcatgggcaatatggtggaaccacgtctctaaaaaaaaaaaactttttttaattagccaggtgtggtggtgtgcacctgtagtcccagctcctcgagagcctgagatgggaggattgcttgagccttggaggttgtggcagcagtgagccgtgattgtgccactgcattccagcctggtcgacagagtgaaaaatttaaagaattttaaaaaattattttaaaaaaatttttaaaaaagaatttaaaaaattaatgccagtgt

SEQ ID NO: 97191 - DNA, 1529 bp, Homo sapiens
atgtaaataaaaatagccctttgacaatgcctgctgtcctttcagtgctgggaggatgtatgatctatgccgtttttgtcctaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagacaaaagtgcttcctcagttattgccctggtatgagtctgaagatgctcatcccctgcagggaggacgtggctgaggtggcagcaccctcacatcaccctcatgt

SEQ ID NO: 97192 - DNA, 1039 bp, Homo sapiens
caaaaagccaaacatgggaactttctctccacgtacctttctcagctacttccctagactgcatcatgaacgtgttgttaggtgttcttgtttcattgttttttccaaaactatgaaatcttcatggtccctgcccccccgcaccccacatcttagtgtgaaatgaaaacaggataagctatagtaacaaattaacccccccaaaaggtttgtttctcaattatgcaaaatccacactgagcttggtaactcctaggcaactttacaagacagctctcttctccaggtggtggctggggcatccaggctgcttgcatcttatggttctagtcacatcaatctgtagttacaggagaggaaggcaggaaaggaggggacatcctagttcttaaatgccttggaccagaagtattgtctttccttgctagaattgagtcgtggcctcaaatcagctgcacaggaggtactatatctctgtcaccatcaagaatttgcatgacaatccaggtttacatgtaacctgcttgtaccttttaaagggaatctccacttcaaatacatacatatctagtctgtgattcatgacttttgccagattttgggagctgtgtggagcaggaacctgaagagcttagctgaaaacctctcatcagtaggaatccactgaggtagttacagatacctgaggctcagatgggaagccctggaggaccatacccaagaataggagcaaaccagctcaacgccatgccctctgcctggtggttcattgtgattggtttattgtgtagatattgaagaaaaagagaatattttaggttgacatttttaagccaaaaaaaaaaaaaaaagattctagaaaaaagccaggattattttagacccagttaattatttgagattctcttccaacaactctaccatagactttgacttggaattacaaagatggagaaaataaacatttcacttgagcaggggtttgtgtttgtttaaggaaagagtaataaggacaatttgtcgagcacttatggtatac

SEQ ID NO: 97193 - DNA, 2432 bp, Homo sapiens
agatctacttatgtcttaaatgtgtccatccttctgctgattcagttgattgatatttagaagggaaaaagatcattaattgctaacatttcctttctctttttgaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaat

SEQ ID NO: 97194 - DNA, 1303 bp, Homo sapiens
gtttgaacaaaagaaccatgtgatcaggtgtatattttagggagagaagtgcctacagtttgaacagtggttaaggaggatgggagagggtttcttctactattattagatactgcaaataagaccattgtaatctctttaagtttttgtttcggtaggtaggtaggtggtaggtaggtaggtaggtagatagatagatagatagatagatagatagatagatagatagataaagatagatagagatgaactttatcacaatgttgtatgtgttggctctagagttaaatgataaaagaatgtaaatgctccagaagttcagttgatgattttcactgatgggagtcctagagtttatatatgaataaaattcgtgttctaagattttacacttagaagattttaagttacagattgtcagtagtaaccttttttctctcccacaaaacttacaggtatttacctcctgagtgttttgtagttggaaaagagccaccaaagatttccaacaaggttgatgtatggtcggttggagtcatcttctttcagtgtctttatggtagaaaggtaaattgaattctaccagccttcagctctacagagataaattaagttgaatttttccttcttaaaagcaaaatttcactaacttaaagtcaatttagatccttctaaagaaagccaggcttctcctctatttcttcctaaaatttccatggatcagaattattttaatgtcacaccagtttacttgacctactttttgctttctttcctttttttaagaaaagaagtaactatctgttaacatgctaatatttgtctgctattgggaatactggagtcaatacttttcattatccaccattcacttgacctcctcttacaccccccaccccacccacacacacagtttggcctgggtgggcagtttccccgttgctcatcagggaaataccatcaaacttagtcttatttcccaacttctttttatattgaagttggaagtgcaggttaccataaatattaactagcccacatcccaccccatcccttcatcaataggggaagagaggttaagggatttgtgtgggatctcctcactccaaatccagagctccttcatttaaattcgcctgtgatgcacacagtattttattctttggaaattgtcatagacattttcattactacttcatctcttctctaactgaacttcattgtttattcagaataaagttttaaatttatgtttttatcttatattgcaacagcattattttcttcttcttacagtgtttaa

SEQ ID NO: 97195 - DNA, 1181 bp, Homo sapiens
ttttaaaaaaattagccaggcatggtggtgtgtgcctgtggtcccagctaattgggaggctaaagtgggagaatcgcttgaggcttggagatcgaggctgcagtgagccgtgatcgcaccactgcactcagcctgggcaacacagtgagacccggtctcaaaaaaaaataaaaataaaaatcatacatggattctcaactgcatgggtcagtgcctccaacccctatattgttcaagggtcaactgtatttgatatatttggatagcactataaatactcgtatattttagaatacacatataatattgctcttataaattacctttcatcctcagaaacttaaaatatttagttttgtctctctggtctcaaattcactaaatcctggtggacatcttttcccaagttactttgacgtcaatttctgtggttgctctccttgcatacatacaccttgtgcctggagagagtatagcttaatctttacaagctattcctgtttcagttacacacatagacacctgcgtaaaatacacacttttattgacaaaataaatccagctttttactgcattacaaatgagttattggttatctttgctggttttacttcacggaagtttcatgtgtattttaagagatctgtcaacatcttgctgaaatcttaatgattttagcatagtgaatacaaaactgcattttttaaaaaaaatagtaaattcccattgagcagcattatttgttttgataattttaagtttatctaaatttttgaggtgtgagatgcttgcatccttgtgatggatcttttacttataactggagatgacaaattgatttttacccttcatctattaaaaattatgaactggcttagtgtggtggctcatgcctgtaatcctagcactttgcgaggccaaggtgggaggatcacgtaaggccagtagttcgagaccagcttggtcaacagcacaagactatcactacaaagaagaaagtattagctgggtgtgctggtgcacgtctgtagtcccatctatttgggaggctaaggtgcgagggtcacatgagcccaggagtgtgaggctgcagtgagctatgatcgtaccactgtactccagcctgggtgacagagttggaccctgtatcaaaaaaaattatgaacttataaataggactt

SEQ ID NO: 97196 - DNA, 1864 bp, Homo sapiens
gtttgaacagttttataataacgagtttttttcaacagttggaaaaataactgttaggaactttttaatttttctaaaaagtgagaaagaaatagggggttgctaggaaaagatagatttaaaaggttttatccaacctacaaaaaaagtggtacagtcatctgttttcctggctgcttactactagtatagaggaataagtccatattaaaaacaaataatagctttattgttttatttttattcagtatattggcatttataaaatttaatgtgaaaattcacattaaggttttctctgatttattaccatggaatttctgtcttctgataataaaagtgtcattgagctatatatagtcttagcagagaagatcattaataattgtagggtttgtcctaattccatattattgcaaaaattatcaccaaaataaaaaacatctcttcagctattcaattggtctttcatcttaattgtttttgacttgaaatcctaggcttttgacctttatgaacaaagatatgctgctgtgaagatacatcagcttaataaaagctggagagatgagaagaaagaaaactaccacaagtaaatactaatactttatggttttttaaaattgaatattttttgaatgatcatggagaattaatacactgtcttctcatagacatgcctgcagagagtatagaatacacaaagaactggatcaccccagaatagttaaactctatgattatttctccttggatacagatacgtaagtgaatattaaggttcaatttttaaggaaagatatgcttgctttctctttccccatcctgtgttgatgatataaatactctccatttccccattgtgattctgaattcttggatattacttatgtctaatttttttctcttctctgttgtaggttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggtaattatgaaatttgtctaattttttttaaacttgagtatagtttttaaaagtcattcattaagttatctgaaaacatgttttttggtttctcttgtaagacatcagtaaaatactagtaaaattaaaagttattaaagttatgtttttcatgtatgtatcattaaaagaatcttatattttattcttaggaaacatcctactggtagatggaacagcatgtggtgaaatcaaaatcactgattttggtctgtccaagattatggatgatgatagctatggtgtagatggaatggatctaacttcccagggggcaggcacttactggtaagtgtattactaaaaacatcagaatgtctagattggtgcccagtgcttttataataatttagtgtttttttttttatttccatgtagccattaagattactgtggtaaaggtactgatattaagctctcagttgagagggagacttctgtggtcattcctcttttctcatctgttcttaactgcaaataacagcatactggagagagaatgacctggcattaacaagtgacttcagtacctgccagtcagaaactcctaacaggaagaattcattcatgggttttcttctacaatgttagcgtgatgttcatcataaatataaatacttatgttaatataatattttaactattgcaagcaaaaactgcaagcatcaagccctctctgtggaggttatatggttgcaggaattttcattttattttgagacagggtcttgccct

SEQ ID NO: 97197 - DNA, 1047 bp, Homo sapiens
gtggttaatttattttacaaaagtccgaagacagtaaaatttaatgatgaaggccagtttataattatgtttaatcatatgtcaatactgtaaaagcttgattataactcccaatataaaagtctgttttttccagagaagtgattcttgctgagtacataaaggattttatgaagctcttggcaatgcagtaattattaggtctttgtgagagtgctataattggtcattgctcctgaatattgagctataaaagttttgtgagcgccaaagccttaagatgggtggtagtcatgcagatagactggtagagaatgaaaagaaatattgaatgaaatttgaaattagcagtggagtaactgagaaataaatagctaggaatagaataagagagtagaacttcagtgtagaaggaatttttatgtgtgtgttttaatatgtctgttttttgcccccacctctaaggttcaaagatcacccaacattaaatgaaagatatttattacttcatctgcttggtagaggtggctttagtgaagtgtataaggtaatgtatgttttattctgttttttttacactaatgtagcaaggatataggagtatgtggttaagaagtacttacgttgtctgggcatggtggctcacacatgtaaccccagggctttgggagatgggagggtgcctgaggccaggagtttgagaccaacctgggcaacatagtgagaccttgtctctacttaaaaaaaagtcagccaggtgtggtggcgcacacatgtagccccagctactcaggaggctgaggtgggagtattgcagagtccaggaattcatggttgcaataagctatgattgcaccactgcactctagtatgggtgacagagcaagaccctgtctcaaaaacaaaaaaaagaagtacttgtcttttgtttattgattatatgtcctcattataaaaaagggtttgttgtggcttctgttgtcttatttccagaatccaaagactgtccttgccacctgcacagtccctgtgatatttgatacctag

SEQ ID NO: 97198 - DNA, 1520 bp, Homo sapiens
agacggggtttctccatgttggtcaggctggtctcgaactcccgacctcaggtgatccgcccgccacagcctcccaaagtccaaagtgctgggattacaggtgtgagccactgcacccagccctagtcttatccattttttaagtagtattcaaatttgtattgacaaaaaaggggtgggtgtgtgtgtgtgtgtgtgtgtgtgtgtgtatatgtgtgtgtgtatgaatgaatgacatgaatgacatgagtgatatgtgtacttgttttggtggctagtctaaaagttgtatattttaagacaaaaatgtatttatcaaaatatttatattgattattaaatttctttaagatttatttacatctgctctgataccttagagtctactacagcaatctataaattttttgttgtaatgtatctttaggattgcaagtgagtggtcagtttgtgtgtgtgtgtgtgtgtgtgtgtgtgtgtgtgtgtgtgtgtgtgtttgtactccaaatgctgtaaggcgtaggaagaatcattctgcttttttctttcttcctcttttaactattataaaatattttcattttatttgttttctactagtaaattattccttcttaaattaaaatttgcatggactagaaatggctcattttatgttatgtcagttttcaactacctttcagtatatacattataaaaatagatttcttgtagtacagaataaaacccagcatctcattaggtatagattttcatgtggaggatggtttcttcaaataggtttttgccttatctctttccatcttttcggcattgaaaagagcactttggtcttttaactcggtggtactttataatatactattcttcccatcactgtaaaacattgatgcatgggtaaaaatatcttttttatatcgcaaataaattgagcttgttatagtcccctctcttcattttcaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacc

SEQ ID NO: 97199 - DNA, 1028 bp, Homo sapiens
aaaagagaaaacagttgcttggctaccagcccttcccaatcataactgtaaatccatgccatatgcataatgagcatgtagaagactaggtttaaaaggaagcagaggccaggcatggtgactcatgcctgtaatcccagcactttgggaggcagaggccagaggattgcttcagcccaggagttggaaatcttgtctctaccaaaaaaaaaaaaaaaaaaaaaaaaaaaaaaaaaaaaagtcggggcgggaaagcaggaaagaaaactgggagaaggactgcagtacactacacgaaggcattgcacctgtgtgtgatcaggcttggtgtcagccccttggttagtgttgaacgttaatttcactcctataatacagcagctgtaaatatttttaagacaagtgtgccagatatttaaattttgccaatcagttgaattcttaaacatttatttgatgctggggaggtagtttttgttttgttttgttataataaagtagaggaactgacagaattaaaacctgcctgttttaacagtcattccaagttacgggtattaatgcatgtatttatgcatttgaagggagagtaaaccattacccctccacacacccccagaaaaacaggaaatgaagtgtgtagagagcaaaacattgagtaaaggtactaagttaattatctaagctagttgaacacacctgaggtgatacagtatgctctcatcagtaataagccactttagtaattggggataggggtggagggaacatttatataattaggaaagaaagcccccaatatttaatgatttttatcttttctccttctcctacccttctccccaatctacacaattattctcaagcaaaaatatgattatggtgcaatagtttcaaaagtcagacctgctttgtctaggtggttattttggttggttggttggttggttggttggctggcttttattttggttggttcatatctcacacattcatatttagaatatgggaaagcatataatatggtg

SEQ ID NO: 97200 - DNA, 1027 bp, Homo sapiens
tctctgataagttctaattatgggaaaacaatttatctttgtgattcagaagctctgctaggttgattatatagtcagatctttattctggagttgaagaagatggtgtggatttgctttcaaggattgtcactaaattaacacataaaactaaaaatacaatccctgcaaaatcaacttccttgaaatgtctatatttttaaaaagatacaagttattagtcataataccccaaactgatgagtaaatgagaattttgaaagttattaggtccagtaactatgtcttgagactgctgttactcaaatttgtgatatgaacagcatgtgggtatgttactctttattttcttgtcttcagatttttttgtcttcttgattttaaatatttgattagttggagagaatgtgtttagaaagtgtgacatctcagtatggagtattaaatagtgtagtagggattggctttaatgtgtgtgttttggtgtgtgtgtgtgtgtgtgtgtgtatgtgtgagtgcatttgacttatgagccctgaatataagtgccagaagttttatttgaaaaacataaccaatttgtaattgaaacaggattagtcaagaaccatcagcaccaacacaaatgtatctttgcagaccgaaggaatcagctaaacaatttacagtcatctcaatctctactaaaacaaaaatcacatccaacatgccacctgacaccatttctttctctctctctcctttgctccttgcgatgtggcattcatctctccttgtgcctccgttctgaagagataacagtatagcaacaactctgccactgaaatcctgttctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtgg

SEQ ID NO: 97201 - DNA, 1010 bp, Homo sapiens
gcattagcatgggtgactctcttgccctttctcccttcaataaattcttaacattaagcagaactaattattagactaactttcttagcactgaaggaccaaagttcattgaggaagcccatggcatatggacataggagaatagaaagacctgtttactttttcttgaagtggataatttatgacatgctttgtgtttcataatgataatcactataattgaaaagctaaactaaaatatgaaaaagtatatttacctttgaataaatcatgaagtttagttcatattttatgctgttcttcagggttagaaaaataataaatccaaagatagccttactctattatccaatgtgtgatagagtaaggaatgagagtcaggcagaaacctccaaaagtaaatacatggctaaaataaataggtgtttctagttactaccaaaaagtaaatgtaaacttacttatggacttattagttttctcttctgagattaggaaaatcacagcagagcgtcactttttttcctctcaactgtatcaagaattcttttatctaatatttattgttatagttgttcccaagtttaagcagtcgttgctcacccatttattaagtgacttattgccatactctgcctgacacaggcataattcaaattcccattttaacggaattacatattactttttatagactttgaagctttcaccatttttgagtgaacattaattacacctttttgaaagcccagatctatatatacttcctctggagtaataccaccagtaagtgacaaagccaaaacttgaaccattcccactcctatttcaatgactgtacccatgtagttaattcctagaattattttgttgtagattaatagtaagttgattctttgtattcagaaaaattaattcacttgtggctttccttgcatctctattaagtactggactgtttgcttttccttaagttttcttttggtgtgtggcgggatgaacgtgctatt

SEQ ID NO: 97202 - DNA, 1487 bp, Homo sapiens
cttccaaggtctttagattattctatttaagtactaccttttggtaaaaaatacttcattttaaagatgaaatctaaaattccatattgtttatgttcatttcataataaaatagcaattgtaaataaatagcaaacttatttctttggcttatcttttaatttgttgcatgtgtgatgtttcgattagaagatgtacgtaggaaaaagcacttagtgatagtataaagggataaaactgagaaaaaatgttgctatgtgttattgtcgtaaacttttaaataatgtgtatctttctacttgtttgtaaactctgaaattgtaatcagtttattgtttttacaggtcttaattttagttcaaatgatttcagagaagtagtaataatagagtaggtttttttccctcaaaattaagttactgacagacataaagttctttttctttgacccaattttttgtgctttctgcttgtcaggttctttcaattttttaaataggctgaattataggtaaaattgaaggagtgaactaattggagatagtatctgtgaagttgtctccatgggatagggtgaggtaggatggagaaacccattctggtagcagctactattacactgcatactaatttgttttggaaatgttattaatatgctggggattcctaccatttatagggaatagaaaattattatatataatttgcattagtatcctttaatatgctatatctgtctatgccaactgcccagaaagcttcaacgtaaactacttgaacagtgaattaaaaagtgatttattttggttttgttatttaagtagttctattctgttctattgtaattattgactacttttcctgcgctttgagacttagttgacaacttaagtctattctctataataatagatggagctatataactatcataatagttctataatagtgatagaaccatataaaggaactatggaagcgaaaagggaatttttagtacaggatgagtcgtaagtatctgtgtgcccacttaaactgttttgataatgagttcgtaagggcctatgctttatgtctcatataaagatttaccagttattttctaaccagcctgtggtgataaaggaatacttatttacttagttatagtgattccaaggtgtacttgagagttttactgaagggttattatcttcacgtgtaataccaaatttcagattactctttctaaatgatgacattttacatatgcaccttattttatgaaaatctgttataaaatctgaaattgtagagcagttaaattaggaattggctatttgtattacaaaaagtacactttgaaaaggcttcaaaggagggtttgtttttgtttttggttggttggttttaaagctttcctggtactttgaaaatactggtttctgtgaaaaacacttttataaagtaaggtatacttagtgtccaaatattatatagacatttgt

SEQ ID NO: 97203 - DNA, 1020 bp, Homo sapiens
cttatttatttcatcacgtggttttttttatgcttgcttacttccactatagagtgtacgctcaaactaatatgtaaggagaaattgttttgtttttcactgtatccttagaatataaattctagaacatcacttgataaatggtactcattaaaacattgtagaattagttaactgtttcatctaaaagtattaaatatattctgaagaatatctcaaaggatttttggctcatacattttccttaaagcattgtagaattagttaactgtttcatctaaaagtattaaatatattctgaagaatatctcaaaggatttttggctcatacattttgggcttaaagttgtccacattttagtatttccacttgatttttatattttgctagttgttaataaactaagtattaatctcaatatgtagaattaaaatttcatttttgacaggttgactttggcagaatatcatgaacaggaagaaattttcaaacttagactaggacatctcaaaaaggtatgtgaaacatatgctgcatttttagttcaatttgctaccagaatttgtgggaagttgtgttataagtcacttattttaaaagccaaaatttaagagagtaagatttcaaattaaaaatttcagattaaaaagagatgcattaaagttactttattttatttattagtatttttattttttgaaacagtctcatcactcaggctggagtgcagcggcacaatctaagctcagtgcaacctccacctccctggttcaagcaattttcgtgcttcagcctcctgagtagctgggattacaggcatgcgccaccacatctggctaatttttgtatttttagtagagtgagggtttcgccatgttcaccaggctggtctcaaactcctggcttcgtgtgatccacccaccttggcctcccaaggtgctgggattacaggcatgagctgtcgcacccggccaaaattacatttttatgttgagtatattaaaacaacattcctttat

SEQ ID NO: 97204 - DNA, 1055 bp, Homo sapiens
tagatttttgggtttatttctgaattcagatctatttcataggtatatatgtgtattcttatggcagtaccatactttttgaaagtctccaatctgtggacataggatatcttttcatttaattaactctttttgaactccttagcaatattttgtagtttttagtaggcaagtctttcacctcctgggttaaatttattcctaggtattatattcttttggatgctattgtaaatgtaatagcttccttaatatccttttcaggttgttcattgctggtgtatagaagtaactgatttttgtgcattgctctcataccctgcagctttgccaaatttatttattgttctagtgattttttttcttgtgcattttttggggattttctaaatatagaggcatgtcatctgcaaatatagatagttttatttcttagcttacaatttagatgcattttatttcttttccttacctgactgctctggtaggacttccagtgcaatactgattagcaatcatgaaagtagacgtccttgtctttttcctggtattaggagaaaatctttccattttcaccattaactatgatgttagtttgcctgggttgttgttgccttttgttgttgttgttgttgttcttttcttttcttgctctgttgcccaggctggagtacagtggcagtctcagctcactgcaacctctgcctcccaggttgaagtgattctcatgcctcggcctcctgagtagctgggactacaggcgtgcaccaccacatctggctaatttttgtttaagtgcctctaacagtctatttaccatagtttgtgttctttgaggcttcatgttaattctctgcttaaacagaatgtctttaagacattgaataccaaatttgtttaaaatgaatatccctgtttttgttatttctactaactttttaaaatactgtcaccccatatttctgttaaactattttagaacacttttaaaattaaaattttcatttactcagacttagtgtggaagattatcaggagtcaagtcttatgtttgg

SEQ ID NO: 97205 - DNA, 1074 bp, Homo sapiens
accccatactttaatagtttggggtattgttttatctcatttcattcaagaaacatttactgagcaaaggtaagtgatgatcactacactaggtactagggatacaacagtataaatactgtataaatagacaccatctgtgttcttagggagtgatgtcatctaaccggacactttctgataaagtatctataggaataatatttattagaaagagtgaggtggggagatagaagatcccatgaaattatatatggcaacacatctttccctaatctaggggtttagagaatacctcacttaaaaaaattctttcaaatgagacctgaaggataagtacaaattggttcacaagagtggaaccaaaaggttacgaatgtatattttatggtttttcatgttttttatgcattttttccaagtttagccttgaaaagtaatggaaggttaatatggttttatttgtttatttttacacaggcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgtaagcctccatttaaaatttttcttttttaaaattgttgccagtgagcgtgaatgttactaatggatgttatttataattaatacttagatagcaaaaatgattaagaccaggaaggaaggcagtattgaaaatttagctctaaattaatagccccaaatatctgaattctaccgttttaagcagagatttaacaattctcttttaaaacagagacctaggtagctaagaggttaccagaattcacccttctgtgtctgaatcagttaggaatcaattaaaagttttggattattctaattcaacgtttccattcacattcctttgtctgagagaatgaagtaatgtaactaccatttatatgttttctcagcctgtgaaagcagttcattagtgggttatagg

SEQ ID NO: 97206 - DNA, 1592 bp, Homo sapiens
ttggcccttcacagtcttagagaaattttagaatcaggtttcaagttgcatatgcatcatacacacacagtgttgagattttgtttgaattgctgagggtctattggtgctaaattctgtttcctcttccttgaaaaacaactgtgttgggtatctaattttaggttggcaattcttttctctcagcacttttaagattttgtgcccttgtcttgtggattccaccatggttggcctagacttttgattctcaaagtgtgatcttcagaccaggagcatcagtattactggagaacttattagaaacggaaattttcaggtccttcctgagacctgattcagaagctctgggaatggttcccagtaatctgttgtaacaagccctataggttattctcttgccactgtactaatcagactcatcttttgatgttagaaggaagcctcttctctgagcatatggccacctacaaagtgaacagaattagtatcctattgctaaggaagaatggtgaggacagttgttgggtaggcaacttgtgtatgtcatttataagttcagtggagaaaatattttgttagttataagagatagaggaaaacccacatttaatttgttaattataagagatagaggaaaactcacatttatttttaagtgatagacactttatataccatattttagttatttttaacaaagtgaggtagattgtgttgcttctatttagaaataagaaagctgaactaaagttcttataacttagccaaagttaaccttagagtatggatttgaatgtatggatatggatacaaatttccctgtatgtactttccactacacacttaagtaacatttaacagtattatctcatggttaagtaggctttttttttttctcgtatcatactcagatatttaatattattagtcctatctgtatataatttatttagaacattaaaactatttctaagcttttcatattccccagtctagacctcttgcattttctacttatgtcataggctaactgtgatctcagacggcaaatagatgaacaacaaaaattacttgaaaaatacaaagaacgattaaataagtgcatatcaatgagcaagaaacttcttattgaaaaggtaggctaaaagttgagtaaattttcgctttcccttcattagccccttttgctttgtatgcttttataaattaatgaatacaattgagtgatgattttttttctccttttcagagtacacaagaaaagctgtcaagcagagagaagagtatgcaagatcgattacgcctcgggcactttacaacagttagacatggcgcttcatttactgaacaatggacagatggttttgcatttcagaatcttgtgaagttagtcattcttaacatttaaaagtttttagtattcgtttgggttttcattactttaaaagattatagatttgtaattatgctctccagttcctcgctactctgaaatcatagaatttagtacctttgaaagggatatgaaaccaagagtattacagttttagcttagtaatttcttgattaattagcagtcatctatagaa

SEQ ID NO: 97207 - DNA, 1114 bp, Homo sapiens
atgaaaattgctaagagagtagattttattcacaccacaaaaaaaagatatgtgttaaataacttgatttagccattccacattgtatatacatatatcaaaacatcgtgttgtgtaccataaatagataggtttttacttatcaatttaaaaaaggtcttgcaaaattcaaaaaaatcaactagaggaacgtatagcacaaagcagcggatatattgaattataatgaggaacatcagtattctaagtaattggcctttctagatgtttcttggtaagtctgtagcatttatacacttgaagttattaaaactgcactaaaactttttgagattcactttacatatacacacaaatatatttttctttaccttttgaatttggagtaaaatctagttttatgtttgcttgaaacaacatatataatggagataataaaataactttttttcatttagactgatctcacaatgctgaaattagcagcattagaaagtaataaaatccaggacctggaaaagaaggagggacgtatagatgatttgctcagggtaagtaatgagtcatagaggggaaaaaaattgaataaattatttggcaacagtcaaactgttcagaaaatacttagcattgtaaaaaaatctgtagctaggccaggcgcagtggctcatgcctgtaatcccagcactttgggaggtcgaggcgggcagatcacaaggttgagagatcaagagcatcctggccaacatggtgaaaccccgtttctactaaaaatacaaaaattggctgggcatggtggtgcgtgcctgtagtgccagctacttgggaggctgaggcagcagaaatgcttgaacccgggaggtggagattgcagtgagctgagatcacgtcactgtactccagcctggcgacagagtgagactctgtctcagaaaaaaaaaaaattctgtagctagaactcaataagctttttctgttagtttaagtacatgattgaaaaataccaattttaaagtgaaatattttattagatcttcaataaattgggaattgagaaactgttggagaactggaagttaataacatttatatgaccaactaccataacacaaat

SEQ ID NO: 97208 - DNA, 2461 bp, Homo sapiens
tgttagagggaagggacctattataattctttttatatagtgccatgaacacttgggtatcttgagaatgatattctgtttaaaatagttgattatgttcactaaggtctatgggtaaacattttgaaatttcttgggattagggactatatggctcaataaacatttgtaggggacctgtgctaagatttggggggaaaacaaaatatgtttattgctttggaggaatttatttgtctttgagttgaccaaaataacagatgatagtcagaatatagagtaataaggatctttataaaacagtctcgtcatgttcttgtgatcagtagtctcttagtcttttaggacttggctgaccttgtgttttttttttttgttctggacccatttaaatgactacttattttaaaattaggtatatttagattaattcttaatgtcatatctgaaataactgtctgagcctgctttagtaaataataatgcttcctttttcttttactcagtaccagggtggaaatggctcaagtccagtaagaggcatacctcctgcaatccgttctcctcaaaattcacattcacattccactccttcctcatctgtaagtcatctttcaagtttttcatgtgtagtctttgggagggttatgtacactgaataagttttataatttgttgttttttattgagaacttctatataaataagttagcatttatcttttaatacattatttctgtgacatgaattaaatccttttaagttatctggtgctattggaattttatttctggaagtgagcctcttaaagattttctgaattaattatatccaagaagcattgtttatgttaaaagaatgcctgttgagtctgtgggactaacatgagtactcttgtatcagtctgtattcagttgttgattcctaatttataactttcttaacaattgaatttcttaaccactaaaatgatagcataattcctttctgggaatccttaagaaaaaggcagggtatgtagttcagtataggaaaagaatcatggacttaaaattatcttaaactttttggttttttcataacattttagatatagttcttttatatgcattgttttgcatattggatttcatttttaaatttactttcattgtgtgaaagttcaatatctaactagaaaaacaatattggttttcagtaatttaaagaggaattaaagatttttaaaaatcagagtttcacttatttattcaaacatcttgtttttatgtcttgtgtccccttcttgtcctttgtctttagacatacttggttttgttttactcattttgtacctttcaggatatcacattgccgtgtataaaagtaaggcataagattcaacagtaactaagagttgtagtgatagcgctgatacaatgttataatctgctttcagtgagtgtctttttgaactagtgaccagataaactatgaaattcattgataaattgatattaaactacatatgggcgtgtattattgtccctagtaagtttgttttttcaactatcataatcattgtttaatatttttcagaataatttatttggccttattttttttttaactgtatgaaagcattaagatttcttttatggcactagaatgtaagctctatgagggcagggaatatattgttgtatttctcactgggtcttatgtaggaggtacttaatgaacacttgttgaataaatggtgattaaaggttttaaaagtcaattatgtttcaatttaggtattattctgatagaaacttcttcagaaatgttaagtaattgttgctaattagaaatctgttttgttttgtgttttttttttttttttttgctaatataaaaattttaataatttctttaggttcgaccgaatagcccttctcctactgcattagcatttggggaccaccctattgtacaaccaaagcaattatcctttaaaattattcaggtaaatgataattaaaatgtttttttctatggcttctaagaaaccattgactaacttactaacaactaagatgtctgtttgttttatatgtagtcataaagcagaattacacatcaagaaagataacttactaaacaaaaacaacagaatttgtaggaaggagtgagaaactgaaacacacaatttactatcagctttttaaacaaccgttaacatgtcagttctgtttactgattctttctgaacttaatttccaagtatatgtaattgatattttgtgaaactgctgtattttttagaagtggacattaaagcctctcatttgactgtatttattaaatacgtatatgtgacaaattataaacattatttgaattatttgtatattttctatacttatttagtttcatgaatttgagcactaagtttttcattttaattttttacatgtgacagtttctgagtggcact

SEQ ID NO: 97209 - DNA, 1047 bp, Homo sapiens
gctggttcactttgtcagcgtggtcatatatgagcaatatttacaatctagtttttaaaaaacattgtatttaatttgggaatgctttttagaaaatcaaaatacattttacaaaataacattcctattgaagtgtgttactgtcagtttgacaggaatcatgttatggtttgtataactaaagctgttttattattatttacaagtaaaggttagtttgtcagtgatgcagtcgctacttttttatttactgatttgcttttctgaaattagtagttattaagcagtattaataatgtagttttaaaacaggacatcacttacatcatttatttgtaagattctccaataactggaacttttaaaaattggcatgtctctattgaaatgtcatttgattttcatatttgtgaaattgatagctgatgtcctgcggactcttaatatttttttgatgcccatcactaccctactaacatcatgcgcttcttatattttaggaaaaagtattgggggacgtggccacaaaattagcgactattttgaagtaagttcattgaggattgtctccatttcctaattcagtactattctgctgtgagctagaaataatttcttagaagcacaaggtcagcttttgattacttacttgattagagcagagctttattactatgtgatatctttctaggaaaattagatttacatttacattgggatgccatatcatttttttctaaatactttctcacatagttgtttataataacctgtaagataggcaaaatacatattagtgtttcagtttacagatgatgaaactgaagaccagaaatgtaaagtagcctacaccgtaattttttgaatttttgcagtcagaccgtggcagcagtgaccttgagcaataatagaacactaggcataaatgggttaacccatttaaggcaaagtctgaattgaagagtaaagaatagaagttaaagttcactggctctctagttgagaattctttctactatcaagtgtaattattaaaacaacaaacat

SEQ ID NO: 97210 - DNA, 1093 bp, Homo sapiens
cttttttctcatccaagtttacttttatacactaagtatgtttgagtagtaggaaactaaggaaaaacttaataggaaaaaactcataggaaacactaaggtgatttttttccccctcatccagttaagcatttgaaggtcatcttttaaaggctaattattctaggatttttcatccacttcatgtcaaattctgtaactgaatatcagataatatgtacaaggtcttctctacttggaattttaaaatgtatacaataggaaattttatcttttaaataaattgtgtgtaaataacagtatattaacatctcttgagcactactgaatgctatttttttggtctcgaaacatggttttatgttgactgtgataattttgtatattaaaactgtcatttaaaaatctgttatcttgttttctgtagacaccggagaagaaacaatcggaatcatccaggggaagaaagagaaaagcagaaaaccagaatgaaagtagtcagggtaagcacataacatcttccttcagagcctagtggacacttaaaattaattgttttaatttttaaccaattaatactctaattgtaaaataatatgaagttgtaaattttggtgtgtgcacaggtagttagtgtataatgattgcttttaggcttttcaatgttgcccttattgttttcatttgggtcctagaaagacaagtatcatgtccaaatctggcaagcattaacttatgacttttcatttttcattctttatatgtattgtattgaaatggcttgtttttgaattaaaaacttcaatctcactttaacagaactactcaaacttttcccatttatttaaaaaaaaggctatcaaaataattatgagagactctagttaaagtattatctgtttttctttccatcctttcttgcatacctactttttgtgatatgaactaagaaaattattttcatttaactaaatatcttataatgaatagaaaaatagtgttgtcatttaatttgagcactcaaaattaaatataataaattgggctcttaaatcgtgtataatgatgactttatacataatgttacatgtgt

SEQ ID NO: 97211 - DNA, 1057 bp, Homo sapiens
tggaataattcatattgatttctgtccctcatactgtaacagcattgagattcatgtgttcttatgtttggtcttatttacattgaagaaagactcctttatattttattataagataaaagcagcaggctacatgattagatataaaaaccttgattaataatcactgacctaagttccaagtaaaattggaggattagttaaattatatcactacacttcttgagtcctttaaatttgtctttgtgttttttcaacaaactttcaactggtagaaaatactgtgtaaattcacactaatatcttggaatctctaaatgccagagtagtcattcaggttttggtatgattacaaatctaacatttacacagctaacttggtttaaagtgtactagtctctcctttcttcattttctcctaatgactgtttcattgtatattggagctctttggccttttataattactgaatacttttcatctttacttcaaagccaaatcctattattttgccttccgtattaatcttttctttagtggtctatttatagtaggatagctaagaaaaaatagagaataaaagaaagaaatgacagcattattagcaagagcagtcttgaaaatgttctatataaaatgtttaatatgtgcacattatataccttagcaaatacataggtggcctggttgatgtcctttggatttcctcaaggaaatcattggtcatgatcagtagttttttttaaaagctgtcgaactattttttcaaaggaaatctcatctggaatctcaatattaaaataggagatgctgtgtttgcagattcagggtagaggtaacataggatatgtctctggtaggctggagccttaactcagccacacacttccttcccttctccttcccctttaataacttctggggcacaacagtcttaaaattaattttagtcctgttaccctttttcttctccatctgtaaattcttctctggtttaaaggaggtaaacttgttgccttctttactataattataatgcattcgtttgctttttgg

SEQ ID NO: 97212 - DNA, 1112 bp, Homo sapiens
gtataccagagaaataattgtacagacctagggattcgtgttcaaaggaatgtttgtaggggtatgatacaggagtatgttactccattgtgagtgtcacaatgggtcaaaagttgtgagaccacagctctgaatttgactattacaagcactttcaaaatgccaacatttccagaataaattatctgaaagtgttacttcccaacccccacccttcagcagttgttctaaatggctgttttattcttgtatgatttgaaaactactggcaaggtaatttgagtaggggagaaagttcaactttattctaattttatagtatatactgtttaacaaataaagccttaaagggatagccagagaagggaaagtgccaggaaatagactacgtaagtgataagaaaataacagacaaaatcattttcatcaatattaaaaacttagtatactcctttaaacatgtgtgaatgcagtgggtccaagtgataggagtttaagaagtcacaatgtgaggatgtcaagttaggtagttgttaaaaattgagcataaaataattgttttaatattacatttctttggagtactgatacggttgtgaatgctgtgcatgtgtaaatagagtccttcagcctttacaaaaatgtatgaggtggcatactttaagtatacctgtaagacagcacatattttagttgggtggttacccaatttcttcttactggtgttctaccatcttttatattacacgttattaaacaataaaggcagtacagcagaaaatatactacactccaaattgctgatatgatgattttgatttacttagaattgcaaggaaatgcttttatttgatgataggattccaaaattttacatacataaattttttatactaaatattaaaatcagcattatagtagagatcttcttttagaggtcaaaggttcaagtaaatatttacagataatagttatcaatattaaagttttaactcttgggcagagacagactatgtgaatttcaggtcataccagctcaaaatcatccttgaattcggatgtgcatatttcatggtaacgtttatatgtaaataggatacaaagcagcaaac

SEQ ID NO: 97213 - DNA, 1053 bp, Homo sapiens
attgttgagtgaaataagccaggcacagaaagacaaacttcacatgttctcacttatttgtgggagctaaaaattaagacaatgcaacttatggggaaagagggtaaaaagatggttactagagtctgggaagagtggtggtggtggggagggggaatggttaatgggtacaaaaatagaaagacttagtaagacctagtatttgctagcacaacagagtgtgtatagtcaaacataatttaattgtatatttaaaaaaaaactataagtggattgtttgtaacacctttgtgttacagttgtttgtaacaactgtatcaaaatatgtaccccataaatatatacacctactgtgtacccacaatgattaaaaaaaaaaaatttaaaaaggaaccttctaagctgattggtggaaacaagattggaagagaaaaatggcctattactgtaagagagtgaagatatttttttaaagtggaacccagtatagttctttaccataataggtgctcagtaaatagctgttgtctacccacctcgttaataggctactacttattctctagcatactcatctcacttgctagcatttcctagtatacaatcaggatgagtgtatctacaaaagcagttttcaaattttgggtctcagggactgctctttaactttaaaaattgaaggaccctaaagagcttttgtttatgttggttacaactatttggtatttaccattttaggatttcaaacaaaatgttgtaaccctagaattcacgaatacataatccataaatcatccagtgagatgtcgtcacatgtcatatagcctctggtaattttcactgtaaactcagaatgaaagtaaaaaagcacaccgtacagttagttttatgtaccaactacaaatgattcttaatgtgttcatcaaagcaaggtttctcacccttaacattattgacgttttgcactggataaattttgaggggtggggttcctgtcctatgcaatgtaggatgtttagcagcatctctgcctctgtacattagatatctaca

SEQ ID NO: 97214 - DNA, 1115 bp, Homo sapiens
tttttgtcttttttctacttgattagtatagacttttttctacttggttagtatagacctatcaacttgataataccagtagttcattagcactcagaaactcttaggcattttgtttcactgttcagaggaaagggaacttcaaaggtggcatctttttagctctgtgttattgaaagcatctagaaatctctaggtagacagtttcgtgcagttctgtgcaggcaccctgacactacaaaggagtatggcatagggctctcactcatcaggctttcccttccacagaaacaactggcaggcagctgaaaggactgtgcaagtgacgggactttatctgcagtaggttcccttgaggtaagcgttagtagcccctgtagcatcagattatcagtttagtttttaaaaaattaacatacttatactaagcctttgaaaattgtaggtttagctctagtcaaagttttttaaaaagtgtatcaagaatgttctcactttatatttcctggactttggaacatttcttgatattttcccagaattgggaatatttagtaatttcacctgcctcctgtttcatagacatttgtgttatgaagagcaataaaataatgttagatatttctcttttctgttcactaaatatgatatttttgatagattttttaaaaaagcaaaacatggtgaaagttagatcacttatcacagttatacattctttataggtacccatattccaaatataagttatagatttaatatttggattttttcagaggaattagtctataagagaattcagcttccctttaaagatcccaaggatcacttttggctatatttttagttaaaacatgtttttgtttcttaaaagaccatactggcatttgaaatgaaacacaatttggttaatcattggatatacttagctttatctgtattgaagttttgacatttggggcagcagtagaaaatcttgaaaaatcttttgggccatgtacgggggctcacgcttgtaatcccagcatgttgggaggcctaggcaggattgcttgagaccaggagttcgagaccagcctgggcaacatggcaaagccccatttctacaagaaaca

SEQ ID NO: 97215 - DNA, 1093 bp, Homo sapiens
ctgtttcctcccatattgataatgataccatacattatctatggttgttgttgacttgtttccatctgatgttttgagggggattcatggagattcttgtcacctagttttgttgtaaatacagtctgtgggtttttggtttactatttagttttatacatttttttggtgggtatttacagatgctcaaacactttgccactgcccttattgtcccagaatctttctaatgtattacttcttaattgctgctgtttcaaatttgataatcttgccataattagattataacttattccaagtactacttgaattgtaattagttcaagcgctatcctttgttgacagcagcttttacagtatccagcatagtactgggcatgtatgcaatggctcagagttgtcactttggaaattaatctaatttcaattatataattatagtctaactggcaacctgttaatagtaggattagcagccactcctgttacaagtgaggtgaaacatgaggatatcaattggcttgcctgtatgtaatgttaattcttgcatcatctttgacatatatgccataatctgtcagccacctggtctaagcatttctggaagactatgatctgatgtactgatggtacaaaaaagtgcacaagataataagtatcatagaagcgtattggaaacaaagcagacatcatcctacagaatgttagctctttctttgttacagttcaaaaatattgtcaaggaaatggagaaattcttgagcaaagcaattaattaaaatggtcgagatggtcaaagatgtttttgaagagatagagttaaaacaaattttaaaaaaaagaaaaacaggacagtttgttaatacagagaaaggcaaagaggtgtgtttcagacatgatggaatttgataattgtgaagggacctgaagagcccaaataatactttcagccaaaggtagcattagtttttaatacattgagtaataattttagggatcttgtcatcctaacaatggcccagttcctttgcttttgaactgggatttaaaaaaccagctaatagaagtcagttcctaaaacacagcagaa

SEQ ID NO: 97216 - DNA, 1032 bp, Homo sapiens
aagtgattctcctgcctcagcctcccaagtatctgggaattacaggtgtgcaccatcacgcctggctaattttgtatttttagtagagacagggtttcaccatgttggtcaggctggtctcgaactcctgacctcaggtgatctgcccgcctccgcctcccaaagtgctgggattacaggcatgagccactgtgcccagccatcagagacattttcttgaattacagtttttactattttctggctttagtagtttttagggtcttctgttatctgtatattgatctttgttgcttcatcatcagctgtagcttactctcaaatacttttcatctcttcatttcttttgatttcaaaaatgtccctgttttttgccttctggttatcttaaagcattatctactgtatatatttgctcttgggttcattcagatatactttttatttctgaaacttttatttttaatgctttcttgagttctgttaccttatttccgagttttttgaaatctgatttatatagttgtttcatgtcttgagtcctttttgtaatatctcttagttcattttaaaatagtaggttacaatttttacctattttgtggatgtgtgttcctggtatgcttttattatctggatgttattctgtatcttactttattttttcttatacctttatgacctgcataattttcttttgcctactttcatgtgaaattggatttcctgaacacttaaatggttggtgtggttcaggatggcttttcttacagggctttctctactgctgtttttaggcacgcttcaaaactgtggcatttgctttctgagattgctaggctgtgttccctcccttctttatctgaatattctctttccattattgtaattgtacctatatagtactcaattttcattccacacccagtaatttgtactcattgtaccaccctgttatgtaaagatccgtttcaaggattcgtggaggctagactgctctcactttttaaatgtaaccgtggactcctccca

SEQ ID NO: 97217 - DNA, 1039 bp, Homo sapiens
gaaaagcaggcctgatcttacttacctattctaacttattgattctcctagccttcttaacagtggcattaagaaggtgttgcttggaattttttttttttaatggtttcacatagtttttaagttgaagttcaaattacctgacatttttcggattcctaccttaccactgtagcccagtttcatgccccactttccatcttttcttcacattgtactttgaacagcctatttgtggttccctaaatggatatggtttttcacatctttcctttgaacatacagttcactttgtttcagatgcccatatgccctttcttttcatcagatgcatcactctttgaatgtcaaggtcagatcaggtatcactttaaggatgtttctctgattacctcattccatctaattgcccaaatccaaatctggtggacctcctgtgtccctcttcaacacctgtgtgtacctagacaaaatttttcccatcacattttaattatttgtttcttactagcctactaagctcttgaagacaaaggactgtgtggcatattttaatggtctcagcacttagctctgtgtctactctttagttatgtcctcaattttgggggaatgaaatccttttattataagaaatcaaaacagtgtatcctgattcagaaactttggagacttaggcagtaggaggctaattttgagactggcatatatttttaagagtactgggggaaaattttgaattgcatttagagtttacatggagtcatgtggtccttctggacttgctttaatattatgttcttagcactgcccagtatcagcaagctctttggaactgaaaataaggccagtgtctgtttattttactaattttcctaacttctaacctgttaacatcacgtaaaaaaaaatgtacccatctagttgcttcatttccttagcatatactttaaagtactcatgtgtaaggttccatttagtgtccttggtttgtagacagaggacaaaatccttgccctcagatgcttttagtctgttc

SEQ ID NO: 97218 - DNA, 1295 bp, Homo sapiens
tctgcataataacaataacatcagggtgttaaatttttccccttaattttcaaggtggtttaatactagtaagtgttacttcagtcatctgtgtgtgtggtaaacgtgtttgtgtttcatttacctgatggaaacttaaaactatcaaccgtacaaaaaatcttaaggattgtgacaataataaaacagttctttatagtttaaaatgtagttagttatataagatatacataaacaaaataattaagtggtaatgtcgcatagttacaattctgggtatgctcagaatagggagattacattaggagagtagtattttttaaactatggacccatggtccattgttggtttatgaaatcaatttaattgctatttactagtgtcacctcactcttttttaagtggactaggataggctagaaaatagatgttgtacaggactcttactactgcattgcagtaagatttggtattctgtgaaacttttaaatatatgaatgtttgtaactgtgtactaaattagatggaaaatatatttcttctgtgagttgcagccaaaagtgttggaaatccattgtaggatgttttgataagttgatgtgtacatttaaaaataaagtctctcaatttcgtctgcttgtagcattcattcctaaatttttaacatcttaactaatcacatatatatatttgtgtgtgtaagtataaagtatacacacatatatatgtgtacatatatatttttttttcttaataggtgcaatggatgagcttcatagtctggatccaagaaggcaagagttattggaagctagatttactggagttgcaagtgggagcactggaagtacgggcagttgcagtgttggagctaaagtgagcaaaattctcatctttatttgacagtctttctttctattaaatgatctaaaatagtatgtaaaggattcctacataacgtgcttaacagcaaatgtaacttttataatgtgtagaataagatcagtgttcataaatgcgtttttaatgtagtataccatatttcaggggcattataatacagcataatatgtttcagggataaaaaggagtttggtagattgtactgcctgtctcccactatgtagtttcttatccttcctgcccttattatccatggtcctatctgtacatctaatccacagtttctaactgctgcataaaactttaatagtgtatatcttttaggccaggagtcctcaacccctgggccaaggaccagtaccagtcctgttagtaaccggccacacagcag

SEQ ID NO: 97219 - DNA, 1943 bp, Homo sapiens
tttatagtggcttttgtaatttcttccttttcaaaattataaacatttattgtaataaagaatttgatggattatagtgaatttactttttttccagaaaatttccctcttgaggacagaattttttgttaagggtcaaaaatgacagtttgagtccataaaagattgaaatctttgaagtgtgttttctagaacaggagtaagcaaacttacctatttttacatggctaaaaacatcaaaaaagaataattctttcaggtgatgggtgcaccaaaatctcagaaatcaccgctaaagaacttattcatgtaaccaatcactacctgttcccccaaaacctgttgaaataaaaaataaataattctttgtgacatgtgaaatttgaatttcattttctatttataaataaagtcttattggaacacagctgcttttgctttataatggcagagctgaggagttttgacagaaactgtatatggcattctcattacttcaagctactgtttggtgtaccacaaatttcagtgctgccattattgcttgacggtgttttgagtgccacatctgtgaccagattgcaattttttattttatttgtttatttattaccactgtgtatccatcatgtcaaaaaaaggaaagaagagaaaaatatagacgtgcttttaaggcacattggagtgtgggttattttgttattgaatttaatagcaaaacattgctcttattatgaagtgacactagagctgcaatagaggaatacagtatacatgaaagtaactagactaatcatatactacactatgtccaactctgaggaaagcaatagaaaaattacaaaacttaaaaatggaatatctcatcacagcataatttcttcataaaaatgaaaatgaggctgccaccaaaataagtttccaagtggcttatttgtttgccaagcaaggaaagccatttactgatgttgagttaattaaattgtattttattgaagcagtcaaaaaaattatgtccagagaaaataaacttgttttaggctattagctttttggcaagcacagttgatttaagagttgaggacatttgaagcaacatcactagtcaattaaaaaacaaggcaaatgatttggagtggtttttctcggctcttgatgagccggcagatgttattgatacaattcagttgttctttattcaaggagtcaattccaagtttgaagtggcagaaaagttggcctctgaatagcctgtgcagaacaactacaggcaagaatattttcaaagctgagaaaacactaagtacaatctgaagtggaatctgtaaggatgtgctgcaagcggtggtgatagaatacatacggagcagcaaaaggcttagttggagtaatttacaaagcttgtaaaactgaggagttcatagtttatggttattcattgttattcattggcagatactttgcagaaaatatttccatctatccatgtgtgttactgaatcagtactgtcaactgtgaagtcagtttgctcttttggacttaactagcatcagctgcattaatttttgttagaaacaggacaaatatcctgactggcttagaagtggtaaagtatattttcacaattgtttgagctaaaggctgagattgaaatttttttaataaagagaactgccctcaactgctattaaatactaattagctttggaaattagctttttgtgaagattgagtaatgtttttaaaatgaatttaacctaagatttcaaggcaaaatagtgtctatatttgaaagaatgtggtaaagtcatttcagtggcaactgatattcaaatcccaaataatttcaggctgctttatatatttctcaagctgtcaaagaagttagattgtcattcccacataaatatgagtggacgtattttctagtctcaaactatag

SEQ ID NO: 97220 - DNA, 2546 bp, Homo sapiens
gctggtctcgaactcctgggcacaaaggacctgcctgccttggccttcaaagtgctgggattacagatgtgagacaccactcctggccccttgttgattttcattcattgttttcagttgtgctttaataggtagatcgtattcaacttggacttcttacaaaaagtacttgcagcctcctttttggtcagggatctacttacctgctgtaaagggactttaagaaagaaaaactgttctgtggcccttctttcaccctgtattattgggatagaagaataggccaagaaggagtactgtggagcagtaaatcatcactgtcctttttaaggttcataacaattggttacctctcaggagtgggatttggagacaaggaggtattgggactttttacttttatatttttgtatttatttcaagaagcacctattacttagtaatgagggaaagggatgaaaccaaaaaagagtcttgagtacttaggttagagacaagataccagtctactttctggtagtgaggagagggtaattaccagctcaagttttaccagattcctgttttggagttttcttagagaacattccttcttactgcaggatcaagtacatgctctgtttttctctgtgtctctgacacggacacgtgcacacacacatacacacacacacacacatactcttcctctggacccttcttttgggacagagatgcttagttgagtggatataaactataacaaaaggcagtataacttaacctttcagtgtctcaatttctttatttttaaaatcaggactatatgttaatacagaaatgcagtctagtataaaatacatctatatgtgagtatgtgtatatacatttgtatgtatgtgtatatatatatacatgtacatgtatatacacaatgtgagagattgattttaaaaatagcagattgtcacaagtttgaggctagaggaagaggaacttggttagttgtgttactactatattagcataaagaaattaggcacggaagtatatgtaatcctattatacttagcaggaacttctaaccccaggaagaaagctagaagggggcttattacattatatatgctaatatttattgagcacttatattttagcatacatatatgttcacatttattgaatgctttctaagtgacagatttagttcaaaactattcatagaaacttattttactttaacaactctataaggtatgtacttttattatctccattttctatataaggaagctaaaatagagagagattaaagaacttgaccaaactttacacaacttatcgacctacgtatgtttttgatgaaagaaaaattagttgtcagatttttttattagtaagaataaaattgaaatttaaattattttcattttttaaggtcatggcagtagagagaagcagaaaccctatgctttagtaactctgatgcaagccatatctccttatatgaattatttggtctcagagtatttgaattctttgctgtaagggttgcaacaaaagtgtttaaaaagaccaattatattaaaaagattaggtgaagcattactctgacttggaatgattctagattagacctgtcttctctaccacagggttatataattgaacatgtatacctagattcagggacctgactttctatacttactgttgtcagacatttgggtgaaatcttcggaaagtgtgtgtctgtgtttatgtgtgtatgtgcagtacatatatatctatatatgtagatagatggatagataatatgactcagaaacagataaatagtttagtgaaactatttagtgaataaagtacaaaacagaccgatgtttatggaatgtgataaccagagaggtattttaaattagtgggaaaagtttgaattggtgagaaattgggacattttcctttggaaaaaaattagatatatatctatatataattctaaatggattaatgttctaaatgttaatatttgaaatcattagaaaaaaatgtaggaaatgggtttattgaattcatgtgagggaagggttagaaaaagaaattgggctggttttgtgatagctcatttaactaacatgttcatttaactgccaaaaaattagaatatttggttttaaagtagggaatcaaactgtggaataaataatgcaacatagtatagccaacaaaagttatagctaaatatggtacaaaatattgtcaatgaaaataggtatgttctatttattaaccatgttaaaatggatgtttcaagacaagattcagaagtaattccagtgttatacaatatagacttcttgaattttttctttcttttttttttttttttgagacgggagtctcactctgttggccaggctggagtgcagtgacatgatctcagctcactgcaacctccgcctcccgggttcaagtgattctcgtgcctcagcctcctgagtcgctgggatcacaggtgtgcaccaccacgcctggctaatttttgtattttttagtagaattggggt

SEQ ID NO: 97221 - DNA, 1013 bp, Homo sapiens
cctggccatctttttcttttttaagagataggatcttgttacattgcccaggctggccccaaactcctgagctcaaatgatcctcccacctcagcctccagacactatgcctagctcaattaatatttttaattggcaaatcataattgtatacatttatggggtacagtgtcatgttttgatatatatatatatatatatatatacacacacacacacacaaacacacacataatgtggaatgattaaacaaagctaattaacatatcggtcacctcctttaatttttccagcaagacatttgaaatttattcttttagctattttgaaatacatgtcatatatcattattaactatagtcaccctgctgtgcgatggatctcaaaaacttattttttctgtctaactcaaactttgtgtcctttgaccaacatttcctcatttctcccagcccctggtaaccactattctttctgcttttgtgtgttcaaattttttagattccacatgtaagtgagattatgtggtatttgtctttctgtgcctggcttattttactttgtcctctaagttcatccatgttgtttcaaatgacaggatttccttcttttttaaggctgaataggtccggctcagtggcacatgcctgtaatcctagcactttgggaggcttaggtggaaggattgcttgagctccacctcaagcaccccttgaggtgtgagctgtgatggcactactgctcgccagcttgggcgacagagcaagaccctgtctcaaaaaaaaaaaaaaaaaaaaaaaggccaaatagtattacattgtatatataccacatttttttttttttcctattcatctgttgatggacatttaggttgattctgtatcttggctattgtgaatagtgctgcagtgaacatgggagtgcagatatctccttaacataatgatttcagtttctttggatatatagaaatgggattgctggatgtgagcatcttttcatttcttggc

SEQ ID NO: 97222 - DNA, 1025 bp, Homo sapiens
aaacattttagccattttttttcaaaattgtaattgtggttaaaaaacacacgacataaaatgtaccatcttagccttttcttttcctttcctgtcctgtcttgtcctgtccttttttgagacagcgtctcactctgtcacccaggctggagtgcagtggtgcaacctccgcctcccaggttcacttgcctcagcctctggaggctgccaccctgcctggctacctcttagccatttctaagtcggtagtgttaagtgtattcctgttgttgtgcagctaatctccagaatgttttcgttttgtcaaactgtaactttacacccattaaacaactttctaattcccctctgcccctaggccccagcaaccactattctactttctgtctctgtaagtttcactactctagatacctcacagaactggaatcatatagtatttgtcattttgtgtctgacttatttccctcaacataacgtcttcaaggttcacccatattgtgtcatgtttcagtgtttccttcctttttaaggctgaataatattccatagtacgtgtgtaccacattttgtttatccattcatcttttgattggacatgggttgcttccacttcttgggtatcgtgagtagtgctgctatgaacatgggtgtgcagcaatgtctttgagatcctgctttctattttctatctagctgtaccattttacattcctactgacagtacacaaaggttcccatttttccacaatccttgacaacactttttttcagtgtttttgatggtagccattctaataggtgtgaggtgatatcttattgtatttttttatttacattttgctaataattagtggtgttgagcatctttttctttttttcttgtcgcccacgttggagtgcagtggtgcgacctcagctcactgcagcctctgcctcccgggttcaagcgattctcctgccccaacctctggagtagctgggattacaggtgcccaccaccactcccggctaattttttacat

SEQ ID NO: 97223 - DNA, 1477 bp, Homo sapiens
catctgtgagctacagttcttcaacaggctggagaaacagaccatctaagtcaagcatgctgtggctataaggaacatttattcagatagtatttggtccctattctttgccacataaacagagaggaaaacatttaaattctaaagtatcattatatccacacataatagtgatagttaaaacataagccaggtgcagtggagcatgcctgtagtcccagctacttgggaggctgaggcaggaggatcatttgagcccagaagttgaaaggctgtactgtgctatgatcacaactgtgaattactttttgttttttacatttcaaagatttggcttactgggcaaagggggcgagtatttttatgtcgtttaatctctgttgtcactgttgttttcttagtggaataactgggattttagtctattgttctctgagatgaatcagttgtcagagctatagagttttatagaaaacttattggcatagtttgttcattcagcaagtatttttggacctgaagcctagtaatgaggaaacaaagataaatatgatgaagttagtccttgctttctaggagcttggtcacagtctagtgaggaaggataatttctaacatttaatttatacttttgaagaacaccttgtgggttagataaaacaacccgaattgccagttttcagcttctgagataagctatatcaaggtgttatattcattggtcatttggttgctagaaattaacttaagcaaaacagatttattagtagtagaaggttatagagctgggtatcccttagaccccagttaggccttaaggaggcctactgaggtagaaaccggaaattcaggaatcacagtagcattgttctcttgtggatcattgagcaactgtttccagtgctgtgaaataaagttttctaaaaaggagaagtgggaaggaaggaaattgtatttctgccacagaggttgtgaacaaagtactccctacagaagggagttacacagttttcctccagtttaactgctgttaaaatggtatcttgtttcagttgatatgtcttgattggtagtgagattgaacttaatatttttatcaagagcccaaagccaatttttcttgacgtctgtatcttagacatgagaatatatggtagtgatgttaattcttgttacatttgatgaaactatttccaccgtcatattttttcttttatatatttgaatattttccattgtataaagttttatgcttttattgaattcaataccagttgttctttatattttatttattttcttatcagatgggtcatatgctgatgtcataacaaggtttgagagaggcacctcttgtgtgtgagcacccagtcatcacacttaagaactacaaaagaatcacattcttacagagtctcactctgttgtcccggctggagtatagtggcgcaatcatagctcactgcagcctggaact

SEQ ID NO: 97224 - DNA, 1041 bp, Homo sapiens
atacagttgttattcccatcttcagatgagaaaactgaagcacagagaagtaaagtgacttaccagtgtgacctagagtagtacatgatggggatttgaaccaagttggtgtattttaatcactaggatatattgcctaaaatatgaaaatttggtttttagtattttagtagtttttcctaagcagattttaacttactaatcagacttccaggcttattcattttacttctaaacttttgttaacttttttttgcatgagtttttatacacgtgtgaagataagatttaaaaaaatacaaaaaccccaaccaaacaacccaatttagaaagctgtaccagctgtgcaaatcctacacttcatttttttaagataagttttgtccattcatggaaaatgttagagatacatcaatgaaaaattttatttccatgttagataatctaatttgtaattccatttatcttgatattttggcctcataaacccactggagccataacaagtaaatactagaatttgaacaaaaaacttcccactgtcagtatcggagcagtctatttattgtggaggctttataacctgatggacaaggctttaaactaaattataatgctttagtggcagatctttgactctgttaatagtattcagtatgggcaaggggaagaggatgtgcagtctagctaatctgtaaaaaagtattttaaaaaaatacttagttttaattcttttattgctaacaacaacaacaacaacaacaataacaaaacctttggtagcatgtattatatagcaaacctaattgagaggcaggatttgaatggattgataggaatttatcagtcatggagtggaaagatatgcagagcagagcagatccaggtggtaggttgtcaaacttgaattaaatttttccaatgtggcttcatcattaggtctgaaatttaatgaatttcaagaaggcaatttaacctgtatttaaataaaagtgattatattctacatagattcattagccaaatataagtattttgggg

SEQ ID NO: 97225 - DNA, 1018 bp, Homo sapiens
tcattcctgtgacattagtcgtaatataatttattaggggaaagtttgtagcttttatttattggtgaaagaaatgtttcttgaagaggcagtataacctttgcaaggttatattttgtttttttaagagaatatcatcaggcgaggtgctatgtctcaggcctgtaatcccagctttgggagaccaaggcaagaggattgcttgagtccaggagtttgagactagcctgatcctgtctcaaaaaaaaaaaaaagttagctgggtatggtggcatatgtcggtagtcctagctactggggaggctgaggtgggaggatcccaccttgatcccagcagttcaagactgcagttgatgcagtgagctatgatcatgccactgcactccagcctgggcaacacagtgacaccctgtctcaaaaaagaaaaaagaaaacatcttcattaataccaaagggtatttaagtttatgagcatggtaagtagtgtgataggtagtcttgttttttgtaaaacacttattaatatattaataatataaattgcgtaaataacagtgtgatacccggaagtgaagtaagtaggtgattgttcctcagaaaatattgctggagtttattttatctgggacccctgtgtctgcccctagttaagtgcctgtgttgtttagtgtctcacaggattgtctgtttccatagcatctgcatcatgctacttttattatagttttatttatattgtctactagacagaaaggtcttgaattcagagactatattttgttcattttcgtattttcagtgcacaggaggacatcctctacagagttggcactcaactaaaagttttgtcaaaggactgtttcacatacatcatctctctatatatcatggtatgcacatatttcagacccaggaagatgcttattttagtaattcttaagtgaactatattttagagggtgatatggataacagtaacagtaatagctaaagtttattgtgttcgcacatgttaatt

SEQ ID NO: 97226 - DNA, 2615 bp, Homo sapiens
ctgagaatcagatgattgattatatagaacacttgcattttctttcctgctccaacctgccaattataaataatttgctttacttttttgtaaatagtgaaagcttggtcaaaaagattgtatgggccaggagtggtggctcaagcctgtaatcccagcactttgggaggcctaggcaggtggattgcttgagctcaggagttcaagaccagcctggacaacatggtgaaaccctgtctctacaaaaaatagaaaaattagctgggcatggttcaggaggctgagttgggaggattgcttgagcctgggaggtggaggctgcggtaagcctagatagcgtcattgcattccagcctgggtgacagagtgagatactttctcaaaaaaaagatggcatgatagttcgattaaactgtaaacttcctctgtttccatatttaaagactgcattccttagaagaattaaagtaattgacttcagatgatttagtaatgagatgttaaaaacgaaggtgtaccagatggccctgtaggcctttaattttttgaaatcactagctggaggaggacagggttatgtgtttaaggattctagctcatgaatagatatgtgacagatgtctcctttacaatggcacatttacatattagaggagagagataaaagagagaaaccagaacggaggtttgaaaatcttatgagaaatagactatgctttagccttttggcctcagggcctctttactctcttaacaattattgaggaccccaagagatttaggtttatgtagattatatctactaatatttgctcttttagaaattaaatgacaatttcaaatatatttattaatttaaactgtgttgtaaatagaattttttatgaagaataaatatgtcctaaaaccaaagaaactagaccagtggcattgttttatatttttgcaaatcaccttgatttctggcttacttggagaagacagctggattttttgtctgccttcagtctgttatgatgttttggttgagatatgtgaagagaatccagcttcatgtagatatatggttggaaaaggaaagagtgagtattcttctttggtattacatcaaaattcaacaagtggcagttttttgttttttgttttttaagttactgacaatgtgaaagcatattgtattccaaaaatgtctctaggacctacaggaagtctatggaagatacatttaaagaagagactaacggttgggagacgtgatagctgtctccaggtatttaagaaacttggatttcagtaaataggatttaaaaacctgttaattttaataaataggagggagaatagatccattctcctgctttagaaggcagaccaacgggtgaaaattaggaagacattgaggtcagtctaattttttaccagaatgtaagaactgtatgacaactagacttggaacagtggaacagtggagcaacaatggaactcgcaacagctaacaacaatggaaagaagtagttagttttgagaatttaaagtggactacagggacatattttttggggaggtggagataaattctgtagattcttacgatgagtgctattggattagtgacttaaggcttcatccaatttaaaaatgtaaacattctgtgattttttaaaaatccctaaatatagttaaactatacttatatatattcattaacgtttttgaatgttcttgcaagtcagtagtatgaaactactgttgttgttgactttattactattttgcatttttattgtgcttttcctctgaggatttttctgtcttttcttgtgtcagcaagatcagtcttcatgaaatcttgctaaattccctgtgaaatataataagcttaagacattttagagaaccaaatgctgtttatgatacagtttagtagagttgtaatatatttcagcacagaattttagaatactatgggggctgattttcaattttgtaagagaaattatgagcatagtttatatagtcttttatttgtaattgtttacgtgatttcagaagtaatatgcttaagttattctaatgtttttaaagctagagagtctgaaaagagggaagaagaaagaaaagtgtttaaattgatctcttttgaatttaaaatgcatattaagtataactagaacataaaatgaagaatttaaattctcatcttattcctagaattatacctataatatgtatcattacttataacaattcatattttaattttgcatggcacataatctcttctgtgagttggatttttaggtggtgggaatttaagcataaattctcataactttcttggggtcaatttaatattaataagtgtagtaagtaataatacccagcttgagacctcatgtacttgttgcatttggatttaaagctcatttcctatagaagagctgtagaaatcagtcatgtagtttcataaactccttcatgcttgttaataattttcaagaatcttaaaataaattacaggaatattgttatgaagtagtagaagcagtatggtataggggagaaagtgattgtagttgggatctgaggatagtctttactttgctattaactag

SEQ ID NO: 97227 - DNA, 3564 bp, Homo sapiens
ggagcctcgcgatagtgtttgcacaggcggcgcgtgacgccgccgccgcctgtaactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtaagcaccgccgcgcccgcgcccgctcgcgggcctcctctcccgcgccgcggacccccgcgccccccccccgccccccccgccccggggcttctccgccagaccctggggtgggggatggtggcgaggtggacgcgaggccgcccggctccccggctctggggaggtagtgccctggctgtggatggtggttcgcgggtggcggaggagacggacgagggggtgcgcgctggtggggacggggcgaggcgcatagactcgcctggggttcctgggagccagtcctgcgagggtgggaagcctccccccagacgcgagcccctttctgctccatttgccagtacactcagtactcttaacctcctggcctccggtctctggtgggttttccctcccgctggagccttcgtcctcgagccccctccccttctcccgcgcactcctcccatagaggcggtccccactttgcgagctttgctgcccgggacctggaggatgcccctcgcttgctgggtttctcctttggggagagacgctgaaattatctgggcagactttgatcccctgtgtggccccctagagcaatttaaacgacagactgactcgtgggcaggcttttaaaaccgcccctccagatggttgcaactttctctccttcgccgttgcttcctgcgtgtttgtgcgttatattctctgctgcaagtaggctactgttcttctgtgacagggtcgtgggttttgtgggaaatatctgcgtaaaggttattgcaaacacgcaccaaatcggttacaattgttttctaagttttctggcttcttgcaagcaagtgggctgccaccagatgtagcagttacacagcttgtaaggcaccggcgtgcttttgactaaaatttcaacttgctgtatctaagtatacaacataaaatgaaatttgggagaaaacacatttatggggaatgaataaatgtgcatggaatgtcttttaacgctctttagtctggaaaaagcttagcggtattcatccgcaattggtagacgggctgttcactcctagttgtcgcacacgaggagataggcacattttcaaatgtctggaagttcaaccgtctagtgaatgttttaaagaaatcaagagcttcgatttatgtaggaatcggtgcgagtactttattttgaaaatatctgtcgatatttgctagtcagagccttgacaagtgttaatcaagtgttttgtgccctgaatccagtggttcaggcatagcattctttgtcattttgttcctgtgagcatgtgtgaaagtgacaataggcttaaagattggcatgaatatgctctagaaaattcacggaaagctttgatttatgggatccattaaacatgcggaatacattgacagacgtttccccctttcatcttatcccaacgctgagctttcattgttagaatatagaagtttatttattaaatgactagaaatttagtatatctggtgattcttttgcacttgaaaatttttaaatgaacggtttaaaatgtatttcatagagaagttgatgcttgcttttagcatgcttttacttttgtttgtagtttcattaagatgtttaatgttagtgttatgagtttaaaaagaccattttattgtttcttgtttaaggctatatcatcattcattcattcattcattcattcgtttctcgaatatttattgagccattactgtgagccaggccgtgaactggatactgaggacatagtgttgaattatctcttgatatctgttatcagtattgggaatttgggagacaaaacatctagattgtgagtttctgaggttacttcaacttaaaaacattctgcacttttcctgatgtttgaaaatttggaggggttggaatcatttagcttgaacttccaaataaccataattttttccggcagtttagattacagtgggtttttatgtaacctaaagtagtgagtttctgttaattcatgaaatcataggacaggcttttgtgaaagttacacttcacaccgagtacctgtatagctacagggggatatttctttttgaccaaccagcatgcaagttgaaactattaatcctctctagggttatattcattttgaagcttggcgatgtgttctcagatttcactaacgctaacaggaatatgaagccctgagtgtcaaaatggagatgatttctattgagcgaaatctcagtttttattttaagtgtttagcaccttttccaggtatacatgttagtacattatataaattgatgaagttttagaaagctttttaactgctagttactgctagtaagaaccgttaatattaatggaacttgaatgtattgtatgtatcacggtgaaaactaactttgtttcttgaaaaattgagtcagtttaacatatagtaatagaataattgaaacttaaaagagatacacatgtatgtgaacttacataaatattctatgtgatgaactccttttaggcagacttaactttgaaaatgggttatttttaaaaatatgccataagcatctgtaaaagttacttattttgaagttttgacatttgaaaccacaaacctaagattatgatctgattatttttgatgctgtatgttgtagttttgtttctttttaccttattaccattatcatattcacatagttttatcacaaataaaatacagctctataagatttgggaatctattagaatttaggaaattatgtgataaatatagtatagatttctttccctcgggtcccaaagcttttcgcttgtcagtcttgtggttctgttagaggagttcagcgatgtagctctagattttctgttgaatcttttaaacctataatctccatcccattttgtc

SEQ ID NO: 97228 - DNA, 1061 bp, Homo sapiens
ttctgcaaagccagtttagatgaaaagcaaaatctggttgatcgccgcttacaagttaataggaaaaaacaagtgaaaatgcactgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcggttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgc

SEQ ID NO: 97229 - DNA, 1035 bp, Homo sapiens
ttaaaaaaaaaaaaatcccggaagtctactaagtcctctttttgctttctgttcctttatcatgacagtcacactcgtcctacagagcaacccagtgttttgcctttgttcatgatgtatgtgatgatggcttaccttacccttttccagatgggatcctggatgtcattctccttgtctttgtgctctcttctattcatcctgacaggtaaatgaagacgaaagggcaaagtggatgtgtaaagctcctttatcagtagtggttttcagaactatcaaagcaaaaatgacaatttttgaatttattatttagtgagcaacattatgtataatacacagccttttaaaggcagtttttcctttcttcgtacttttagacagaaactggtcagactacttcattaatgagctttctgtcactgtcagaatgaagtgagcatattctggcaagacacatacctattaaaagtgacagtgcttcaaggaaattacaaattcagaacaacctaatagactcccaagagggaaattgtacttggtgatcagaaacaaacatctttagtgtagtgtcttcctgaatgttcatgaagaggtgggcttgggatctgtttggcttcacacaggcctgttgatgggctttaaaaattttgttctaaagaagcacactagggaatcaggagttattaagatttgccagattatccttggacctttatgatctaaggttagcctgatgccatcatttaaatatttatgacttagtttcatacagtgttttaaaactataaacatagcttttctccagagagaaaacataaagagatattaccagcaattagaatgattacctttcttaaatcttgccatcttctatgtattaaagggtacatatggtaagtaccaggtctgtgctttcataaggtttcttaaaattgggttctcacagttccctggtggaagatacagacttggcgtcaaccactttttgtttgatgagtgtgacccttttccatagaaactgagttaccatgtgct

SEQ ID NO: 97230 - DNA, 1245 bp, Homo sapiens
atgtatatactattctgtgtattttctcttaatattattttcctttattattttattttttatatttatttatttatttatttattgagatggagtttcactcctgttgcccaggctggagtgcaatggcacgatcgcagctcaccgcaacctccgcctcccgggttcaagcaattctcctgcctcagcctcctgagtagctgggattacaggcatgtaccaccacacccggctaattttgtagttttagtagagatggggtttctccatgttggtcaggccggtctcgagctcctgacctcaggtgatctgccctccctggcctcccaaagtgccggtattgtaggcatgagccatcatgccccgcttattatcttttatttttaaattgctacataaggttaccctgtttgaactgcatggtttgcttgctcattcccatgttgttgggcatttgagttttccccactttttcctaatataaatagaactgctatacacacattttttttttaagtagagacagggtcttgctttgttgtccaggctcatcttgaattcctagcctcaagtggtcctcctgcctgggccttccaatgttgggattacaggcatgagccacctcgcctggccgctatgcacatcttttattaggttactcccctgtacttcccccaccccacttaattcctagaggaatattcccacaaattaatcaagatatagtagtattacagtacattctagttactggtaattgggctcaaacacacttcacaagtagcttgatattgtaaactcaaatactagagatttcactaaatataagtcttcttagatggctgctttttgttaggcagaaaatcttttacctgcatggaatgagttacaaagagagttttttttttttaaggtaaaggaagaagagaaagcttgagaagaccctggagaaatttgactcttttataatttctcctgagtctgattttcagagtgtcattttgttttcttacatagtatatcaggcacactccaatttttaaaagtggagatacaccaaaattattgaaaaagaaggaaaatagagatagaaatatttaaaagacaaatatatagtttcagatcaaccataaataggtttctttccattagtgcagaggtgagtatgttttggacttaatatcacataattcttttgttacaaagatccactttcatttctcagaccttaaatacagatgggag

SEQ ID NO: 97231 - DNA, 1049 bp, Homo sapiens
aaactgtcaaggtcttcataaacaaggaaaatctgagatactgtcagaataaataggagcctaagaagatatgatgacatggccgggtgcggtggctcacacctgtaatcccagcactttgggagattgacacgggtggatcatgaggtcaggagatcgagaccatcctggctaacacagtgacaccccatctctactaaaaatacaaaaaattagccgggcatggtggcgggcacctgtagtcccagctactcgggaggctaaggcaggagaaaggcgtgaacccaggaggcggagcttgcagtgagccgagattgcgccactgcgctccagcctggatgacagagtgagactccatctcaaaaaaaaaagacatgatgacatgatctcatgtaataaggggtcccggaacagaaaaaggacattagataaaaattaaggaaattgaataaagtatggacttaagtttataataatgtattactattgagttgttaattataataaatataccataataatgtaagatttaatagtgggggaaactatatcacatatatggaaactctctgtactatctgtaacatttttataaatctgaaattaaaagtttactttaaaaatgcagcaggaatatggtagacaccactatatagggatagcacaacttagtaattaagaagatgaactcacgtaccagcctgcctgggttcagatctcagcctcactgcttagtatctgtgtaaccctggctaccttaagtaactagaactacttaacttctctgtgcttcaatttctttatctgttagtgaagattcttgggaggactaaatgaatttgtgtgtgtgtgcatgtgtatgacttggagtagtgcctagcacaaagcaaaccttatataattgtttgaatctatttattattactacttttgttctttagttttggtgattatggctaaatttcactgcatctctcttcttcagcatactgatttttagcttggcactccaacagaacagtatccataatactttgttttcatgggga

SEQ ID NO: 97232 - DNA, 1094 bp, Homo sapiens
acctggaggcggcagcaccgcgcccccagggctctgcccagctagccactcgcagcacagagaagcgcgcccgcaagacagcgcagcctccgcgggccggaggaggcggggccgcggcaggcagaggcagggccgggcaagccctcgctccccgccgcctgacgggaattgtagttcctgggagaagccgggctgcctcacgaggcactaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggtgaccgccagccggccggggcgggacggagggccgcgggcgcgcggcggccgagcctcctgcggggatgcggttttaacgcgctggggcctccctttatagggtcacatgtgatggggaggaggatacaagcccggaatctgggataggtggtaatagggccaccagctgcttttagttttacgcttcttatgtcttacctggaaacaattattctaaaagttggtcacctcattaagccaaaacatgagggcagagtggaggaaggatgcaaaaagttttaaaataatataggtgacattatgttgctttgaaaatttaaaatctaacttaaagcctaagagttctttcctgaacggaaattctttatgtcttttaggaaagtactaaatttaagaatgtctggacaactcattccaggtcacctatagccta

SEQ ID NO: 97233 - DNA, 1166 bp, Homo sapiens
atggaaagcatttattgagcacttaaaaaatagatatagactgcttttagaggttttctgtttctttatacaccgggacacctagaaaaagcaaatacttattttgtgtctccccttggcagagtctgttgtagttctttctcatttttaatttgaactacttcagctgtttctcactagtgtccttgattgcaaaacaggcaggcactgatctgagttctttacctgtatttactaatttgatcttcagcacactcctttcagtagatacttttatcatcccattttacaggtgaggattctgagccccagagaagctaagtaacttatccagcatcatagtgttggtaaccttggctcaaactcaggcagtttagctctagagtccctgctcttatgcactgtagtaagctgccccttcttgaaatttctgtaatatggactggcaggtgaagtttatatagaactctagcattaaaaaaaaaaaaaagttaagtagttcctttaattttaccttgtttagataactacatcaagcatttccttgtcaaccctccagtgtattcccatacatgctgggtctgtgaactctgcttttcattcctccctcatctctcttgtctactttttctgtatgcccctgaagccaagcaaactatttgttggctacttctacttactttttatcatggttatctgaatgttttcctaccctttactaatcctgcccagtcacattaataacttaactgcatgccttttattggaatctccttacccttttcctgatttatttagtatgacatctaagaaagagagatgctatctctctcttagtaatacttctctctttatactcttactaccttgcttttactttggtaaaggaaaattcagaaaagtgggatagtataaaaaagcaaaacattttgctactttgagaattctaaagtgtcttgtctgatgtacctttttaataatttaaattgctaaagagcaagaatttttgttttgttttgttttgttttgagacggagtctcgctttgttgccaggctagagtgtcgtggtgagctctcagctcactgcatcctctgcctcccaggttcaagcaattctcctgactcagcctcctgagtagctgggactacaggcgtgcaccaccag

SEQ ID NO: 97234 - DNA, 1047 bp, Homo sapiens
tgctggctctcctactcttttaatacttctctctgatatccttgtgaacatccttgctttctcgaaacaacagattgtccacacccatcataaaattttcttaccacaagacatggaatcagctactctgagaatttttaggcctttttcattgagaatattagagatcaaaattggggctcttgggttcacagggcacattagagttgtgggcagagtaatagtgctacttttgggtcattttttgcatttactgggaaaggtatttctttttaagtacatctgtttgtactgtttttttttttttttctattttgaattcctatgtcctctatattgaatttcatattctttatatattaaatttcacattctctataacatacctagttgatttcaaccccaaattccaactctaattgtatgtttttcttttaataatttttctcttcttcatccaccatatcatcacatacaatgtgtgtatttctcttataatttaccaactcatgcctttttccctttttctattggggtgtttatattttttattgcttaaaagacctttatatattaaagatactacccttttcttaaaagattaaaaaaataagcacttgacatatatttgatatgtttatgcctgtctcttctttttcctcaagattttttgtgaaccactttttatgaaagttgaccctttacacaggtttgaactgcacaagtccacttatacacagatttttttcaataaatacaggaaaattttttggagatttgccacaattaaaaaaaaaatcacagatgaaccgcatagcctagaaatatggaaaaaattaagaaaaaggtacatgatgagtgcatcaaacatatgtagatactagtttatgtgttaattgactatttatgttattggtaaggcttctggtcaacagtaggctattagtagttaagttttggggaagtcaaaagtttggctgggcacagtggctcacctgtaatccaagcactttgggaggccgaggcaggcggatcgcttgtggccag

SEQ ID NO: 97235 - DNA, 1037 bp, Homo sapiens
aaactaaaaattaaattctcaagttagagggtaaataaggcagtcataggttagccacctgcccaaacagaccatgtggtgtttcctaaaggctgcttgaaatgaattcaggtcttctaaaattgctataccttctatttatgcatctaagaatagatctattatgccctacttaaagttgtgataaaagaagatgactaaaaatttctcttggtgctttttagcaccaagagaaatttattttacagtgtcagtcttcaaaagaaactgactggatatatctgaactaccttaaagttaacttgtctgatgataatagtggtagtagtgactatcctgtaataaagctttcattgtgacaggccctttcctaagtggttacattcattgggactaatactcctctgtactggaaatcttaagcaagatagatgtatacctgagtatacctgttagtccaggatgtggaagatctcttcctcacatttgaaggcattattagacctaattaccttgtaggattattatgagagttggaaatagtatctaacccagagtctttacatagtagatgttcaataaatgtccgctacttttattaaatgtactttgtcatttcttaccatcataaacacctttagcccagtttcaatctctactcacctgcgggccacatatacctcctgaaaacagatacctagaaagttgattcagcctaatttaggttccgactggctgtttcttttcttacaataaactccttacctgattgtattttatttccttgaacatagtaatttttcattaatagaaatttatagatgttgcatgcaaagaaaggttgaattcagttaatgaatagtccagagcccccagaacagtgcagctaatgaattccttttcctgtctctacagacatgccaccactgctctttgaggtgtcatccctggagaatgcttttcagattggaggccatccttggcactacatcgtcacacctaataagaagaaacagaaaggagttttccatatttgt

SEQ ID NO: 97236 - DNA, 1015 bp, Homo sapiens
tttgataccagcctgggcaacatagcgagactctatctctatttaaaaaaaaacaaacaacatacaccaaaaaaaattgggcaaatgatttattctatttgtgtatcagttttcagtacttcctttgagtgttattaagattaaatgaaacagtgcctataaagcatcaaacgcagttcctgacacaaagtagatgcttgagatatggtatctcttgggttattaactcctgtttgtgagatatagggtatgttacagaacaaatccatgacatttctgaatttaaatgttcagaatttctcaaatttgcatgtcctcatttggccctcaaatatattccactttaactggttaatattttttcttccgtgtacctttgacctactgatctatcacttgggttagatttgtaaaatcatttgattttcccttaatctttgtctttaatacttttttccaacttcaggcaaaaaatgggatccaagaaatggattgttgttctctagaatctgactggatctatttccatcctgatgcttctggtagaataatacatgttggtccaaatcaagtcaagtgagtaatctcattagcacttgaaagttaagagcagcttttggtagcatttattggcatctttatttttgccagcgaactagtgagccaattaatggaaataattagcttgttgttgggtgcttcctcagagactggcatacagaacacctgaatttattctttgagactcaacattactgtttgtaaatattaaatttgaaaacgttatttgatggatgatatgcaagtaaaagggaattacagactggccctttctcatcaggtcttagttaattctatagggttaataagaaagaagagtatttgtctttgttctgaaaggcagcctagacacaggaaaggaagtagattgtttgaagtaaatcttgttttattttgattggtttcagggcacacacaactcccacaaactgacctctccttcccttaaacactt

SEQ ID NO: 97237 - DNA, 1034 bp, Homo sapiens
aaaaaataaaaaataacaaagggaagtgtctgcctttattttttatgcttcgtagtaatcagtctacctctctggatctatttaatataaggaagatgaaaggatttaatgaaataagattatttttacacattttaaactgtggttccgcttcagtaagccttacttttaatgtttgttaccacccatattagtttgaacttaagaaaacaaggcccacgaagagtgtatggccttttgccaggttttacaatataagcatttaaaaatattgccactaaaaaaactaagtgaataatttaaattattatttgatctcttggtctttgggaactctgaggtctccagcactctctggacacatagctgcttctctctgctgttctttttttttttgcatttgagactttgagcttgtaaaacattgtgcttttgaagcttgttaacaatgtaaacagatttctgtgggtggtgagcaaattattttattttcttttaataggcttgatccatgaggccatttgcactccaaacccccaaatctttaaatataaccaatcctaagaaaaaagaatagtattttcagttgtagtttttaaatattaatctatcatgaaaactcttagtttctatttaggtatagatttaattgctgattgaatttctttttagttaaccctaagtgttgctcatagatatctcatcctacttcagaaataaaaatgcaaatatctgctttaattgttagagctgaaatgttagagacctgttacagcatagcagaggtaaggttcttcagagtaactttcattaagccagtttggaaaatagcttaggcctgaccaagctgatcattacctacttcagtggcacctgttgtcacagttcccacgtttttctgtttaacagaatctccgaatttgaaggagttcatggacatttagtgatcacttattagtattgtagactaatcaagagaactacctcagtgttactataatttttatttgttgagttttacttcagtacttaaa

SEQ ID NO: 97238 - DNA, 1052 bp, Homo sapiens
ctgaaatagaaaataatagttctcagcatcagatctctgaagattttgtcattttggccaacagggagaaccataaagtaagtcaagagtactttaaaatcctttatatatcattgtctttctatataagactataatatgctaatatatttgcctttgagtgtagcagaaaacaacagcacagccctataaaagtctgtacattttgtctacatgggtagccagttttagccccatgtacatttcagatttaaagaaagttgactatcttgagtttgtcttttgctgatttccgcttcttttctgagtttccttttaagtttttattgatgaattatcaacctttgggtctaattaattgtgcaaacttaaatttaattggggtaatatataagtctttaaaaatcacataccatactttaactccagatggtacttttcttttagtgtataaattaagaccacaaagaaaattatggggagaacaatttcaaaaacagatccactttttatttgctgtgctatatactaaggcaaaagtcaggtgaatgaggcagctaatctataatcttttaaataattttttttttgcccattctggcattttagccattaaaaactttaataaagtatttttgagccgggcatggtggctcacacctgtaatctcagcactttggaaggccaaggcagacagattgcttgagttcaggagttcgagatcaccctgggtgacatggtaaaccctgtctctacaaaaagtagaaaattagccaggcatggtggtgtatgcctgtagccccagctactggggaggctgagctgggaggatcacttgagcctgggaggcagaggatgcagtgagccaagattgtgccactacagtgaggcaagatcgcaccacggcactccagcctaggcgacagaatgagaccctgtctcaaaatatgaaacggaggatcagaaatctgattcagaattttctcagttgaggaaagaattgtggatgtgggagaagggttggtaagttttaccaaatttgttaatacagt

SEQ ID NO: 97239 - DNA, 1019 bp, Homo sapiens
gggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacat

SEQ ID NO: 97240 - DNA, 1057 bp, Homo sapiens
cccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctact

SEQ ID NO: 97241 - DNA, 1058 bp, Homo sapiens
gtattctttcgtatgaatatatcacagtttgtttttttatctttctgttgatggacactgggctctttctgcttgttttttactgttatgaataaagctgctatgaacattcttagacaattcttttgtgaacatgtgtctttatttctcttgggtaaatacctggggatggaattttcgggtccttgggtaggtgtatatttagtttaataagaaactgccagaccttttccccaaaggattgtacgattttacatgcttgcagcaatgtaggagacttccacttgctccacacattctccagcatgtgtggttgttagtcttctttatcttagtatttatgctgggtgtgtaatcatttctagttgatactcagattgtttctacttgtggttagcaaccctcttgtcaacttgacctccttccttccccaggaactgctgaaaacatcctttgtgataatagttaagataccccaaaactcagcttgaattattctttctcaaacatgggatacattgctcatcaaagaaccctgattcctttaatggagatcatagttgggaacaacctgggttctaagggcacgtgttccaccgtttcacatgactactggagctggacaaaatggcactggagaagaggtcacaacaatcattataataaaagcagaaaggtgacttttttcttcaaaagttgagttcgtgttatcatgtacatgataacaggtgaaatcaggtgaattttttttctctaatatgagagcatattaaacaagctgtatccttttctcactaactgtagtattctaggccggatatgttgtgatagcaaattagtatattcaaattttagaggtgcacaaaatttcagaagtatttatttatttatactctttttgactctcaattcaagtgtcttagaatttgtgccaaagtttgcaggttcagttcctttcctcattataacctgagtcctatagaagggtgaaggtggaaaggagggggacactcagcctcctatataggcacattaaaaaacaccatgctgtgaacact

SEQ ID NO: 97242 - DNA, 3150 bp, Homo sapiens
gccggatgtggtggcatgcgcctgtagtcccagctactcaggaggctaaggcaggagaatcacttgaacccgggaggcggaggttgcagtgagccaagattgcgccactgcactccagcctgcgcaacagagcaagactccgtctcaaaaaaaaaaaaaaagttctccaaaggtaaaacaatgtttctggctactctataataatcgtataacccagttcttacatactaaaatgtgccatccaaacagtccaatgtcgtaaaatttggttataagaaaaatgtgccagggcatttctttccttgctaattctctgtcttaggctctctaaacttctcatcagtctgtcagccagtcagtgcttgaatgtgtttttaacggcctcttctctgttgacaactgttctaggctatgttaactatttgtctgtattcttagatctctggcatgtggagccttgtggacctggggaaccactcctcccagagttaactaattcctagagataagaatttgcctgccagcacatctttgatatgcagaccaaccaattagggttccacgccccaacctacctgcttttatcagatcactacaggccctgctgaagttatttaaactgtccaatcataaggttgttctgcttgcttactttgctttcccctttcctcttttcaaaagccacaataaaggcttctgccctttctgcctgctcatctggcttcggtgcttccctatgtggccctgcctgccatgccttgcctcctgtttctaggggactgtgaacataaaaaacctccttccttcatggcattttgtgtctgtgtgttgtactatatctgctcaaaacaatttccaggtaaatttttagacaataggctggaagaacagcagcaagtaagacacaccaaatctgtctttgaaaagctgaagatccttgaaggagcttatattttagcctagggtttatacatttgcatgagcgagggctctaaaataaatagaacctagatgtgatcaagcaccatccttttcttccccatctggctattttctgctaacatatgggataaaggtagtagatgagaattggggaatcaaggatttaatcctaattctcttttgcctggataaagaccagactctgcctagagcacactccacctactaatgcctaggctggggagaaacgaccaggatggggtccttttaattttatcttgccacatgattaggaagatgcaagatgattaggaataggtgtggtgactcacacctgtaatcccagcactttgggaggctgaagcaggaggatcccttgagtccaggagttcaagatcagcctgggcaatatagggaaactctgtttctataaaaaattttaaaaattagctgggtgtgctggcacacacctgtactcccagttactctagagactgaggtgggaggattgcttgagcccaggagtttgaggctggagtgagctgtgatcatgccactgcatttcagcctaggtgacagtgggagagcctgtctcaaaagaaaaaaaaaaaggagggggagggagatgattaggaagacttaccaatgtctttcctgagtgcttcctgccttaccagttttccttaaaccaaacttgcactggatggtgacggaagtgtgaaagcaaagtaactcttggggcccccaaatcactcagctaaagggaaaagtcaagctgggaactgcttagggcaaacctgcctctctattctatccagtcatccctctgctcactgagataaatgcatatctgattgcctcctttgaaaaggctaatcagaaactttaaaaaatgcaaatttctataatctggaagcccctccccatttttagttgtcctgcctttccagaccaaaccaatgtacatcttacatatattaattaatgtctcatgtctccctaaaatgtgtaaaaccaagctgtgccccaaccaccttgggcacatgtcgtcaggacctcgtgaggctatgacatgggcacatgtccttaaccttggcaaaataaactttccaaattgactgggacctgtctcagatacttggagttcacagaagtatttaaaatttaaatggaggatcaggcagatcttacaaagcagtatagtgtggagggaacagaagtcatgcctaggtctaacctactcttcttcccatgctcttcttctcccatgctccccacgtagcacaaaagaggctgtactgaattagacattttgctggaatgcctctcaaagatgctctgctcactccccattctcccagataccttcctcttatccttgtgtctgcttgtcagtccagtgtcttactctgttcccttagtaagagagtttcttcctgcctcttctcaaaggaagaggctatggaccaatacaaatgaaaccttccactgccccagccctgcccacgtggggcaggtggacccagagcctcttgaattggagaactggtagagggctgcttccacagccagtatccccacagtgagagcagaagctaatctctccagttccctcagaggaaaaatccctcagcaatgcaggtgtttgttttagacaacacagtccagccttacatgaagaaagtttattccccccatttaacatgggtttggctatgttctcttcaaagcagtaatccttgctttatttcatcaagaagcctctgaccactctggggcttggcttgcctcatgagtcatggtgccggcagggagttcctttgtcttggtcatctggggcagctttctggtccaaatcttttttttttttttaggcggagtttcactcttattgtccaggctggagtgcaatggcacgatcttggctcactgcaacctccgcctcctgggttcaagcggttctcctgcctcagcctcccaagtagctggaattacaggcacccacctggctaatcttttgtatttttaggagagatggggcttcactatgttagccaggctagtctcgagctcctgacctcgtgatccacccacctctgcctcccaaagtgctcggattacaggcgtgagccactgtgcccagccactggtccaaatctcttaaccagaagaagggaggaaaagagaaagtgggaagggaaagcatgt

SEQ ID NO: 97243 - DNA, 1032 bp, Homo sapiens
ctcgggaggctgaggcaggagaatggcgtgaaccagggaggcggagcttgcagtgagacgagatcacgccactgcactccagcctgggcgacagagcgagactctgtctcaaaaaaaaaaaaaaaaaaaaaaaaacaaacaaaaaaaacacctagatgctagaaacatgctcatgcagaattttttgtccctcacacagatgtagaatgtagagtaagaagacatgttgtgagggttgtggaaagaaaatccaaatcccacccatcaggagatgaggcactgggagccctagatgccatctgtcttttgaacttccacaaaataatgttgcatttcttctggtgcatacagaagtccagtatgctgctcttctgaggatccggcaagatggcagaagtagagcagaagaagaagcggaccttccgcaagttcacctaccgcggcgtggacctggaccagctgctggacatgtcctacgagcagctggagcagccgatgcagctgtacagtgcgcgccagcggcggcggctgaaccggggcctgcggcggaagcagcactccctgctgaagcgcctgcgcaaggccaagaaggaggcgccgcccatggagaagcaggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcacggccggcccggcatcggggccacccactcctcccgcttcatccctctcaagtaatggctcagctaataaaggcgcacatgactccaaaaaaaaaaaaaaaaagaagtccagtatgctaacagaaagtcgtaataagctgcacacagtggtttgctttgtgggataagccgaacatttttcacttctgattgttgactgtgtgttggttcctctctgttttcccctccactctccaccctttgccttggcttg

SEQ ID NO: 97244 - DNA, 1069 bp, Homo sapiens
gtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtttgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagaga

SEQ ID NO: 97245 - DNA, 1084 bp, Homo sapiens
ctgtctcaaaaaataaagtaaaataaaataaaataatgttaaaaaatggttatctttgagacatggtaggataatgggcatttttcattttcttctttttgttttctctgtattttctataattaagtatcacttttgtactaagaaaaacatgtattatcggaatcccgtctgcctcattgacatcatccaaatgtttgcttagtctaatttatcaagaaattgaagataatatatttataattgaaataaatgttttcctaacaccaggaaagaggaactaaagcatttgccaagatcctaacttggtcagataccggaatggcctgagggactatttgctttgcagcattgttaatctccagatcgcagagacataaacatttacaagtcttccgaaggtcatgcaatcactggaagctgggcagtatatacttgtaagaactggacaaaacagaaaaatctggattcttgtaggaactctatcatggtccacgggtgtaatcttgggcaagccgcttaatctctccatctgctacaaaaaacaggtccttttatattcactcaccaattagtgattgaggatgtcttgtgtgcactgctcctaggcactgcctggggctcatgctgaaagctatgaatctgttattttatagactattgcagccagtttaattcatacaccatttccatccttcagcacagaattacctacaattctcatggcttacaactggaataaacctttgtaatctaggtatcgagggctccaaaaaagagagacagttagtaggctttgtaaaagtgacaaaagaggcaaaaatgggaccagacacagtggctcacagatataatcccagcactttgggaggctgaggcgggccgaccacttgaggccaggagttcaagaccagcctggccaacataacaaaacccagtctctattaaaaatacaaaaaattagccaggtgtggtggcacacacctttaatttcacctactccgtaagctgaggcaggagaatcgcttaaacccgggaggcaggaagcgaaggttgctgtgagctgatattgtgccactgcact

SEQ ID NO: 97246 - DNA, 1031 bp, Homo sapiens
atgctatccctcccctccccccagcccacaacagtccccagagtgtgatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcatcatttttatggctgcatagtattccatggtgtatatgtgccacattttcttaatccagtctatcattgttggacatttgggttggctccaagtctttgctattgtgaatagtgccgcaataaacatacatgtgcatgtgtctttatagcagcatgatttatagtcctttgggtatatacccagtaatgggatggctgggtcaaatatcaactattacttacactcaagctagagtgtaaatagcttatactcaagctagagtgtaaatagcttatactcaagctagaagttgagtataaataatagttgatgagctgaaattgtagaatcatggaattattagagaattttgagattaagtcagatttcttcctttcacaggtaagaaaactgaggctcagagagattacatgctatagccaagatcacacaacccaggtgacactaaactggggccctccatgaaccaaatccagcccaccactacctgtttgtggaaataaagttttattgcaacacagttgctcccatttgttgcattgcctatgactgcatttgtactataattacagagttgagtagttgcgagagagactatctggcccacaaagcctaaaatatttactatccagctctttaaacaggttgcccaacccctctctaggcctccggagtcctctgcctccagctagaagaaggggaacaggcatggagaagtatacatgaagcagggactggggaggtggtagggacagccaggcctggagtgaggcacatcatttctgcccatgttccactgacgaacatgagtcacatggtttcacttggttgca

SEQ ID NO: 97247 - DNA, 1013 bp, Homo sapiens
aataatatttatatccctaaacatttccgtgctgagagcaaatttcatttttgttttctaatgatggccataactggcaaaaatgggttctaagggatatctattgcatgatttatacctaatttaaagcttgtaaaacttattgagtcacacagaccaatgggaaaaaacaaagtttataaaaatgttacaagagataatacaatggtattaaactgtgagtctattaatatatttttatcaacagtgaagcatcagcttgatattacaacctgttttgttattttgattaatttttctgatgacttttaagtcaaaatggcatagaatattatggctaacaaaattcactccagacagtgtctgagtaatagttgtctaggtggcatagggatttgagatttacataaaaaaaacttttccttggaaagcttacattttacttgagaagtcttggatgatctgagagtattgaggtttatctagtttaaccagcagattgtgctaaaacgataaatagccgagataaaagctgacaaaaattttcataacaaaatgttttgtgctatgcaaaagtgagtttaattttacaaaacacaatcccaaataaaatgaagactttatacagaagtttgtgatactctttttcaacaaatcatattgtcattcacttaaaatttgttacctcttaaataattacactttaattttttcattgtatgtgatattgtatctaaccttttgtgccacttgggggaagttgtctattattcctgaccatagacagcaatttcatactgtagataattcgaagttgactgtacttcttgaatttgtctgttaggaaaatttttgtggaaactccttgattacatatgaagatagagcagtttagtacatatcatttgaaggttatttactagaactctattgagaatgattttcatttaatgactataaaaagaacttaacctgtactcaaaactaagttcatgccttaaaagtatacagtg

SEQ ID NO: 97248 - DNA, 1084 bp, Homo sapiens
tttttaaaataaaaatgtccctagtgaacatgattggctatagaaaggttttgaagaacattttatatatgatttaaactttgttgagtatttggattagttataagacagtggggaaggtagcatattttatctccagtcattttataaatagattattaataaaaaattttttacagagtatactatctggcataattttcaacaaaggtttttctgagtggggcggaatagtatcttcctcttgattaaatattagcttatctgttgtgaactatttgacttcagagtttttagctgtcagtaattaagagtggagactcaattctggtcaagatagaacattgtagggagcagtaaataaatatgctttgaaaaacaagccaaatgtcattgctttaatttatttagcttatgatatctatttgaaattttcaataatgtgtaggcatgtgagattgtgtttatcaaagcagcatgagctgattaacagttgaattaccagtttctccaaatagctatgaacaaagggttggctgttccttcccagaaaaggttaacactgtatttagatttaagaatttaagtttccaagttagatctacatcttttcctttctttgaggttcttatttctaaatgatgtttccctttcttgttggcagatttaccattataatggaacctgtgaagggttaaaggctttctgaagatctcattaccgttagaaaattaggctaagtgcatttcataatccttaaaacatatgcctacaagtccagtatttatttgtaatttggcctgaaaaatacaggatacggatgaaggccatggctttcaaaccttttttgacagtaaaccacagtaaaaaatctattttgtatcatgacttaggatggatacttgtttttcttttcaatatagaatgtactccttattaaatatttttaaagcatagaagtataaaaacactgggtttattttaaaaaatcaatctattgttttcctaaagtggatttttttttcctactaaaaacaattggtttaaagaaaaaagagatacagctaatcaaacctctcataac

SEQ ID NO: 97249 - DNA, 1050 bp, Homo sapiens
tgattgcctttttgtcctggatagttaaagaagtacagtctttctcacattacctacatgatcagtgactgccatggtttagctttttttttttttctttttttttttcttctgtgacagttgtcaaagaagagaataggtatctgtgctctaaacttctaagaagctgaaattcattaacatattcacctatgtttatattaattcctttactttataccatttaaaacctgttttaggctgtttatgtgcagaactgtggagtaaaggtaatctgattgaatcactgttcttactaagcagatcatatctcagatacttggcaaaaattaattagtaatggtttatgttattttcaaggctgattagacttacaaactgtctttaaaaatgaattccagaagtgagtcttttcttacatttgagaacctgtgagttgattagtgtttctgttttgttttggcctcctgaatgcatgcattcatttgttctcaggggtttattgaagtctgggaatatagtggtatttgccttcttgcataattctagtattctttgatttttctagattaattggattaaaatgtagcagttaccaaataacactatcattcccctttttaaaaattaatattcctccttttgtaatgatagtaatttttttctaggattgtcccttctgtggtatacattatttattattgcaaaatgtagctgtggctcagataatagctaagagtcctttatagagtcttttccatcatttggcttgaacctatatttgggagaaagaagatagttctgggatggagatatttatataattacaaatgtgaagtcactgtgatttattttggctttggctaagaaactgtgataatatggtagcatcacccttttattttttatttctgaaacttttatttcagaactggctgttaatgtatctgtttatctgtgtaattagtatttagcctgtttctgtaaagaattttgattaacattttttaaaaatgtagtctttaaccaagtaaaatactgttgaacttg

SEQ ID NO: 97250 - DNA, 1692 bp, Homo sapiens
atcataatatattatacattttgatagattaccaagcccactgtttttactgcagcgtgtataaacatttagacataattttaaggttcaatgaatgtgactatcctaaaaaacacagacttttaattaaatacttatttctttagttcctatataactaggaacttgccttcttttcagtagactgttaaaagaagggctttcagctcaacataaactgtattagtcacttaatatcatacactgaaaaattattttgaaaagatacttgggattggggacatttatgataaaatttaaccagaagatggcagtgatgatcctcctatactccctgcaacggtaatcaaaaagttttacaaatgtcatagcatgaaatgtgcacgttcagctgttgttatataatgttaaaagttgaggatctaggggaaagcacttgctgtttattttatatactatgaaaaatgtgtatttttctataagaagggattaagaatattttgggtgtctgtatctttgtctgtacacttcagttttttctgaatactggggtaaggaagttcccataagtcttgccttgtttatttgcatgcatcactttatgttatgcataatgtctagaaggcatgctgttttattgcctgtttgcatttttcacccaaattgctggaaactaatgaacattttaaaggagccattcctttagctgcagtcatttctctaaattgatatctttttttgggggggaggcagtgaaatcattttaaacattactttttgaaagaaaaaattattagacaaaagttaatattttaaaataaatcttgagaaactagagattaaataacttaatgaaacatatttcagagttgaattttggcagcaattgtaaataatatttataatctggtgatattaaaagtgaaaagttacaagggggagaaggaatgctctcctttgaaaattagtggccacatttggtgatggatgagatgaagatgcatccttccataatcttgcctttttaaaaaaattataaagctcaaatgcattttgccagaaaaattgcatgaatcttcagcatgcattgttaactttttgtcttttcccctttctttctgctgttcattttcattcatatatttttgatttttggtttgccattgtttttttcttttttgttaattacttcattaaattatttttgaaacgtcataagctgagcaacctctccgtgtagtaacagcggatacctgtctatttcactatttagtccctcctcctatgtctccatcctccaaatctgtgagcactccaagtgaagctggaagccaagactctggagatggcgccgtgggatctaggtacagtaattttccttttaatgttttaatgatagaatgcattcagtgcccaaatactgttgatactttaaagggactctaaatagttgtgtcgagttagtcctaacattttaaaatctaaaatggcatagaaattctctgttggacactgggagaaaaaaaaggtttctttgtttttttttaataatattttaactgtcacatttaattaacttagtactaaatagtcaaccggttttatgctaattattttatattaaaaatagagatattaatgcttttagatttttctgtttaaactttttgttggttattacgtgaatgtttt

SEQ ID NO: 97251 - DNA, 1098 bp, Homo sapiens
aaagcgtttttttttcccttctacaacattaccatagtaaaaatgtttcccaagattaaaaattactatatttattaaatgtctttatttgatattatacattatttttatgtagatactatactgtgtacattatgactcatcgttcctgattttgaatagtagattattttaattcagtgtcagcaagtttgctttcaaaagtactttgacacttaagttttttaaattaatgtgaattaaaacatgtccccatgagttttatggacaacccagagattattagagaccttttagaatattgtaaattaatacagggagtaataatggtaagaaaaatatttattcatgtatagaacaaatattaagttaccaactttattaaaatactatggtttaccacagaagataaaacattcatggtccttgctttcatagaatttacattgtagtgattacatcattaatttaaagatactgttgactttattggaaagccctaagggtagtgtgctatgtttagtgtgaagcatagtttttttaatgataaattgtaaaacacaaaaacaaatagttaatattttttaaagtatttgttcttgttagataatgaatacaaaattggtttcttgtgagtttaacggagagaaaaatcctctttttgagtgaggtgaccttacatctttctttttttctttgagatggcatttccttcttgttgcccaggctggagtgcagtggcacgatcttggctcactgcaacctccacctcccacgttcaagcgattctcctgcctcagcctcccaagtaactgggattacaagcatgcacaaccgcgcccagctaattttgtatttttagtaaagacagggtttcaccatgttggccaggctggtctcgaactcctgacctcaggtgatccacccacctcagcctcccaaagtgctggggtagcaggcttgagccaccgcacccagccacatctttttaaccttaatatgtacgttgtctcctttgagagcacagactcacttggaaacattaattttcaagagggctgagtatattcatttttatgtatatatacacacacacac

SEQ ID NO: 97252 - DNA, 1052 bp, Homo sapiens
cggtgcttaacccataaattacagaagggtcacattttggaaactttagctattttgtatcccagtgggatagtctttggttttattaccaaaaggcttatgtgttgactcatttcctttaccagtatgacaatttcctgcacacatgtaatgctttggggaagattagaatatgttaaccaagatgttttaatgtgtttgttttcattaggaatcttaaaatttcaaccattttatagcctagcttgttatccataaataattaacttgggttgtctgactttagttgttctaaagcagatctattattatacaatattagtttcccataatctgcaaataatgtcttttaactattctgggttgtatgcttgcatctttaaccataggaagcctattgcatgcactagatgattgagtgacctggtggatttcttgttttgttttcgattttttttttttaatactaaccagaacatgtgttttttaattgtgaatagtactttagctttagctattcatagaatgtatttgcttgactaacttatggccttttttgctaatgcttcatggttgtcctacaaccatttaggacgctgcattgggatacagatccatcagttcttcagcttcactcagattccgatttggggtattgaatagattttttaccttccctgttttataatgaatttgattctttgtgaaactgtcctaattttattttgcttaagtttataatattgtatcacgtagtaaggacaagagttatattttactgtgacacctcatttatccagtatctttagtgaaagaatattctgtgtgatgttctatgtaccctgagtccatttaagtgtccaaatgtttaaaattatttctatgtttttaatacaagttttgtaggatgtattaaaaaacttctcagacttcttctaatattctacatgtaattgaaccttttcagggttacttgatatgaatattaatttatttttctgtattaaaattcactgatgatttctaagattttgagaataatggagatgctg

SEQ ID NO: 97253 - DNA, 1629 bp, Homo sapiens
ttttaattttgttgacatagagataagattatccatccattcattcattcagttatttattctagattctaatgcaaattataaatgtttgctgctgccattttgcctgactcagatagcccttttcccctgataatttacagcttcaaaaacatatgaatataccttttggaattgtgtctaaagtaaggtaaataagccttgatttgaggcatgtaagaaaaatatatgagtttcttgtacttgaactggaagccctctgtagtggccacactgaggcttccccctcctgcctcccattgcttccttattttcagtaaaagtggcttttggataagtgaggtattacttccctacccacctcctcctataaaatcttggaatatttcgtttgtttagtattatggttttttctgttagactctgtatgcattcaagttggtaattgattcctaatattgttggcttgacgatttttttccagctatgtgagtgatttactttttatataatttgcatcttaaaaatcagaatataaagtttcttatttcaaattttattcttagacttctagattacttcagattacttaaattgtccacttaattctttgactatactttttttttccctttcttttttatttctaaactagaaaagacattaaaaaattgttatggcccacattttggaacattaatttttaaaatgtactaattttattatactttatagtactttgttatgctttattagattgtataggacttggatttagttactaaatagaactgaaaagaatatttatataagaaaaaagttatattaccagcgatagcctgctttatattctgaaagttgcagcagtgtctttattgtatatccttttaaggcagcttcatcactgagaacttttttgggagtctggaagcgtactttatttggtttaggatttaaacatctaataaaaccaataaaagatctcccagatagctaataaaatatatttttcttttggttcattttcctcagccacagctctcttccattgtcaaaaaagaatgtataccctgtatttctaaacagaagtgactttagtagatttatggtattcaaaagatctgtcactttagtctaagtgtagaatatctggaccttagtttctccataatgtgaatcaaggacagtattgatcatgcagagattagagatttaaaagttttaaatatttcattttaaagtccaaattgatagtgtaattctcaatttctgccaaatataagtagaaaaaaagctttcaacagaaacctgtttttcagtcgtaaagctgaattctcctagtggcacaatcagctaaatgtggtctgagtgatatctagtctgattcttaaaaaaaagtccagaaagaaccatatcccagctgaaaccagttcttacgacaaccttattcagtggtccactctgaagttcctattctcttacttcattattgcccgcacatttgttctaaaaaaatgaaattacttgcctttttaaaatgaaaataaaaacactgaatgattcagaaatatcttttgcttttgctaccttctcattcttttgctaaaataaagccaatttattgttaat

SEQ ID NO: 97254 - DNA, 1007 bp, Homo sapiens
gacttttagaactcagtgtcagcttcctttataccaggaataaccagactaccttgtaagttagggatttttcataggatattaagttatcttaaaatgggatgcaccagtacaataaaactacatagtaaattgatagacaacaaacatatttcctaaacaacagtgcactaatgatgggatttgtttttcacttcatattgagatttaatcattaaaagtgatagattcataagtagcaatgtttgttcagtaaggattttctaagatactgtatattaccttttaaatgtcttgtaatattttaaaataattcagagtatgctttgtggcatactcttagcttatcttaaatgtatcttaaatgtaaaatgtatcttaaatgtactgtgaggtacagatgagaaaacttgctctgaagtctccttccttcagtttaacaaaagccacccatttcacagatgatttaactttgattaacttactccattgtaagagattattccaacaactggaatttcattctttcgtgttacttgtaggtgcagcttaatttacaaaacagcttttctttctgtctcaccaaaatacatcacaattttgatgttaactcaaagtaaaaattcagtggttcattaaacctagttttagcattcattgacaagagatttgtcattttaaaagtaactgctacttttatgcactctttactgctcagtttataaccttagattccttgtcagagaaagcgtggagttaaccactttagcatattgtaatgaatattcatcaataaattgatgtgacatggcagccccatttttcagtcttcctgctctgttacagtcttttccagttttaaatatagcttatcatgtaataaggactagcttagaaaatcttcagaactgtaattttatatttttggccacgttaatagtcctttggtagctatcatattagcttataacaagaaaagcatatttgtttcagaagaacatttttta

SEQ ID NO: 97255 - DNA, 2453 bp, Homo sapiens
tttaagaacagcattatcatttgtttttatgttccttgaaatttatttaatcatttttatgaagcttaagtaccaatgatagttttaaagtctggttttaatccatgtagaaagggagggtatgtactttaattctaaaataaaaccctgagagcatgtatttaaatagttgatactcatgattcagctacaactgaaataatttatatggacaaataggcatggcaaatgctgtatagtacacagatatagatcactgtctgacatatttcatctacattttaaattttaaaaggaaaagagtgtctataaacaagatcttttctgttaaatatgtaaattatgaggtcacttagcactaaagtactgaccatatgcattatgacaggaatttgacacctgtcattggaaatggtacttagaggccgtataatacaacaaagttgaaggaggagaataagatgtgggtaggaggctgtaatttataattcatagtgctcaagaatgacctgtcctgggtgattcaaaattcctatctttgattttaggatttacatacagtgaaacctactagtaaacacttgattaggataactggtagcattagcagaaagtggaaaatatatgtatattcttacagtgaatttttagttgaaatagatgtcctattattctaaaagacagcttgtaagttaaatgtaattaaactattttgttacattacacctgcaggtgactttatggaagaatttcattctaatgcttgagtaatatagtatagaattgctaccaattatactattttcagattaataattcgttgtatatgagaattcatctaaaaaggagtagtgtctttctgtttctctatgtgattattttgccccaaaaagctttcatttttttaagtagcacaaaagctataattggcatgctttgtaaggaagtgtcaatgtgcaagagagtggcgatcactaagaattcttttacgtgttctttcccctttgcaccaccgcctcctcagcagggtcactgagatcactagcttttcttgaaatggccattttcactggcaggtgcattataccctgtattttcagattgtttttccattctgaatgtttggcaggttgattgctctggctgcgttgacggagaaagggctgacaaatgtggttgggctggctgaaaagacagtgattactgttttcctttgtggctgattgaggccgttgaaaggaaaaattttaaccttcaccatttggttcaaaagtatgagcatatattgaaatcactcgtgccatttatcctagttctgtaaacttgtcagaacacaaaaatcgctcaatttcaagtaatgtaggattggcatacgtcattatcattttgattaagttggaggttgtatcattgtgtgcattatacagtgtcatttaaagctttctttccacaggtacagttatatttttattgcctatactatagagttagaaagattttcatagctctctaaacctaacagtatgtgtgtggtttggcagctggtgtggcctacaagctgcattttgtttgctgggtaaaggcttgtctttaggcctcctggagtgctggtaattgcacaggcctgccattggggagagacacaggattggaagcagtgaagcggaagaatgttatgccatcccattgccaccttgtagcagaaagacacaatcccagcagtgccatctggttgttgctgtctagtcagctggcctggctgctgggaccatgacttggcagctggttcccattcttgaccattcttttgtgtacgtcgtatgtatgtgtgttttagataattttgaacatgagtcagggaaatgactacagcaagtaaagtccccttattgaataggttgtcattacttgaactgcactctggtgcagatgcctgctgcctttcccttatagacaaataacgcatgtgtttaggcaataaaaataaacattttcttcataaaaacccatctcagtgtgtagcaaaagaaaaggtgggcagggttatgtgttctataacattttaaaataaatgattttaaattacttcctggtttgggatgtaagagatttagtaattttttagaagtcttgtaaacattgtatattatcccaatgtatacttttattcaaattaagaaaacattattttaagtgcttattgccacatcatgtaacaatagataatgagacttgcatttaaaatgacagaatagaaaatgtggtcttatagctattatcttcaaaatctgcctctcaaatagcaacctgagagttaatgtaagccatctttatgccttatgaaggcccattagacactgatggtttcagatcacaagtaagcagccagctctgtaggctattttagacatttgattttcctcattctacagcattaatgtgtcagcatgcta

SEQ ID NO: 97256 - DNA, 1050 bp, Homo sapiens
tttgaaattgtctagctgtaccttattgcttccttaaaaaaaaattgagtgtccagatttcatctcaaatatagatcaccttcacttcaaagcttttgttttaaaagtagcccagattgtctctcttaaatgtagggtatctttgtttctattacaccacttcagatattggacttttgaggtctgttgtcaacagcatgatgtttacagttccaaaggtacttattgctttagtagagttaccaaatgtggatggaataacactcaacaaagttaattctgataagttatgagcacagagttaagtctgtcaaaatgaagtcaaggcctgatatataaacctataataaaatgtgtatgtaattggtctacttataggagacttctctaacattttcacttttatgaaattagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaaggtatctaaaatatagatgtctgctatttgctcaggtttctgacacaaggtggtgatctaatactacataggaatgatgaaaaccttttaaatcataattgtttgctaatagatgaagcctgctaggaagttacacagagcatgagtgaactactagatgttgtaatttttataaaaatatgctaacaagtatggtaaccctacgcagaatcaaggaccagtcttcccaccacttcagtcttttcgagcatgtaactgtttaccctgaactgcactgggaaaaaagccctgagtatctcgcatagcacctcatacagttgtcattcagctcagcacaaaagctatgcatttgctctttggagagtttttaacaggttattcataactacagtggctcacagagttgatgggaaatagggaaaagagagagagaaactgatttacaataagtcctgtataatatggctatatgtagtaaactggaatccttag

SEQ ID NO: 97257 - DNA, 1048 bp, Homo sapiens
ttgacagatgttcttgaagcatgttctatttctttttttaaacagtatggcatctacaagttaaaaagaaaatgcaatcaatagttgattcttagtttacaataccaggtaattctgtagtgaaacaaattgtaggaactttttctaggctgagttaaatatcataaaatgttatcatacctgttgaatgtatgtcatttttttcccagtgataagtagtttaatgatttgtatgtcatatatggactgtgctaagaatcaacttttctctttcagaataacaagcctttgtattcatttgaagataatgcagactatgtttatgatgttatgtggtcacctacccacccagccctgtttgcctgtgtggatggcatggggagattggatttgtggaatctcaataatgacacagaggtgagcaggaaaataacaaaaattgcattgaaaaatagaaaattggatatttattgaataatttgtgaaattcctttttttccaaagaatgtaaaagggttctgtgattgtagattcatcacaaagaactcaaataagctttgtaccctaaataataaacagcatgctgcgaagaactaaagggagaaataatgttgccaggagcactggggcatttccttttacttctgaaaagcactatcatgtctctaatgtcctggcaaagtctcattcataagataactgggatgtttttcattcataagctagaaagcagatagtttcagactgttgaagtatgttaaccttaattctgaatttctaaattatctcttagccttgatagcattgtatatcatccataaacattaatcttagcctgatttgtttgaaggaaggaaaaatatattttgatttttgatgagttttttctatgaaggattgaaaacagagtgttactataaaatgaatatagaaactatcagatttcctaattgctgtactaaaatcacttattagccattaaatttaattgcaactcttatttatttttagtcacatgtatttttaccagcttagagaagcttaaaaa

SEQ ID NO: 97258 - DNA, 1019 bp, Homo sapiens
gtcaataacaattgttgagagagtcaactcagatctcccacatctcttcctagttagctagaatggtaccaattctgttttcttaatttggattttagtcttagagatttgaagttacaattaaatgtggattgaaatttaatatttctttataacaattttggtattctgtgtatggggttaaattatttggggatgactagtacaaattagaaggatttttttgtcaaatttcaaaattttttaaaaattttatcatacttttagtctgaatccaaacactgaatgtttgctccatgtgtagcaaataaaactcttcttccttagcaaagaagaggcacagtcagattccagggagctggtgccattgtgttggtgccatcatcctggctatctccagctagctcatggaacaagaggctttagacagactcatactgcaccttcagtatgaaccgtttctaggaacactgagtcaaatacaggtttcagctgatagagatacatgctgcacaagtgattcttgtcctttacaactgaaccataatctgcttatgagggcttttgaagtgttttctttttaaatgggttttggccatgtgttttcaaacagcttgacttcttaaagacattaaaacaacaaaaaaggattctttattcaagagaagacctttcaaaataatgtgtctagtcttctgagaattttttatacaaagacttattttcccaaaccattttcaaggatcgactataatgtcattcataatatatcactgaagaagaagaaagttggggaaattcttacctgttttcatctttgtttttaaaaatgtagccagcttgagagaagaattactgttttacatgtttatagaaatcttgatgaaacttttaacactgtcctttattttaaatgactttaggtaccaactgccagcatttctgtggagggtaatcctgctcttaatcgtgtgagatggacccattctggcagagagattgctgtgggtgattctgaa

SEQ ID NO: 97259 - DNA, 1051 bp, Homo sapiens
agtccccgtaattatggaaaggccattcaggtcaattattactttttaacagaaaaattatttgaaaacaaactgaataatagtgggtaaaatgatcttttatttcattgtatataaaacattgtctttcttttaacagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttttcaaattttcatttttactccttacaacttgaatttttccatcttttataaaatatattttttccatatctttctttaagctcctgctgtgagcagccatctcaaatcctatagagctgtgtaccctaaatataccatgtggtatatactatagatctcccagtgcattatgaattgatgtctagataatctgttggtgaaaaaatttcccctaggttaacttttgctttactactttatattctttccatctaagacatatttcctttaaa

SEQ ID NO: 97260 - DNA, 1007 bp, Homo sapiens
tagaaaacagaatgtgaacatttttcttttaataattgtaacaaagatttgttgggagagaaatttccaaataatgagtagtgtatagtgtaaggaataattgacctggaattattggccccaaactctgattcttgctgaagcatctatgagaagtgtgattttagccaagtctgtgccgcattctttatatgtaggaattaagttttgatttaatgatttctgaattttctttcagctctactcaattaaggggtatcagtatgtgaaatggaatatagaaaagtaggcaattctttacttttctatattcagtttcataaattaataccccataattgcccattatataccaaagacaatatctcaagttatctcattgtagcagtgtctgtgagtcaaaacttcaattttagtagagtcacactttctttatatagaaaaattcatgtactcactactcatgtagttactgtatctttaccttcagtttgtaaaaatgactaaaagtagggaaaacaagtgttaaaacataatggataagaaaaggttggaaatcatatggcaaatcacatgttcctcagcctcaaggtgtgtttagttgtgaaagaaagaataaaattgtttaaatatttcactttttgggaatgacttctcccctactcccccagaaaatgcgatgtatacctttgcccattcaactttagtccatatttttaggaacacacaaatttactttaaggaattacctttaaagttgactatataatagcaaaagagaaagtattgagactgtcagtgttgataaagcttctagcaagattaggttgactagaagtgcatcacagttctttatacttttagaactaaaagccttataattttgaaaaatatccagttacagaaattgtaccttatcagttatactttttttctgagtaagaaaacaagctatagctttctggttaatttcttatttttcgttgtttggtttttgtctttttgag

SEQ ID NO: 97261 - DNA, 1104 bp, Homo sapiens
cgggttcgccctttcttccacctttatagaaaacagaaaaattagttttagaaagggctagcgcagagtgaagggagggaagaagaaagagaagaaaagctctatatggtgatttagtggggtctaggttcttactttggaatccaaatgcaaactgttctaaaagtcactcatcaagggcgtgattactaatttggatctaaacatagatcttgacagccacatctacactttgatatggatgtgatttgatgtgcagtatcagaatttatttaccttaccaaagtgctctgggaagacattattgctactgccagtaagctgggatatgagaatgtatgcaaatattttcaagaggcgagcctggagacagaccaagttacttagtatcctgcacagtgctcctcgattgatggctgacagccctgtgactgcaactgtaggctccctggaggccctccaggaacaaaagaattagctttgaaagcaagttattttcaaatgtattagattggtctcatgggagtggaacaaataataatacagttgttttgctactaccacttgttagaaatatataagtagtccatggatatgtgattacaaaagaatcctatgtatgtatctagagtgagatgggaaagtgtcccgcttaccctccttctacctccaccacttcctggcccagaggtaatcactgctaacaggttacagcatgaatatgtagtctgtttttcataactctatagaaatatatgtacatatttatattttagaaacaggattatgttatgtgtgtgttattctgtgtcttgcttttgttcacttaatgtgttttggatatctttccatgtcagtttataaagttttatttttaatggctgcatagtatttcattgtatgggttataatacttttcataaatcttcccttattgatatttattcatttttttcactactgcaaacaatgctgtagtgaatggcagacatctttgtacacatatctttagtgcatgtgaatttcattaggatagatatttggaattgcaattgaaaacttttaagacaagctttatgtttttatacatattgccacattgtt

SEQ ID NO: 97262 - DNA, 1104 bp, Homo sapiens
ttataagtattgatattcacttcccacactacgacaagaatcagcaaaaacagtagtttggtgtcagatacatttagtgactcactaagatgacattatcatttttttatacataaaaatacttgtatcttatttaagaaaaaaaggaggtaaaataattgaaactgaaagggaacgcttgggaattgtcttattaatattgctactttttttttctctctcacagttatttgggatcatgcaatgtagagtgattttttttttaattcaggaaaaaataataataattttcccctgatcacactgcaacagctaataggcttctatgcccttttcccattaatggccagacatctatgtaaagagttttgagttccgctcaagtggttgaagttgcaggctctatagtagatgttagcagtattcctatcttttataaggtactctagataaattaaatgtggttttctcctgaaaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcaggtaggcaggggctggagccatacagaatggctggctggctctagcgtcctcccctgtgactcagtggctatctttaccacatttgtcctggtttcaagtctcccctgcccctgcttctctttttcagctcgagtgtttcgatcctctccccagtttggtgttaccttggtcacttatgaacttctccagcggtggttttacattgattttggaggcctgtaagtcagctgctcaactcctttacaaagaaatcactaagtccaaaacaaatgtttgttctgtctacaaaagcattgttgcaactcttagaaaactgataagacagaacctttaagaccaatgcatttaaaacagtgagcttaagaagcatttgtgttaagcaagtaaaacttgacagagtgacatcgtacataatattaagcagctatttgggggattttagggaagcagcaaatttttttaaaaaa

SEQ ID NO: 97263 - DNA, 1009 bp, Homo sapiens
tgtgcgttgttgggatttggtatgtgtgctaggtaactaatcttcaaagcatacaacaattaaggtgtatgtatttttaaaatgtagtcccagctgggtgcagtggctcacgcctgtaatcttagcattttggaaggccaaggcgagtggatcgcttgagcctagcagttcgagatcagcctgggcaacatggtaagacccccatctctacaaaaaatacaaaaattagctgggcgtggtggtgcacgcttgtagtcccagctactcgggaagctgaggtgggaggatcacctgaacctggggaggttgaggttgcagtgagctgttcctgccactgcactccagcctgggtgacagagtgaggccctgtctcaaacaaacaaacacaaacaaaatgtagtcagttatttctttttattgtaccatttttgtaaagtttcagtagaaagcctattacttgtatacttcaaaaaatttgaagcattgttaaaggagtataaatctcaatcaattatttctaaaagagagaaggaagaggaggaggcagctgtggggtgggggtgggggacacggattggagtactcctgcccagcaggatgttataatttactaatgattacaaacatgaaagaccttagtatttatttaaacataatgtccacatttaacacttggcacccagggactgacactgtctggtagtggcaaatttgggggaattagaataaaaatttgtggttctattcatttttaaatctgctttagttaaaacataaagcagatatgcaaccattatttaagatagtctttgcaaccattatttaaacaagagatttcagggaagtagtaaactttttcaattgatttggtctttaatactagctacaggagcaattacttggattatcattttaacataatttttcatgcagcaatccttttgaaagtattgtttgcttagattgaaacattaaagtgcttccttctgcctgcagtacaacagattca

SEQ ID NO: 97264 - DNA, 1069 bp, Homo sapiens
ataggtgggaattgaacaatgagaacacctggacacagggcagggagcatcacacactggggcctgtcatggggttgggggttgggggttgggggagagatagcagtaggagaaatacctaatgtaaatgatgagttgatgggtgcagcaaaccaacatggcacatgtatacctatgtatcaaacctgcacattgtgcacatgtaccctaaaacttaaagtataataacaaaaaaagaggtggcattttcatcagctctatctctttgatgctcctaaagcattaccttccagacttttttaaaagttctaattcctatgccttttaagaaatagagtacagaaaatatagtagtggatagagttaccattcatatatgttaactggaactttaaaacaagtgtgagatggctgattaattgggcccttatatcttaggtataggactgagtaagccattgtttaataataatttttcttctttagaggccagagggtatggcaaacaataataacggtaactacatttcagctattgacagaaattctgaaccaagagactcagatatttacttagcgcacaaaggtttctgtctttaaagtgtaagcatgacatgattattggcaaacaataataacggtaactacatttcagctattgacagaaattctgaaccaagagactcagatatttacttagcgcacaaaggtttctgtctttaaagtgtaagcatgaccaattcttaaatctatttgcagctcaactaatttcatttgtggtatttgtttcatatttgataacacatggttcgtttcagacttgtttagtccattttgttcttggaaacattaataacttccagttgaattggctgacagtcttggctaaaacttcctcagttgcttgtgaaacctgaagtgatgaggtcagtgaccttggcaacatttaattcagagacactgcctcgggggtcagagagagagagaggttgctccagattctctttgatatgtgtcagtgtggcacatacctgagtcctctgcagagttgctttggaagaggtggact

SEQ ID NO: 97265 - DNA, 1031 bp, Homo sapiens
agcaggcttaagatcagcagtcagcaagcaggcaaacacatatataactcccctttggctggatgatttaaaggatataaaatgtttattgttagcatctttaaaaaatgtatgcaaaaaagtatgctaacaatttggataagctgtgtgctttagaaagctgagcccaacagatgttgaattgtttatttttttcttttccagtttacaaccagcctggggaatttaactttctaaggattatgatttcctttgttttgaggggattcttttaaaatgtcttaagcttgacatatattagtcaataagaatacaacaggcatatgtttttgcttataggagatactcgttaaacaatacttaaaactgcatttttctttgcagttttggcttccttttaaataaatgaatattgaatgctgtgtttctctgaagagaagattatgggagttagtattctataataacgaagccactgtatgccattatgtaggtagcaaaatctgggtatgcttaacagcatgcttttcagagcttttccaagtgtacagtatctgtgtatgtttatatgttgttggttgtaataagggagggaatttggttacattgttattggcagtgttcccagaatagagaagacgcatggctccgtttcttcttcatggactttttgggaagtgttggataactaggctttaaagtaagcatgcttaagaagaggatttatagcctcaagaaaacgtgacattatactgcatttgtaaataattattacatatgtatacagagttttaaggataatctttttcccattttaatgaaaactctgcaatgtttgatgggtaaataatatgggggaaactctttgttgctgggcttgtgtattcatgtctggtacagctatattgctgatgattctgtccctttacctaggtctgataccacaacttataggggttgctccagaaaaggccattaaactgactgtaagtttatctctaactgaatttatgtcatttgtttagattacc

SEQ ID NO: 97266 - DNA, 1048 bp, Homo sapiens
tcacttacaaaatgagatacgtataacaaaaaaatgaagagaacatctctttaaatgaggtctcaacttatttcctatcatacacatatgcttagggagtaggttaaaaatcatttaagattctcaactcttgttttgaaaaacacttaattaaccttgttaaatatcaaactttacgaccataatcataaccttaagggaaagagcgtcttttcctttggcccatttgctcacggcaggcaatcttcttagtgctgagtgttttccttcagcctaaatgctaaaaattcaggacacagtcattaatagggatgacagcggtagcatttcatttatgaatattcatgaagtgaaatccatagcattaattacattaatttacatacctgaatacaagtgagccataagtgataactaagccttaaaaaaatgttgctaaccatatattgtatgttttcttttaaatgttatttaataagggtgaaggtgacatttctgtcaaaaggcatttgggtatttatagttagaaatgtttttagcaaagaattaaagcacagtataatccttcagttttcataggattttgtagggcttataaacattctttaaaggaagaaagtatacagaaaaatatatgcagttgaatacaggagaaaccttttatatgaataagggtattagtggttacttgatgcttatttaggatcataggctttttattctgtgagttttaattcaacatattcttttgaaaggatacatgattgaaaataattcataatctatgagaatgaaatttattttcatccagttttgtgattgagaaactctaagtgggggaaataacattctacatacatttttttttttttttttttttttgaggcagagtcttgctctgtcactcaggctggagtgcagtgatgtgatctcagctcacagcaacctccacctccaggtccaagtgatgctcccacttcagcctcccaagtagctgggattataggcacctgccactatacctgactaatttttgtatttttagtag

SEQ ID NO: 97267 - DNA, 1049 bp, Homo sapiens
ataaaagggattcaatttcattctaccattatataagaattatctaggtagtaatatatacatttattatcaaataattatattttaactcttgaaataacctttaaaaggttaccatgaaataactattccctttaataattgtaatgttacttaattaaatatagtaatttgttctaatttgctttccatttttaattttttttaacttgaagatgaaacacttctttttgttagaccttaaaagtaagaaattaattaatttgggactagaaacagctaattaattaagttagatcctaaaaatctttaataatctgctacaatatttgtagccctaaatattttctgctatctttattattttaattgttttgtaaactttaacatattttacaacttcgaagtttcacatagatttaaggatcatcttttgtgttggttagaaaccaggatcccacaaattgctattgggttaattctttgctttttaaatttgtatttatgtaaggtgaaaacgcttgacctattgaaaactttgaagtatttgtccctacttagggaagaaatgaatcctgcattccatttcaaagaaaagatgagaatcccatctccccagtgacatccaatgccttcttccaactttgctgattgctgcaatctattcagagctattatattgactctagactggtagaacgtccagttcagaattcttacattcccctatcccagtagtaatgcttttattaagaaaaagtgtatgtatataaaactaaagggaatccattaaaccatttacaatatgagatcagtatcttatttaaagaatttgcagaaattagagaaaacagcatagttggagattataaaactttaaatgtgtatttactaattctctagtataactgatagctatcgatggcaaaactctttcactaataaaattggctgaaatttgaaaataattttgttcttaagacatcagttaaacaggcttcctgctttcttaactttgttcatgattttttttttttggcatgagcttc

SEQ ID NO: 97268 - DNA, 1795 bp, Homo sapiens
tgggataatctcttgaacctgggaggcagaggttgcagtgagccaagatcacgccactgggccgggcacggtggctcacgcctgtaatctcagcactttgggaggccgaggcgggtggatcacgaggtcaggagatcgagaccatcctggctaatacggtgaaaccctgtctctactaaaaatacaaaaaaattagctgggcatggtggcggatgcctgtagtcccagctacttgggaggctcacgaatggcgtgaacccgggaggctgaggtcagtgagctgagattgtgccactgcaccactccagcctgggcaacagagcaaaactccgtctcaaaaaaaaaaaaaaaaaaaagatcacaccactgacttcagcctgcgtgacagacaaagactttcataaaaagaaatgaaaattctatgataataaatatatagcttaatttggtaagaagtagagcttcacctgagtattcaaattaaatcaggaagattttttgatttttttttttcttggtgttgctttcggatattgcagagaagttttttgttttttgcttttttttttagtactcaaggctattagagtagcttaagagttcaaggtgaaagaaaaggtggagtgttattagtttttatgctgtttgatgatagactgttgaagtgtctagcttcaataataatagtatgtatgtatgtatgtatgtatttatttattaattttgagacacggtcttgctgtgtcgcccagggtggagtgcagtggtgtgatctcggctcactgcaacctccacctcctgggttctagtgatccttctgcctcagcttccctagtagctggactacaggcatgtgccaccacgcccaactaattttttctatttttagtagagacagggttttaccatgttggccaggctggtctcaaacttctaacctcaggtgatccacctgccttggcctcccaaagtgctgggattataggcgtgagccaccacgcccaaccgatagtctttaaatatgaactcatctttcctgagaaatggacctttacatatatttgacagcaggactactctattgactgtgcagtagtcccttctagaggtaggtaaagggctaatagaaatactttctctcagagaaacaggaggtcattcaggaaactaatgaccatctgagaggagaacccagaagtctgggactgagtctacatgccatgttggttgggacttcctctacaagttcctgttgttggtctttttgttgttgttgtttgttttcctttgttttcttttttggcttcccagttgttcctcctctttcctcccaatttttccttcactgaaaaactcttcacttctacaagtctcaccattgtttttgttcagctatgtacaaggatattcaccattcatggtgggagtcctaaaaacctctctgacttcactttaagaactgtgcaggtgaaattcagctactgaggaacttttccccctgacaataagaatgtttggtctcaagcctataagttggttgtagtggctcctgctgggctggaatccttggaataaggatgtcgttgggctgatggtaggtgggctgtgtcacagggctgatggcttgtatacctacaggaggagttctctggccacaccgttggtacagcagctccttccaggctcattcatggaacaggcatggtggcagtcttggagaagagtgccagccccggtcagaggtaattttgtactgcagaaaggtgaacaagaccagtaggaagtgcccataaga

SEQ ID NO: 97269 - DNA, 1790 bp, Homo sapiens
ttgtaagaaacctgcacatgggggccgggcgcggtggctcacacctgtaatctcagcactttgggaggcggagacgggtggatcacgaggtcaggagatcgagaccatcctggctaacatggtgaaaccccgtctctactaaaaatacaaaaaattagctgggtgtggtggcgggcgcctgtagtccccgctactcgggaggctgaggcaagagaatggtgttaacccgggcggcggagcttgcagtgagccaagattgcgccactgcaccacagcctgggcgagcgcaagactctgtctcaaaaaaaaaaaaaaaaaaaagaaacctgcacatgggccttttgaatctaacatttaaaaatttttaaagtatactgtatatatggaatcgccaagatgtcaacattcttgactttaaaactatcaggaaatagagcagccttagcacaaaccacaaaggacacagcggctaacaaagaaaacaaatgctttagttgacatgtactgaaacaggctttgccagtatctggggttataaatgatgccaaagaaccacttaccctgaggtattttgccagtgttttctccagctctcctactctattttaacttaattttaactgaaagatagagtgtatagcttagaggaaaaaagcataagttttctcccatccataagaagtcagtacttgacttctacaggagacagttaactaattaactcattaaattagagacaattacttggcaatgtctgtaagcctgttgcctgaacaacacaaccaaagagggagtttagatctgaaactagaatctatctacccacagtcagtcaaaaatgctaaaatattttaggtattatgctaacaaagaaaagctggtacctcaaaaattggtgatatatttaaatcaggggtttgggttttttttttttggggggggggggactcaagtgatcctcccacctcagcctcctgagtagctgggaccacaggtacgtgccaccatgctcagctaagtttttcagtttttatttttttgtaaagatgggggtcccactaggttgcccccccacacacacatacacacttagtatagcaagcaatttaatagtttcataatataattttcattttgttcctgtgttttcaaaggatgaactaaaatgactttagatgaaattacccaagtatgtctatactccaagtaactttagagtttatcatttgccatttcaaagatatctcttaagcagttgtatatccctctggggcaagaagtcaaggacacatggaagacattgacataaagtagctgacagtatctgaaatgtatctgaaatagctggtccattttcttgattaaactttttccaagcccaactcaagtatttgaaatgtaaaagaacatacagctttgacatttccagaaatatttaaatttacattgagtatagttagcatgtgctcaggaaagccttaacattctaaagcttaagaaataaaatagatctcatgagattagaatcctcatacatttaatcaaaattattgtctataaaagatggcagggtttcacatacagatgtgtatcataattacactgaactatctctagctccaaatgagaagatcatgccatttaaaaatgttttgcctaccaagccaacagatcaacataccaaggcttcaactgactggaataaactggatagcaataactcctttgcaatttaccaaatttaaccttaagtgacctttaggatgtatgcaaccggctgggcacggtgg

SEQ ID NO: 97270 - DNA, 1019 bp, Homo sapiens
caggcactatgcctggtgcctggtactggggatgcagagatcaacaagacatagtgcctgctgtcaagtagctcagagatgatggcacgacggacactaaaactgggtcagaaaacttgggttctaaactcctgtgccattaactcaagaatttttgggcaaaacatgcagattcttggagtctcttctttaacaagggtttgcagaaaaattgctgtcctattgtgaggcaaaaatgacaccttgaacaccaaagtacttcaaaattgtaaaatataacttgaaatagttactgtaaaatgcttagaaacagaaaagcataggatctctatttccctccttgcttagtgaattcttctgcttttgcccaaacatgaagaaattattgttctaacctttcatctctctccaagccagagtttccctgggttggcttccagtattcctgggcttaccacgagatcggtcctgactggtctaggcagctttatctctgtctaaccaacatgtggctgtaatatgagtcaaaacaaactgttcctccattactttgttccaactgagatgaactgacattttcagatcttaacatcctttcaatttcagtaattcaaatgacaatatcatgaagtttagtaactacagatatctcatagagcatttcccacatagaaaaatgaattatttgaacaataaaagaggacaatatgtaccaaggcaagtactgagtatatgaagctagttctcttactgtccttcactattatggctcttacttccaacagaagccaaatttagtcaggaatgcatgccctttcactacacaagcactctacataaggagcaaagaccacagcagatctgacacacaaaccctgttaaacagtacaatgtgtaatttgccttattatgttagttcaattagaataaaagagcattctatcataaataatactttataagaaaaaaattattttaaatacatatggccagtttgattttttaacaactttattaag

SEQ ID NO: 97271 - DNA, 1046 bp, Homo sapiens
ttggcttcttacatcatagtggctgtgtaataatattgacaatggctaacatttattgatcatttagagtgtgcttgagattggcctagtgctttaaggatattaatgttagttttcataacaactttatgaagcaggtttaatatccttgttacatagatgaggttaaattaatgtcagactatgtggtagagccagattcaaatcaaattccagagcccatacccttaacccttacataatactactggtaggatattgaaatggggtgacttttgaaagacagaggtatatcaggggataatggcagagtgttaagaagttaaaaaaaaatctggttacttaggtgatgaaatttaaaaagtttctttacactgtaactgtctagaatagttagccaaggaatttggatttgaaacagtagggagccactgtgggtttctgagtaggcaaattgaagtggtgaattctggcagctttttgtgtatgttggataaagtatgaagagattggaagtagcttaggtgataagctgagaggctactgaagtaatacttttgagaattaatgacctagagtggttgatggctggggaaatgaaaagcaaggacaataccagcgatgtaagggaagaatctatcgaatttggtattaaatatggaagtaagggaagaagtagaagtgaacctgtcagttttaggataggtgttaattgataaggcatctatttagataatattttttggggggatggggttagtttggttgctaaacaaatgtatctcactaagttaaagttggatttggacagatacaaatttgtgcaggtggtagatgaattccttgtatataaagcaaggcagaggatcaggggctgatttataagtgatatctccaattgaagtaggaaggaggaggaggggaaatagggagaatggtcccatgaaagtttaaagtaggagtttcacaagaaggatataattaaaggttaaaatgtagattattctgttattagtatgatttagtttggggaggattttggggtc

SEQ ID NO: 97272 - DNA, 1016 bp, Homo sapiens
gcgcgcgggttgattcgtccttcctcagccgcgggtgatcgtagctcggaaatggcgggtaagttaccgggaaaagtttaccaaggggaggaggcggccagatcggggatagaacgccgagacggtggtgacaatgcccgcctagaactttcgggctgtagcctgggttccagaaggcctgcttgggaccggaagcgcggaactctcagcccagcagctccttgttggcggcggtccgcgcccccgcccccaactgcttggggttctgcgccttctgccagcaatccggcccctaccgagggccgaagacgccagggaaaagcgtcatgatttgggctcgtaaaatgccacatgccttggggcctgtttctcttcccattccttttgtccactgctgcttgcttcagctcttgtacatctggtcctgttcccgccagctgattttaatgctcagatcctcctcctcttccaggtctccgtctaccttccactacagtcaacttctgagctagcgcattgctgccttgccctgctctggcgctcccacttggatctcgactgacttcgtagtcgtctcgttaatctgtcacactttagtattccgaggatcgtatttagatgccctttgagaaagactttgttcctgaactgctcccttctcttttagggttggactactataatacaattctcttgtgtacattctagagacccttcaagttacaacatttaataatgtataattgctattactttgtacgtgtattaaggctgttttggtgtgattatttttttcgattacttatcttttgaagttatggacagtttctttttcctgagacagggtctctctgtcgcccaggctggagtgcagcgatcatagttccgggcagcttccaactcctcgtaggctcaagcgatcctcttgcctcagcctcccgagtagctaggactacaggcatgcgccacaacattcggctaaaaaaaaacaattttttttaaccttttagagacag

SEQ ID NO: 97273 - DNA, 1421 bp, Homo sapiens
agatggagtcttgctctgtcgcccaggctagagggcagtggcatgatctcggctcactgcaccctctgcctcctgggttcaagagattctcctgcctcagcctcccaagtagctgggattacaggcgcccgtcaccgtgcccggctaatttttgtatttttagtagagacgggtttcaccatcttggcgaggctgacctcgaactcctgaccttgtgatccacccacctcagcctcccagagtgctgggattacaggcgtgagccaccgtgcccagctggcattcttaatacatttatttaagagtatgtggagaatgacttgtgcttttatgatctatcagcatgttttaaatcatacccctattccacttataataaccctattgcaggtttgacaatttaagtcacttccaaactaaaccttttaaaaaccttttctcttaggatttggtgctatggagaaatttttggtagaatataagagtgcagtggagaagaaactggcagagtacaaatgtaacaccaacacagcaattgaactaaaattaggtatgtatgccatttctaagtgatgttatgtacatactgtgtgtgtatatataatctttcattttaaatttgaagtaaaattttatgtaagagcagttatttatgcaaatgtatggttttctgcatttattgaacatattcagattttattcagttttgatttatgtcatggaaggtgtagatgtttgaaaggtgacagaattttatataaaaaggaaagacggtggggcaaaaagtaataagtatatatagttttagcctcttaaaaatattttttacttttttgcctgtaagaataataaacaatagcaaatattggtgaggatgtggaaaaaaacacttgtatattgctggtgggaatgtaaagtgatataactattttggaaaacagtttggcaattttcttttctgtcttttttattttctttccttccttctcttctttcatttcctcccctcaccccttttttttctttctttcttttttaaagagacaaggaaggtctcactctatcacccaggctgtagtgccacggcatggtcatagctcactgctgcctccaacccctgggctcaggcagtccttctgcctcagcctgccaggtagctaggagaccacaggtgtgcaccacccaagcctggctaatttttataaaaaattttttttttgagacggagtttcactcttgttgcccaggctggagtgcaatggcgtgatcctggctcactgcaacctccacctcctgggttctagtgattctcctgcctcagcctcccgtgtagctgggattacaggcatgcgccaccacgcccggctaattttttgtatttttagtagagacggtttctccatgttggtcaggctggtctt

SEQ ID NO: 97274 - DNA, 1046 bp, Homo sapiens
ggaggctgaagtggaggatggcttgagcccagaaattggatacgagcctgggcaacaaagacccccatctgtacaaaaaatttaaaaaattagttgttcatggtgatttgcgcttgtagtctcagctactttaaaggctgaggcgggaagatcttttgagcccaggatttcaaggttgctgtgagctgtgattgtgccactgtattccagcctgggtgacaatgaaaccctgtctcaaaaaaaaaaaaaaatacttaaacaaggatccagtaagggattgtgcactgcatttagttgtaatgtttcttaaataatctcttttaatacagagcagtccctttccgtccacatgcaacttttcccctacatgacattgatttatttgggagagtaaagtcattgcacagataaatgtacattctggatttgtgtatttccttttgatattagtttaacttcctcctctatcctctgtatttcctgtgaattggaaggtaaaaagcttgattagatttaagataaaaatttttggtgagaaaacttcatgggtgatgcagcatacagttggtccttgaacaacacgacttgaactgtgtgggtccacttacacatggactttttttcctaccaaatgcagatagaaagtacagtgggacaccagacagaactacaggacttgagtatgatggattttggtacagtcaggggtcctagagccagtctcttgagtatactgagggatgactgtacttcatattgcattgaatcaggaggcacataatgttgttctgtcccacaatgaatgatgctaagttagatcatttggaaaggaggtgactaccagatctctacagtgaaaatataccttttcttctgtaaattagtaatatgctggtgatactttggcatgcagggagtgacctggtctgtgaggacagtgttagaaatttttcatctacagtttatcttcttttttccccctgagacggagtctcgctcggtcacccaggctggagcgcagtggcacaatctcagctcaatgcaac

SEQ ID NO: 97275 - DNA, 1154 bp, Homo sapiens
ttcagtactctccccctagttttctgctgccaggaatttcccctgtgtatacttataaaagtacagcaggatgtatataaggatgtcattgcagtgttatttttaatagcaaaaaacaaacatgagaacaacataaatgtcatctagcagtcaaaaagaatgacttcatcaaactcaggttattgttattatcagaatgtttcttacagcattctgttttcatttgctgtaacttcttacctcaaagtgtctttttgtttttcctttactcattgcattgtgcataaacatggaaaaataaaaactaaatgaggtgcctctgtcatacttagccttctgattcttagaataagtagggttttgacgctgaagcactcaaagtaatattttaattttctttgttcactagtctcttgagaatacagtgtaaataaatcatataatggtgaaatgacacttttagtaagaaaaatgttggctgtatcctagttatactgaaactcatgaaataggaatacctgtcaccttcaatatctttagttatctttaatatctctatttttttgtcccttgaaacagttcgttttcctgaagatcttgaaaatgacattagaactttctttcctgagtatacccatcaactctttggggatgagtaagtaacttagtaaaatatttgtcaaattagtatggaaaaaaaaattttcattctttttcttttagatttagaaatcaaattttattttcttcttatttttaatgtggtttatcttaaaatatatgttataatggtgtttttttacattgagacaccagttattttaatacctaccatttagtgctgtaaatgcattatttaattctcacagcagtattaatgatggtattattatttgctgctttgtgcattgatagaattggataattgttcatgaacatacaaatggctggagtatagattttaggcaatctgactccagagcccataatcataactactacttttttctgctaccattttgctaaattacttctagtagcatgtattcccctaaagctgtaatagaaagcttaagttgttattctatgatcaaataagcagttgagagaagtttatttatttattatttatttatttatttttgagatagggt

SEQ ID NO: 97276 - DNA, 1047 bp, Homo sapiens
gtaaggcaggtgctattgctgcagctctggattttggtgattcagtaagcagtaagttggagggactggtccaaggcttggtagctgcttgcctagccaggtcctaatttaacactacttctctcatttgaaatgccttctaatactggtaatggtagcagcagcagcaacagtagcaatagtattaaatgtctgacatttagtgagtacttatacaatgtgccagttttataagtagtttacatgtattaacttatttaacccaaacaacattcctgacttaggcaacattcctgagttattctattttatagatgaaaactgaagcacattttattgtagattttttttttaagtatagtttaaaatcttgaaactacccatgaagttaaacttgtttatatgtagggttaatactttttaatgactgcaaaaattcattccattattgctattttttccatttcagtgaaactgcttttggttacaagggtctaaagatcctgttatactatattgctggtagcctgtcaacaatgttccgtgttgaatatgcatctaaagttgatgagaactttgactgtgtagaggtaagaacagaaatactttttaaactgttttccaatttaatttattttaaaataggttttaggccaggtgcggtggctcacacctgtaaccccagcagtttgggggaccaaggggggcagatcttttgatcttaggagttcgagaccagcctggccaacatagtgagagcccatttctcaaaaaaaccacaaaaattagtggggcgtggtggcatgtgtctgtaattccagctactcaggaggctgaggtcagaggatggcttgagcccaggaggcagaggctacagtcagctgagatcatgccactgtactacagcctggatgacagagctagaccctgtctcaaaaacaaaacaaacaaacaataaacaaatagtttctaaaaattaaaggtttgggctgggtgcagtggcttgtgcctataatgccagtgcttttggaggctgaagtgggagga

SEQ ID NO: 97277 - DNA, 1053 bp, Homo sapiens
ttcatattcattattcaactttagtattagaaatattttgagttctatttgttttttttgtgtgtttttccccacttcccagccatgtttgagatgactgagcttgccagataaataatatgtaactacatttaatatttgttttattttatatagtttgtttcccaggataacttttgaaattgtgcagatacaaaagtgattctgagtaatactgtagtggtttgatgtttgaaaagatgtaatcttagataaactagcatttaacacatttattaaaatagagttttttcataatcaaatatgtagattgctaaattctccagacccaagcccagctagatattcttattaaaaatgcaggtgatgtttttccttgtgtgtaaacccactgttggagggtttttgttttttacagttgcagctgatagcactgaattgatttcttccaaaggaactattgatttagttatagataaatcttttaaatatttcatgcagtgaaaatagctgtgtatttgcattgacatctaattgttccattcttgaaaattaggtttttccatttagaaatactgtgttaggaataaggaatcaatcttttataatgtctctttgtagagttacttatttgctttgtggtcaaagatcatttatattgcgtattcaaacaaagacttttttccccttattaaaaacgattgggtaggggatatgtgggtcatgggcttgcttcttctatctcagtttgcagtgagtgttcattccatagtgccttctgtgttgttgatgccagcgatacagtggcagacaaagtcatggagcttacattctagccaagaggaacagtcagtaaacaaaatagtaaatacacaaattaaattcaggcagtattatgaagatacattttgctcatttctgaatgataaaggaggaaccagccatgttataatctgagggtaaagcttactaagatacaaaggctctaaaaatacagcatttttggcatttttgtagtccagaaagattaccagggttaaatcattgtggtga

SEQ ID NO: 97278 - DNA, 4402 bp, Homo sapiens
aatatgatttctttgacacatataaaataataagcaaccttttgccttggccagttcagactgtcatgaaggggtatagtcagctgtttctgcataatggaaatgtccatagcattgcccttattattgtacttggtatcaggtcacctgccttctcttatttacttttatattatgctcatctcagttttgtgtgatgcagtttgtgcacaggaagctcatccttttccaattcgctgtgtgtttacgtctttagttttcaaccaaagttttgtaatttgtgttggttttgtcagttttaaagaaataaaccatattcaacttaaagtcgaatttgttattaattttttatatcctttattctttaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggtaaagataaatctaaatatttattgagtaaagttctatttgcctgaaacctgtatgtagttttgttgtcagtgatttattctaactgcagtaaacaagttttaatcagcattataaaccaagatctattttgtgtgtatgtctgtatctatgttcacatcttaatctgagacttctaaacattttcccacaggataattttgtgttctgcggactttcacttacctttgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtagaccttattacctccacaaagccagcattttaattgtggcagcccaattattgggacagtataatgatatttttcccaggaaagaaaaactattgtttatgaggcttgagttttccttcattatgctttgggagaccttgagaatagagctgaattaaatgctgttgtccgttagggccctgaatgtaggcttaaacagtaaaatgagctttgcctgtgttttcttttacttgccacctattcatctttataataggcaagtgcactgaagtgatgtaaagaggtctgatttatccaagttgctgcacaccaattaagtgaattgtacattcagaacatagcaggtgtacccattgggccctcacagagtagcttgctgacactgaaaattcagtcagagaatggaaaagaaaatggacactgcatgggagcgcgactgtaattgacctgcttggctttctgttttatctgcagatttgagaagtataataaggatggagctacgctctttgcgaccgtaggctacatgacagtctataattactatgtgtacccagacaaaacccggccacgtgtaaggtaattggcagtataacacgtgccttgtcttttatttcagaagaaggaactgctgaagtttccaatacttgttataatagtgttgatttgtttaaaaaaaaaatcactattattcatgggctatgtactgatttatttcattgttccctttgaaacagtgtagaagattaaactaattttgagtatcttgataatttttgggtatctcaaaggtggattgaaaaaaagatcacacaaactttaaagtgtttgtaatactatagtgatctgcaggttttaaactggtcatgttatgatattttaattttaaaataatttctttactgtagtcagatgctgattttgactccatttcaaggtcaaggccatggtgctcaacttcttgaaacagttcatagatactacactgaatttcctacagttcttgatattacaggtatgtaaaatttgatttgttactgaaagagcctttctaaaaatgtcttcttactgattgattttatttttgtcagaaataactattttaaacagcaacattttcctagggtgtttaagccatctaaagatggcttaagtttatgttttagagcataagcctttgtggggattggattacatccctaactgtgaagtgcataatggaacaaattgaagataatgagctgaatatatatggggaagtcttggtcaggcgtaaatacgttgaaagtatggtataacttatttgttcactttatttggcaaacagttgcattatttagaggcagcctgcactttaatttacatgtaggggcagaatattataaactttactgagaaaaaaagtcaaggtaaatacttcttgaatagaatacacatttcctaaagtgtgtgttttgtattcctaaaatgcatgccttcacaacagtagtagataaggtgaaatgtaggcctatttgttttggaaatgtctttcagtatggattagccatagaagtagtagtatgaatagaatgcttaggagaaggaaagacgacttactcgacttactcgacttgactcttcaaaaggagaaggcattattagatggagtttcagataatatgttaaagtgtgatccaccaaaaaacaaagtggcccaaggaatatttatgttattttctaactttcaaatttgttgttcataaaattgctgatgaaactgaaagttacctttttcttttattgaaaaatactttaccagatagttacatgcaaattggtattaaaatttattaatcttacaagtttgaatttggatacatctttgttacaaactatactatttaacatgcactaaaacattaacatgttaaaaaatgctatttgggaattttgtttaaagacaccacctcccacccacccacccccaccaaaaaaaaaatggttgtaagactggcaaccacataaataggctagtaagcagattgtttcatccttctttatatagactagtaatccaaggtaaataaaattgaagttgcttcagaacagtgaattgatctgtagaataataaactggagggaaagcacgttgtctttaaaagggagtttcacatttatagaggtgaattatcttttcatctgactttcctgctactgttaaatgggttggaaactcaggagataaagtagtagttactaaacttcgtttataacaaaagttataaattgtttaagcgacaacttcactagcttagtgacttataaaattgtagaaacataatacagactatgtcacttcttttagttgagcagaaaattgtttagcttctattaacttatagagcttagacttgctgctacatgaagggacatttttggtgattttaatgtggagttcacataagtagtctttgtctactctagtgggtaatgtgccagcaggggttgtttctctgaagcctcttaaccactttcttctgtctactccaaccaataaagtccttgatacttagcaccaattagcagataaagaattttatttcttaaatctcagtgaagagtcatcaataatggtagcctttattcattggtgttattcattagaaactgaagtctctaaaaagaaaagactaaacatgctaaaggacttctgaatttgacaactgggtattggcctttattttcagcattaacatttctcagcatttaaaaatactaaaaatgccttatcagctgttctcattaagatatttatttctcctagatttccatacccagtccttaaaaaacaaaactgcagatttttctactcttctgtcatttagttgcctgtttctccattattgtgtgtgcttttttagctttgtggttcttttgcaggctctggatctccatttgcaatccagaatattctttatattgagatggccttttgcttacttgacagatagccagatctaataataattgaaacttcctgtagatggcctaagttatatcttacttccaatggatgggtgtttgtggtataattgccacccattttcatttttttgcactcaattttaaggtaaaatactggcagacaattccttgtataccatctgccttttgaagatactattctcttaagatgtacagcatttgaatacatctcagttgtataactttataaatagaatcaatgatcttgtttcctctggacttctgaaaggagttgcatttggcaatagaaatcgattctgggctggaatacatatcagtattattatctatcagtagtacattaagagctaattatatttgtcctttaaatgtactttattgttctgggatgtgccatatagctttttagaatattatgtgaattgtttataacttaggtgattgtgctg

SEQ ID NO: 97279 - DNA, 1044 bp, Homo sapiens
ctttcctcccctcaactcctatccctaggcaaccactaatctactttctgtctctataaatttgcctattctggacattggaatcatgcaatatatgactagtttctttcacatagcatgttttcaaggtgcattcttacagcatgtaacagtacttcatttcttcttattgccaaataatattccattgtgtggttatatcattttattcattggtcagttgaacattttagattattcccacattttggctcttatgaataaataatgctactaggaacagtcatgtacaaatttttatgtggacctgtgttttcatatctcttgggcatatacctaagactggaaattatgggaaatctggtaactatgtttaactttttgaggaatcaccagactattttccaaaatggctacaccattttacatttccactaccagtgtatcagggtttcagtttctccacatcttcatcaatacttgttactgtgtttttaattctagccatccttgtaggtatgaagtggtatatcattgtggttttgattcacatttcctgtggctagggagactgtgcatcttttcatgtgtttattatccacttgtatatatcttattgataaatgtcaacttagatcctttgcccattttttagttgggtctttttttttttaccaaattataagagtttgtacaccaatttatatgaatctggatacaggtgctttattagatacatgatttgcaaatagtctcccattctgtatgttatttttttcatttttttactggtgtcatttgaaacacaagagttttaaaatttttgtcacctagtttatttgttttttcttttgttgcttatgctttggtctcattatctaagaaaccattgtctaaccaaaggtcatgaagatttactcctgtgttttcttctaagagttttgtagttttacctcttaaatttgggactgtgatcaattttggttaatttttatgtatggtgtgaggaaaggggatcccactttattcttttgatgatagaga

SEQ ID NO: 97280 - DNA, 1037 bp, Homo sapiens
aaatgtctttgcaaaaggattggatttattattttgacaaagataatagttttatttataaggaataatcctttcatgttgtaacttttgtatgtgtaattttttaaattacacattaaaaattttgtatttttttatgtgtaattaattttgtatgtgtaattttttttaatttgtcttcctagcctagcatatatgttgagattgcaaaagatgaagaaattatattgagtatcagggaaatgttaatattattctgctttatttatttagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataaggtatttttattctgtaggaggaaaacagatttaaattacaaacaaatttttgaagtgtataccttaactaaaatattataaagacattaagaatacatgtgtgggaactagcaatggttaacagtacagctttgaagccaaattgcctgagttcaaatctagctccaacacttgctctgtgatttatggcaatttaatttacctcgtgcctcagtttcctcattaataaaatgggaagataataggtgttattgctatattaagcataacaagcagaggaaagatggataataggatcttatttttactctttaaagtagttgtacccctggagacattattggtgggaagaatggttgaagtaaaacacgtatttcattttatatacttttatatatttatttaaattttaaagtggtaaatgtcttaagataggtacagaaaaaataaatatggaagttcagagaagaaagtttattacatttatgtaagcaaggaaatcagtggttatttcatagaaaggatggcatttgatataaaccttgaagaatgagtaggatttggattatgaaagtatgtgagatgggctgggagtggtggctcacgcctgta

SEQ ID NO: 97281 - DNA, 1125 bp, Homo sapiens
cttatttaaaactcaaaatttgtgcatattgcttacattcctatttaaaatctgtcatgaaggctggggcagtggcttacgccagtaactctaatactttgggaggttgaggcaggaggattgcttgaagctgggagttgaagatcagcctgggcaacaaagtgagatcccatttctacaaaaaaaaaaaaaaaaaaaaatagccgagtgtggtgcatatgcctatggtcccagctgctcaggaggctgaggtgggaggatggcttgagtctaggaggttgaggctgcagtgaactatgatcgtgccacattaaattatccataccataatcatttgtgttacccactagactgcttgagggcaactacttttattgcctttcctctggtttctagcacaattccttgctcatggcagatattaaatatatcctgtgttcttttgggaaagtgtcattatttttactttgaaaatgttcgcattttcttttgtttcattctagcaacacgctagaagggtttatgaaattcttcgactactggtaactgacatgagtgatgccgaacaatacagaagctacagactggatattaaaagaagactaattagcccatataaggtaggactttcaagaatcttaaacactgtattcttttcactgtttaaaacagaagaaaagctaccaaatatcagtatatgagagagtccaagtcattttgtaaaattaacttttacaaaagtagaaatattcttccagtaatttataaaaattctcactcatggccgggcgtggtggcccacacctgtaatcccagcactcagggaggccaaggcgggtggatcacctcaggtcagaagttcaagaccagcctggccaacgtggtgaaaccctgtctctactaaaaatacaaacattagctaggcttggtggtgggcgcctgtaatacagtgacttgggaggctgaagcaggagaatcgcttgaatccaggaggtggaggttgctgtgagccaagattgcaccattgcactccagcctgggtgacaagagcaaaactccatctgaaaagaaaagaaaagaaaagaaaaaaaacccgggtgcagtggctcacgcctgtaatcccag

SEQ ID NO: 97282 - DNA, 1470 bp, Homo sapiens
aagtatagcagttttccatttgtctttctgaaacatttctaacagtttatgttaaaattagcatgtggcccgtaagtacttcactgggtggaatttaaaatgtaattaattaatgactgaatagtaaaatgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaatacttatcattccttccacactttgcttctaagattttacatctgacacctttaaaacatttctttaaggttatcctggtaattttattttttcaatatgatttttctttcttttttaacttttagattcaggggtacatgtggaggtttgttacataggtaaactagtgtcttgggggtttcttgtacagattatttcaacacccagatactaggcctagtatccaatagttaatttttctgctattctcccaacctccaccttcaagtaggccccagtatctgttgttcccttctttgtgtccatgtgttctcatcatttactcccacttgttaagtaagaacatacagtatttggttttctgtgcctgtgttagtttgctaaggacaatggcttccagctccatccatgtcctggcaaaatacatgatcttgttcttttttatgactgcatagtattctgtggt

SEQ ID NO: 97283 - DNA, 1418 bp, Homo sapiens
tgttcacttaatctccctcatcactcatcatagtaccccacccttaaccgggatactatgttgctagccttctccagtcagagacctctctgttttattctctcttgagagtgttttactctctcctaagaataattctgccagaatggtagaggggtagtcattacattttgtagagtatgagatctggaggttagcagttcttcgttttagttccacttcactcttgtatcaagagatacctggtgccaccagttgattcctgggaattcttgctttctctaccacctgaacaggattatgttttcttggttctgctgccatttacttcctattatctgcttttcagcttctggtctttttttgcttgtttcctgttgtctcctctcctgttctctaatcttatagggtcatgccctaatctacaagagaggcagcaagggtagatgtgtatttgaactttggacttctgaaatgaattttgttgcatcttggccagaaatattgcccttatacgtgtcatattttgtttcattttacttcagttttgcaatttccttttttttttttttttttttgagacagagtctcactctgtcgcccaggctggagtgcagtggtgcgatctcagctcactacaacctcctgctcccaggttcaagcgattctcctgcctcagcctcccaagtagctgggattacaggtgcctgccaccacactcggctaatttttgtatttttagtagagacggggtttcaccatgttggtcaggttggtctcaaactcctgatatcgtgattcacccgcctcagcctcccaaagtgttgggattacaggtgtaagccaccgcgcccagcccagttttaaaatttcttttgtgggactaacccttatctaattttcaatccttttcctttacctagtgacaattacccaatttctcaaacagttcactgggtcttatcacctctgatatgatgacagcttgaagggcctcaagtttttctgcaagtccatttttttttctctattaaattctgggcaagacaacactgttaatctttgaagactatccatgaatcacatttttgtccatattcctaatttttcctttaacttttttttgccctcatacttcatgtctggtaattttgttagtcagaaatctaccacttaccactcatgggatgaaaaaagcacagtccttaccctgagggaacttacagtttaatacaggtgaacgtgagccaccttttatatatatgtatgtatgaaaggttttagatatatacacatatatacatatatacacatatatacatatatatacacatatatatacatatatacctatatatacacatatatatacacatatatatgtctgtcttgttccatgaaaggttttatatatgtgt

SEQ ID NO: 97284 - DNA, 1025 bp, Homo sapiens
ggggaaggtcacgttttgcagtgacctgggcaccactcttaaatgttgttattattggaagagggtaccctcaggctgctgcccttcctctccccagaagcgctctgtgactgactttccagttcatcttttctagaaccaagactcccaggctgtagatgaattctgacatctacagaccagtatccatctcaacttcatttgaggtgaattttattagtagtagtgacccagtcctaccttaatatgagaatgatgcatcctcataaaaattgcaaacttagagcagtaaacaactaggataaacttttatgtttcagcataaaagtgagttatgacttttttgtcatttaaaatattgcacacatttcctttttatttctgtgggatctttgttactgttttagtggtcttaagtaaaaataacttcaaggacaacacggttggatgtgaagtagaatatttatttcagacaagtattatgcccacatattttagattcaactatgtgctttattttcagcattaaagaaaatgagctgttttccaacacctgcataccaactgggcctgcatcctctttagaaatgttgtttaataaacactgtggctttatcatccagaggctgttgccaaatgctgttaattaggccaaaaaaatgttttttaaaggttggtgaaacagatccacttttctctctgtaatggcatcttagcttgaaatccaggaagcagtggtgtatggtgtccatatccacgatttcctgcattggagaaaaagtgtggaaagcatctggggaaaaggaggctctttaccagcttgtttcctgtaagttcaattggaagaccttgtctgtgcaaatagatttcaaaatagagcctgccctttgactgtctccataattacatggctcgctctgtattttatttggcagccagagcagttaacccctggaaggaaggggctgatggtatggccagcttggcttcccaggcatgtccatgggaatgaataaaccactgtt

SEQ ID NO: 97285 - DNA, 1160 bp, Homo sapiens
ctttttcagtcaataaggtattagaataatgatttaatagacaacaccacaacatcttaaagtggaggactgtgttaggttgtttttttacttaaaatatgtctgtttctgctcacaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaaggtactgtattgcctattatctcctgctttttccagccaagataaaagttgactgcagaagtgatcaaatatttttgcacctttgatttctgagccatttgggttttaattttcaaactaggtttgtgatctaaaactgtgatttgagaagttttaatatcctgcaattctatagcattaattttttaaaacaaagctctaagctttcaattgcttagagtatttagaattaaaatttttaacatgaaattttctatattaaatttctaacatgaagataaaactatacgtatgtagttttctaactgttttagagaaaaaaaattgactataaaattgtgatgattcaaaagagattacttaaaactaacatactagatttttttaagcctgttcttacattttccttgttattgatgctggtgtctttgaattgtcttttagactaaattaaataaaatatgtctcagagcagtcttggcttttttttttcagagattgcaattctgtggaaaggcaatctatccatttttcaaaatgcaatataaagggagtgtgcgagtgagccctttaggaagaaggagagtagctaaagaaatatagattggtcacaaaaatcatctgctttctcccttttatgaactttgtttacagcgagcccatatttagtatgttatacttctgaaggtgagtggcccacttttatggcaaaggccagtgacacagaagggccaccaggatgtatcccctggcctggccatcacagtgagagtgagaatttggtattagttacaaaactgacacttttttccttagaagaaaagaaaaagaaatctctggtgaggtgaattgtattgctttagccatttcagtcaatttcagcat

SEQ ID NO: 97286 - DNA, 1036 bp, Homo sapiens
taatgcatttcattacatattcactacattaattctagctacattaaaaaaaaaagaagaagaagaagaagagtagaattgaaagtgacattggattttagctatctggatacaaaggtcagttttcacagagtatgaatttgcatgtacaagcttttttgaaaaccagatcagtcagtcccaacaactgcacttaaaaaaactatgtggaaaataacagacaatgaactttttacttgtaccctaatacatttcattatttagatggtttatgtctgccgctagaaaggaaactggccccgattctaacaaatatttgttctgatgtgttaaagcagtgtttctggacacctattatcttgccttttcttattctggcaaaatcttaggggaataagtaaacaaaccatatttacctttaagccaaaagtacttgaaatcattacagaccaaaggtttacaaacatctttcaactcggtcttgtttattttaagatattcaccatcttttgcgtagcctctctctactgatacactaggaaaagaacaagcaacttgtattagtatcatgttatcaaaaaccttgagatctctacaggaaattttggaattctcctctgaaacctaaagaagataatgtctttgaggaagtatcagctaaaatgttttaatggaaagagttctctctgggcccttttgcttttgtgaggaatgtctagtaatctttaggtcatagtgttactagactcactgtatctccatttgctttaaaatatttctaaatctgtatttttataattatctctagattatacaatctgtacatatgagtatattgtgaatgtgtagattcatgcatcatgaatatgtgacagttcaatcaaaaataatttaaacttgtaaatgtcatgatgaaagtatcaataaatggtttttaatgtttaattcataactatatgttttgatattaatttggaacaatataaagcagatttttaaaaaataatctctttctattagattacgcacatttaaa

SEQ ID NO: 97287 - DNA, 2361 bp, Homo sapiens
gagtgtatactcagctcctgagagtcaggcattaagatgtgctcaagcagggaactgggggaaatttggcctgttcttttcctctttccacctggctgtgaaatcctctaacctttgcatccatgacacacagattctatgatactcctggagccagaagttccagcaggacccacggagtaaattgttgtaggagaatgctcttagatatctttagccacctagtaattgcacagcttcttttatgcagaggaacgagaggtatgatggggggagggaccctaagtgttttttcagagtgggctttcttcctctcctctcatcggaaattaaaatgaagattgccattgtaacacacatttaagatgtagccgtgatgcctgccaatcagccggatcctctaaaaacaaaaaaaaaagaacctagatttttttttttagaagagaaaatagaatagtttatattgagtgttcttagaatcattgaggtttgttgggattgaactaacataatttataggtttagggagaaactgttcctgtaaaaaaaaaaaaatctagattattatgtcctatttaattatctttcttccaccctgtattcactcttcatcctcagtgtttattcagaaactgtgtggcacaaataaaaacaccttgggaaacaccaaatagaaatacttgcccaccaaagatccacagaaataaccataaagtacaacgtaagagataaaaaccttgacttaccgttcctgtcctcaacatatgtatagcttacctatttctgcactaacagttacatcaaaattaaatctgaataagaggctgcccatctgctggttatagtgacatccaggtctaagtgaagctgtcttacaagtctggggatggttaaaattatttagaaaaatgtataaacatgaatggccataaagatgctggctgaaagcctgtgggttcatgttaaactaaacttagagtctgttagagactctagtttgagatctagaaacttagttctgttaataattgaaatagtagtcctgtaaatcccaatctagtgttagggttaggggcattttgccctttgtccacatgaaaatataaattcttaatagtatatatgttcttgtttgtctgatgctccccaaaataaacatgttagctgatttcaaggactacttttcaatcttgtagatgaagattttagaattggagtctgtgtgcttggtttcagatggaatgtaaaacatttgcatgtaactaatgtagtgcatgcaatgtacttctccacatacatgtaatgaagtaactaatgaagcactaagaattgggaatcacaatactagcttatcttaagcatcctagtgattaaaaagcattctttatgaattttgttaatggtgcaggtcttgaatggaactctcaaatgatctcacggttttggagtatttcaagaatattgacaaagtagattgagcttttcgtgtgagtgtgcctgttggtaaaatgtgtaacactttgaaatagagcagaaaaagggaaccatagaagtagaaagtcatatttctatattgtaatttgttttatatttggttccccaatcaggagtaatttatagtctttttgtgaaacctcaaaaaagccaggcaggtttttatgacctgcattatatgcacatatatcccggttatgtatggcaatcactatgtgtgtatacacactcacttgttgtctaaaagtggctttgtttgaatgctgtacaaaggtaaatgactcaaacgactgtgttggatagatatgtaccttctctcttcatatatccaaagacagtggttgcaggcaacagcaaaaattaaaattattacagcataatgaaaacacatgaatgttattatctgactctaaatattactgactttttctttttcagagaatattttaaagtgactttgttttatcttagtatgcctgaaaaacttatctaatttaattaaatattttttggtcacttttaaagccacataactcatcagaatggttttcaagtctgtccacattttgtgggacatggaataggatcttactttcatggacatccagaaatttggcatcatggtaagaaagttcatttggaggctgtttcttgatcagagatcaagatgtggcagctttgaccctgaagctcttcctctgactttgaatctgcattatcaaccttgtgtttgtgtgtgtgtttatgtgcagggggcaggggaggggggtctgcttaattttaaccgggacattactgtgttactggattagagcccagctgtttcaatcccaaaataaggtttattttgctctctgtcttctcctg

SEQ ID NO: 97288 - DNA, 1102 bp, Homo sapiens
ttcagcaattaagtttgccattttacatggtcacaggtcttggcacccccaaacgattaccatagtaacatcaaagacatgatcacagatcaccataatagatataataataatgaaaagttcaaaatattgagaaaattaccaaaatgtgactcagagacatgaagtgaatccatgttgttgggaaaatggcaccgatagacttgctccacaaagagttgcccaaaccgtccatttgcaaaaaacacagcatctgtgaagcacaataaagcaaaaggtagtaaaacgaggcatgcctataggtagtttctttggaatttcctcctcgtaaagacagaatgataaaaagcacctacctcacagaattattgtgaggattaaatgagatcacataggtaaagtgctcagaacggtgcctggcacacagcaagtgctgtaggagcttttgccgtccttcctgttttctggctagagccctggactagaatgttatgcagctctggcccccgggttatttctctgtcagctcagtgatgggagttcatgggttcctactccaggactccagcagtgtgagatacagtcactcactctgtccctattttccttcaggtttgtttgctttacgggatgctttactacagtcaaatcctgagagaaagggctttgattggtccaggtggtttctatccttatccccattgggtgaactctgttgacgggccagccaatagatcagcggcccttttgtcaggtcttctcctagtccaatcagctctcaggggccacagagtgatcagtgaggggtgaggaatcaccttgggctgcctccctccttatgcagagggatttgtcgggtgacccttaggacacctccaggaccggaaggactagagttcccactgctgcaccatcagcccccaagaagcaacccactttcttctgcttcctcgggtgccgccaagaatcatcagaagaagccaacccattgtgttatctgaaagccagattccaggagtttcttccaaaacgcttatagaaggcaccgacagcagggctgcttctcgactccctcttcctggcatagctgcaggcacattat

SEQ ID NO: 97289 - DNA, 1047 bp, Homo sapiens
gctcacattcttctctctcctgccgccttgtgaagaaggacatgtttgcttcctcttcaaccatgattgtaagtttcctgaggcctccccagctgtgtggaacttcgagtcaattaaaactctttcctttataaattacccagtctcaggttatgtccttacagcagcataagaatggactaatacaaggaccttcacgagtatctcaggcctagcaatgcccactagtctggacaaaggcatgcatggctgtggagaccctctggcaccatgtcagccacacacatttcttagtttcatctctgttacttcacagacaatgctggaaaagtacaatagatgactgggttgagttacctctctacaacacagggaagaaaatgctcaaggccataggaaactgggcagacattccagaaataggatgtccagggattcaaagacaatgccatcatggggactggccatagggagcgcttgatccaggaatgggcagaaagtagtgccattcggctccccagctggtgaaaggaacagccatcctttggcttccacctggggaaccacctggagacccctggtgttgggtaaccaccttcaaactgcagttctgtctgcccctcccctgcatcactcaggaacttgcctctccatcctctggacctcatggtaaatgcatacccttgcatttcctctgggacaattgtctcttatatagtttgagcccagggaaggccttggcttggtcatcacagcttacataccatattcttcttcccccactcctcatacccccagtcaaataaggtgattttgatggttaccaggtagctcgtgaggccaagatattccatgcaccagggcttgaggtgagtcaatagggaaacacagaatctactgtattgttaagcaaacactctctttatgggtatttggcccaaacaagctctgttatgtagagcacactgatagaattgaaaatgtaaaatgttaaaaacttagcatcaagaaacagtggctcaaaataaacatggagatgaaagatca

SEQ ID NO: 97290 - DNA, 1031 bp, Homo sapiens
acaccagggtaggttcatcaaaatctatggaaatgtccgtaggttgcaggaaggtcccctgattctgaaacacagggctggagagaaggcacagtattccaacggaataattcacagaaccactggcagagagtaaaggaattcttggctttatctgggttcccctccccccacttcattcaacattttaaaatactttcacctgcttcagtgaaggcacagctagggaacttgttgactaccacgtgctgttattttagttaatatccttctccccagagctgagcttgtttgcaggagggctttgcaatgcgtggctttctttccatcctgataagcttcatttccaagctggtggctctccgaaattcttttgcaaaacagagcctcagatctctccctccttcctggttctatggagattctatatgagaatttagaacaaggctcagcattcaccagaatcgcctgggcttcttttctctcctgcgattgctatgttaatgaatctgttggatgtcgctgtgacctacaagctcctacccagcgggagagccctgcatctaaactgctgatatgtcacactaagaaaggaaaagaggccctgcctggccaggcagaggggcaagggggtttgggaagccttccaagactcagatcattgtgtagagatgtaaaacatcacaactctccttgttattactggtgataaatggctgggcaggcagatctgcaccacaagaattgctgaaattgaggaaaccttgtggaatgaacaagcaattgaggaggaagtgagaggccgatggcagtgtgaccttagtggcagaaaagccatatgtcatgttgctgtaacaatttatggcaaatatttctctgtctggggtttgcctttaaatagaaatcacaaatgatgcaagctcagggtcatcacctccaagtgcaaagtcctgccagtggagaaagctgcatggaagggtttcacaggtttggggaacttttggcatgaaagagcccagctctttgagttt

SEQ ID NO: 97291 - DNA, 1044 bp, Homo sapiens
aatgggcaggaagaaaggccacattggattaaaaacatggttgtccaacttggagtaatgtagctgatgtgccagtggcttgcagcctggataaaatacacactaatagtggatttgtagtgaataaaagtttgcgtatgttcttctggtatgcactggacagccacgcttattaatagttggtggatttctgattactcagtgtccatgccatacaaattcaaaactatatcagctaaaagtgttgatataaataagtacttcaatataaataagtacttcatgggacagctttgaataaagcatgcctatattttatgtattttaatataagcaagcatatatattaggcctgggattttaaaagcattttctgagcccctttagccttttcttaaagtttctcaggggtaacttccttgggtaaacaatgtggccaagtaggcagggccttggtcaccctcctccactttgtcaaagcacctgctcttttgcgttgggttctgagtaagatttcttttgaagaaagtgctccattaataagaaaagtggttgaaatgctatgaaggttttatattaaatggtactgtggcagtatgtctatggagaccatggggattctaggggaggggcgcctaatttagtcttgggggtgtggcatggattagcaaaggctttccataaaaagtgattcctggctgggcgcagtggctcatacctgtaatcccagcactttgggaggccaaggcaggaggatcacctgaggtcaggagttcaagaccaacctgaccaacatggagaaaccccgtctctactaaaaatacaaaattagccaggcgtggtggcacatgcctgtaattccagctactcgggaggctgaggcaggagaattgcttgaactcgggaggcagaggttgcagtgagccgagatcacgccattgcactcctgcctgggcaacaagagcgagactccgtctcaaaaaaaaaaaaaaaaaaaaaaaaaggtgattcctgagtgtgtgtagaacaattgtgtatctttca

SEQ ID NO: 97292 - DNA, 1016 bp, Homo sapiens
tatatatccctatttgctcattatcatgctgtttggcatgcacctgtttgtttatcttgctctcctagtaacaggtgagccccttgaaaatagggactttattcctagtatcagagcttaataagcctaggataaatgtttggggagtaacccaccgcctccactcagagcctcttactctgctgcagtccctgctgttcccagcacacatccattactgcatcattgctatttgtttgtgtgtctcattttccccattgcattgtaaagttccttgtgctaaccaagtggtctttattcatttctgttatctggcccatagtacaatgcctggcatatatagaaggtgctaaatcagtgtagaaaaaatatttttaaacgtatgtctctttaactactcagagtggcagattattatatacctttttgtttgtatcttctggagtgcttggcttgtttaatgtgacttttgtcaacacttggtttagatattccttaaacgtcctcgggtaccagactgtttagttgcacaactagacttctgttactcttcatattaggaggagaataaactcagagacaatgagcacaatctgggcattttgtcggtcccacagtcctatcatatcctgggatatgtctttattaggcaccttgtggagagtgcccaagcctttcagtgagctgggattctcagacctcagacgggtaatacaagggaatggggctggatttgggatccatcaatgagggcagtggtaggtctgcatcaagtccacacttgtaggtggagaatccagaagcgagaagaagccagagggagccctgaaagggggtactggaaagactcccagagacaatgggatgcagcaagggccttgtcgctgcacactcacgattgagtctatgggtggagagggattgtctggggccatgagtgagctctgaagtaaacagaaggaagctggctcttggctacatgcagtggcaagccagggggccaccacagacacgcc

SEQ ID NO: 97293 - DNA, 1104 bp, Homo sapiens
tgtctatataccacattttctttatccgatccagcgctgatgggcacttaggttgattccgtatcttggctattgtgaatagtgctgtgatgaagatgcaaatgcacgtgtctttttgatagaatgcattattttcctctggttatacccagtcatgggattgctgggtagaatggtagttctgttttaagttctttgagaaacccccaaactgctttcaacagtggatgaactagtttgcattctcatcaacagtgtataagtgtttccttttctctgcagcatctgttattttttgactttttaatacttgccattctgatggtatctcatggtggtttcatttgcacaaaataagagatttaaatattttttgagttaatagcattacttaaaatggcatctgccattaatggtattcagatgaaaaagaatggaagcaattatcagacctaatcagaggaatcaattacaaaataattatgcaaatcaatgctgttcctgtatgcaagcaataaacagaaattataataaaaatatagattccattcacaataagacacacacaccataagatatagatagtgctatggtctgaatgtttgtcccccacaaactcatatgttggaacctaatccccagtgtgatagtgttagaaagtagaaccctgtctttacaaaaataatttaagaattagctgtgcatggtggtatgtatgtgcctgtcgtcctaggtacttgggaggctgaggtggaaggacctgagcctgggaggtcaaggctgcagcaagctgtgaccataccactgcactgcagccaagacaacagaacgagactctgtctgaaaaaaaaaaaagatatattattaataagtcagtcccccaaattaagctccaatttccaacacattcctaataaaaaaaaaaccaataggattttggagaaaacctgacaaaaatgttctaatacccttctgaaaaaaaattcatgtaagggcgaggcgcagtggttcatgcctgcaatcccagcactttgggaggctgaggtgggtggatcacttgaggtcaggagttcaagaccagcctggccaacatggtgaaaccca

SEQ ID NO: 97294 - DNA, 1765 bp, Homo sapiens
accggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgtctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagc

SEQ ID NO: 97295 - DNA, 2220 bp, Homo sapiens
tcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttga

SEQ ID NO: 97296 - DNA, 1105 bp, Homo sapiens
taattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgat

SEQ ID NO: 97297 - DNA, 1059 bp, Homo sapiens
aactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgc

SEQ ID NO: 97298 - DNA, 1036 bp, Homo sapiens
atgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaaccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtc

SEQ ID NO: 97299 - DNA, 1896 bp, Homo sapiens
gtagtacaatctcggctcctgaaacctccatctccggggtgcaggcaattcttatgtctcagcctcccagatagctgggattacaggtgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttattt

SEQ ID NO: 97300 - DNA, 1043 bp, Homo sapiens
tccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaaagaattggaaagaggccaaggctgcaagtgaataattcagtcgagttgtatcttacttaccattaggttctctcaa

SEQ ID NO: 97301 - DNA, 1069 bp, Homo sapiens
ggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgt

SEQ ID NO: 97302 - DNA, 1534 bp, Homo sapiens
ccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacag

SEQ ID NO: 97303 - DNA, 1079 bp, Homo sapiens
actatatgaaaacttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtga

SEQ ID NO: 97304 - DNA, 2176 bp, Homo sapiens
ctaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaa

SEQ ID NO: 97305 - DNA, 1043 bp, Homo sapiens
cgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttca

SEQ ID NO: 97306 - DNA, 1040 bp, Homo sapiens
ggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggc

SEQ ID NO: 97307 - DNA, 1151 bp, Homo sapiens
tctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattg

SEQ ID NO: 97308 - DNA, 1051 bp, Homo sapiens
tgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggc

SEQ ID NO: 97309 - DNA, 1855 bp, Homo sapiens
ggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctataatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcag

SEQ ID NO: 97310 - DNA, 1821 bp, Homo sapiens
aggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattgtaagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggt

SEQ ID NO: 97311 - DNA, 1124 bp, Homo sapiens
tgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagc

SEQ ID NO: 97312 - DNA, 2763 bp, Homo sapiens
agaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacacagccagtcaatataaaacattttttcaaggagatgc

SEQ ID NO: 97313 - DNA, 1137 bp, Homo sapiens
ctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggcggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtt

SEQ ID NO: 97314 - DNA, 1032 bp, Homo sapiens
ctagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggaaggcttggaatgctttttactgttgctcaggaatcgttttatgctagctaagcatgcaacttccatttcctgcatgtctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatatt

SEQ ID NO: 97315 - DNA, 4047 bp, Homo sapiens
cactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctacaaattgggagttgtctttggactgaatcctcctcttcactgcctgtccttgtaaggatagggaattgcttagcaatgataacctggcattaaaaaaaattctgacagctaagctgcttccttcttagaatatgttttggatgtgggagcaggctagctgtgacgtgtgtggcagaatcaactagtcagaaaatattttcttcagcaaaagaaagattttagatttgagttttatgaaacttctctagctggattatcacaacctaatacaagaaaataaaatatataaatatataaatatatataaatataaatatataaatatatataaatatatatatacatatatacgtatatacacacacacacacacacacacacacacatatatatatataaaatgcctagacaatatagtgtgccctggcctgaataaatgtctgtctaatatattaggtaatagctctccactatacttggcattacataaaatcttggccttcttggttctttgaagatcaaacaggtgttaccacccaaagaaatatgtgattgattggcacttaatgatttgggccagtggctgtgaacctttttagcctcagttcacatatcagatatacccagattaaatcactacaataatatgtaatcgtcataacctcatagagcctatcagtagctgtggtttgactagggctatggcataaataacacagactgtaagtaagtcatggcccatccagtcatagtgcctgtgattccaacacttcccctccctctcaaaaattacaggaacgtctaccagcgattgtggaattattacagggttatccttggatctatttggattcacagaggaatcactgcaaacattgatacttcattattggttgtaaattagttgctgcaaattcagtgtgtcgtgcatagtcatggtttacgcttttcccttgtggctgagaatattctagcatgtggtgttgatataggtggggaatgctttaaagattgtccagactgccagccatggtggctcatgcctgtaatcccagcactctgggaggctgaggatccttgagaccacaagttgagatcagcttgggcaacatggcaagacccaatctctacaaaaaatttaaaaattagccaggtgtggtggtgtgcacctgtagtccttgctactcgggaggctgtggtgggaagattgc

SEQ ID NO: 97316 - DNA, 1390 bp, Homo sapiens
aaaaaaataaagtcaatacctgaacctttgtgggcagaacttgcccccagaacaaccccattcccagaaaatttagagtcattcttaagcaggtctacacatttaaatcaccaaagaaatacatttattaaaatcccgatggctggacaatctgccacactgactacatgagaatctgagtgagacccagaaattagcgctgcttaaagctccccagctgactcgtaaagtgcagccaggattgagaactactttagagattattggatgttgtgaatatttatcaaaataatatgctcactgtgtggaatgcctcgttcctgtttgtggtacttccactgcaccagtaacaggagctgagaagctagaggtgcatttgctataggcagggaggcagctgagcggtgcataagggcatgtctctggagccacgctgcaggtgtgaattagcttctcctcttagaacataaccttgggtgagttacggatatctctgtgcccagtttcttggcctgtaagataagtgctcactcagaggttctttttttttttttttttttttttttttgagatggagtctggctccatcgagacggagttttactcttgctgcccaggctggagtgcaatggcacgatcttggctcagtgcaacctctgccttctgggttcaagcaattctcctgtatcagcctcccaagcagctgggattataggcgcccgccaccatgcatggctaattttttgtatttttagtagagacggggtttcgccatgttggccaggctggtgttgaattcctgacctcagatgatccacccctgcttcggcatgccaaagtgctgggattacaggtgtgagccaccatacccagcccagaggttcttgtaaagagaaaattggaccatctggaagtgcttactagttacttttatacttacccttgtttattatatagaaccataaatcttaaaaagggaaggaagcatggaaatctagttctacttcctcgtttcacagatggggagacacggtttatttttattgtcacgggaaccttttgtctcctcattcttcagtgtctaccaacttaagtcttactagtgggtgttataactacaaaaaaaaaatacgatgaacctcttaaagtccttatcaacatagatcattctgaacaacgacaagagtgaccttatttctatgttaaattctgtctcaacccttaatacagtgaccataatgcagtcttcggttggggtcagaaagatgacatgttaagataatcaacaaagcatcttgaaatcgctaggtattgaatctttgtgtttttctccccgctgacatggaagagtgtgaaaagagcagattctctttttgaaccttttctcaga

SEQ ID NO: 97317 - DNA, 1969 bp, Homo sapiens
acttagactttccctgggccaggcacagtggctcatgcctataatcccagcactttggaaggctgaagcgggtggatcacctgaggtcaggagttcgagaccagcctggccaacatggtgaaaccccctctgtactgaaaatacaaaaattagctgggcgtggtgacccatgcctacgtagtcccagctacttgggaggctgaggcaggagaatcgcttgaaccagggaggtggaggctgcagtgagccgagatagcgccactgcactccagcctggttgatcgagactccgtctcaaaggaaaaaaaaaaaggaaaggctttccctggttgggggcagtggttcatgcctgtaatcctagcaccaaggcaggaggatggcttgagcctgggagttggagacaaacctgagcaatatagggagaccatgtctctaccaaaaaaaaaaaaaaaaaaagcagactttcaccaaactatcaaagtatattttcttctgtagagagttcaagactttgatttgtcaataccattgccatcttaatgcgtgaaagagaagtatatttattaaatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactttaagaaggtgtgggaagaataaaacaaaataggcttttactaagctgtattctggaccttagagtgagagagcagtgaagttatgcaattgaaaatagcattgcttggtgattttctaaagccatattaactcttttgagccatgatggtagcatagcatttggtaaataacaatcacagtgtacaagtaagtgatagtttgcaaacctgaactgctgtgagcaatttccagatgtcccatttttgttcccaagggggagtttattcagaggaaggtctgatttattggttgaattagaattctaagatatcatgagtcttaatcatttgttctactaaatgtctgttttatacacacccctatcaccacccccagtggggctcctattaagtgtttaaatgtagaattaattactgtctcgagaaattgatgctagctcatattttttattcagctttatatccatcgaaatgcctgaaataaaacaatattccacccaggtgaaacattttgaaaatggcttaaagaatgtatgggctgggcgcagtggctcacatctataatcccagcactttgggaggccgaggcgggtggctcacaaggtcaggagttcgagacaagcctggccaatatggtgaaacccgtctctactaaaagaaaaatcagccaggcgtggtggttggcgcctgtaatcccagctactcgggag

SEQ ID NO: 97318 - DNA, 1631 bp, Homo sapiens
aaaaaaaaaaaaaaagaagaagaagaatgtatgcatgcatgtgaattggactgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaaggtttgtaaaatagtattacataacctttaccagtacttttctgaggttaggaatctgctctgaaagccaaatattccactaggttctcctattaagaagtgccatttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctttatgtttttataaaacaatatttagaagagtgattctcaacttgctaccctcaaaggaccagaattctttttttggtctggcttttcttgggagggggaggtcatttatattgacttacagggtttctgctgtaatctttgctctttacaacaaaatttgaaaacaaattatgctactaatattgagagtatcttttttccccgccaataatacttgctggttgacaagaaaatgggtgaggagtgaggggcacaggtcctggtgggtgaaaatgattgccctctatcagaagcttgtagtctctcttcagttgtgtttcatcagccagcagcaaactagaggaaagagggggtggctttcaatctgataatgtaaaggaaaagtgcactgaaacacagaaaaactgaccgaatatcttagaacagcagcagaatgttctttcttccaagacagcaaaaatgtatttaataccttacaaaatcttttttaaaatatttattttattttttgtagagttgaggtctcactctgttacccaggctgtccttgaactcctggcctcaagcagtcctgccccagagtgttgggattacaggcataaaccactgcacctagccctaaaatctttttatccaagtagttaaacaagtagtgatgggcacttcaagcattaacacgaattttttccttgaaattccagtggcataaagatcttgtgccctatgattgaggcactccgtattatat

SEQ ID NO: 97319 - DNA, 1156 bp, Homo sapiens
ccttaatttcaaactagagataaagggattcattgctccatcaaatacgaccatcgctgttactactatatgaaaaaaattgctttcctttaaagaaatttatgacagttttttaaatagttctaaaaatatagctgaaactacattttcaaaaatgttttgcccatcatttactaaaattataaaagtgtttgaacagagttttctgctttaatgtaactagttaaaagtgttttgaagtctgactttggaaaataagcaaaatttagttggagtctttaggtcagaatatccttcaaatcccccccaaattgactccattaaaaaaaaaactttaaatgtggttataagaattgtgattctttggcatatttccatcaaattttaaaacttcaaatagtgcatatgtacttgaaaattacactttctcttttctaaaaagctgtatttttaatacaaccctaatgtatttcagaatgcaatgagagccactatggaacaccatgccaacagaggtgtttacccccctattcaagttcatgtcacgctgggtaatgaggatttgactgtgaaggtaaatgtgtttaatggtttgttttcttttttttttttttgtaattgatgaacagacatgcaaaggtaaccatacgcataatttctaaaagacataatctactctcaggggaaaagaatcttgtctgtaatagataataagcacattgcttcattgagctggtggattatagttatcccttgagtcttttctatgcaggtcccccgtcgaggtgattcaagttaaaataaatcttggagacagacaatttatcattaatatctctttgataagtaagatctaaaatatttgggtagttgcagtattatggagatagtattttatatataatttaaaaaattttaaaacagtgctttctaatctactggtttcatttgattctcatgacgtaggtaattttatcctcacttttacaggtgtggagactaagacacagtgattagctcaggatcacacagggcagaaatgctatgggacatgatatccagtcttctgtccccagtgctaggccttttctattacattgttcaggtggcccagtttcttcttttacattttattaaaaattgttttctgtcaccc

SEQ ID NO: 97320 - DNA, 1015 bp, Homo sapiens
cttacgaacatatcagaaagttttctggggttctaggctgtaaaattgctggtagatggaaatacaaagtagtggttctgtctttttctccctgaaaatgaaaattatactgtttttttcctgttaaagtaattgtgaagaaaattcagaaactgaaaaccccaaacaagaagagaaaattactcattctacagacaataaaattagatatcatttcagacctttttataatagaatttttgcagagtattataaatgcttctttgtaactgttttttttttgtttgttggttggttttttttgctgcttaactatctcttatgccagtatatggagttctatataatatctaattaatggttaacaatattctattttagaatgtactttcttttacttaactaatcccctatttaggttgtttacttttaggtattctgcatagagctgtgatggatgttctcatatatactttgcatgcttttctgcttattttctcaggataaatttctggaagtgacattgttgtgtgaaaggtacatgcttttttttttttttttttttttaaatagaggcagggttttattctgtcacccaggttggagtacagtggtgagatcatagctcactacagcctcgaactcctgggctgaagtgatcctcctgcctcagcctcccaagtagttggggattacaggcatgcactaccacatctgggtaattttaaagttttttttttttttttttttgtacaaacggagtctcactatactgcccaggctggtctggaactgctgggcccaagtgatccccctgttatggcctcccaaagtgttgggattatatgtgtgagccaccagacccacccaatatatgcttttctttttttgtttgtttttgttttcttaatttagagacagtggctccctctgtcactcaggctggagtacagtggtgccatcatacctcactatagcctccacctcctgggctcaagtgatactccttcctcag

SEQ ID NO: 97321 - DNA, 1026 bp, Homo sapiens
gatggagtttatgtattagagtttcacatattagaggagttgggttgggttcaacagcgagggaaatgcttatattggcaacttggattgtgttgtattcattttcaaaagcagcactcaggctgggtgcggtggctcatgcctataatcccagcactttgggaggccaagacaggcagatcatgaggtcaggagaacgagaccattctggctaacatggtgaaaccctgcctctactaaaaaaaattagccgggcatggtggcaggcgcctgtagtcccagttactcgggaggctgaggcaggagaatggcatgaacccgggaagcagaggttgcagtgagctgaggtcgcaccactgcactccagcctgggcgacaaagcgagactctgtctcaaaaaaaaaaaaaaaaagcgctctcccaccagcagttaaactgtgatgctatgagtatgtgttgatattttgctgttttgaggatttgggcatagagcacgatccttttcttaccttagatgagtgaccgaggaggtggcgttcctttgaggaaaattgacagacttttcaactacatgtattcaactgcaccaagacctcgtgttgagacctcccgcgcagtgcctctggtatgttatcaagaaataatgaagtgtgtttctgtgaattgccttccacatgctgtagctgccaaataagtaagttaagccgtcatgtagggtactccacaaggaagaaagaagctcttagaaatgcacactttcccctaaatttaaacagccttcagaatacttttttttttttccaactgaaatgggcacgagacagagatttggagttcttgttacaaagtttgatcgtgatatagcagtagttttcctgtgtaaaaccacattttgaaatatggttaaccacattatttctaatgtggggaataaattactggttttagtagtgtttggtcaacactgaattactttttagtgttgacttttttctcaagtacttgtcattagaatgatctcatatc

SEQ ID NO: 97322 - DNA, 1429 bp, Homo sapiens
tctctttctctttgacttctttgcctctctctttctgactcctctttgtctcttcctctctctgactttttgtgtctctctttctctctctctctgactccctctttgtccctgtctcttcctctctctgtctctgactttgtctctttctttctttctctctgactccctctttgtctctctcttcctctgtctctctctctgactttctgtctctttctctctttcctttctgctggtctttccctgcctctgccagctgcttatgctgctcttctcccctctcctggagaagtccgcagaccaagaacccactggaaggaaccaattccagacacaatacgaccgagcaggccagcaaggaaaagcaatatgctttttcgagaccaaccacaagtcattttatagaaagaataaagagttttaaatgaccagagggaagtcagctgatacagtactcaagtaaacctcagcttaatcattgtcaatgcttaaatattaattatattaaatataatgcatctctcagatgcgggctctgatagccccgtggtactcaatggcatctatcttaattagaaaagtatttcagtgtgtgtctttctgaatagaattttgtttttctcatcaaacaggctggttttggttatggattgcccatatcacgtctttacgcacaatacttccaaggagacctgaagctgtattccctagagggttacgggacagatgcagttatctacattaaggtaatagctgtagtcttcttgatttaatatttcttttgatgataagaacagatgtccatacttaactgtaatgaaatttaactctaccacatgctgtttaaatagaaaaaaactatggttttttgctggggatctcacccattttgatagatgatcccctaaaactatggggaaagagatttgtatcctggagtgattaggactctgtctattaataggaaaaaaattgggttaaagtagagaatcataagttatatatcatacaagtttaattttaacataaaacacatgaatggacattgataacgccaaacttttgatgtactgccaaggctttttttttgtatatgggtctgcagattggagtgtcacattgtcttttttgcaaaagctgtactgacagtgcatcattttagtttctttaaaccaacaagtgcatactctttttggacttttatgcagtcctttacagatacctcctgactgatttgacagcaagttttatgtgactttccttcatgagtctttccaaaacattcatcttagttttcaaggaaacattcccctttttattctttgcttatgtaataaattttgtaattatcatgacagaattgtacaaacagatttgggaacaagcacaagtgactcttggtaagcatatagcttacctaatggac

SEQ ID NO: 97323 - DNA, 1432 bp, Homo sapiens
taaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagc

SEQ ID NO: 97324 - DNA, 1669 bp, Homo sapiens
gtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgtaaaaaaaaaaaaaaaaagtcttaatttaaccagcattaccctctgcttgtaccaattgaatggcagaactactatagtcaaaaataaattcctatcctatttttaattgatgggatataggcagcacaatttcccttcattgttgaagccaacaagttccgtaacagaactccagaggtaa

SEQ ID NO: 97325 - DNA, 1738 bp, Homo sapiens
ggcccagaagtgcttacccaggccgtcgcctcgtctggcctcgcttgcccatgacagctttcagaaaactttaattcaggactggctagatgacatccgattgcctaaaaaatttttttaaaaagttatctctgttagatcgctgaaaatgttatgtttctgatgcgctttgagatcgcgcataagtactgtttatggggaacttaattactatttttgttagtttctgtaataatgaaagcaacacaatttaggggcccattccaagtatggtacagtaagcagctctcgatactggtgtgtgagaatcgtcttacagagtgaatttgaggatgtttgacttaagattgttgaaaactgtactccttctttaaccccgaagctgttttggaagagccttcttgcttcctcgaccttcgttgaaatgaacagctaggatttagtggatccaaacctccaaacacgtttaaagacaaaaataaacaagtgattcaaggctagttaatgtcctctttgtagtaggcctatctccacagtgaaatttcacttgtttttcaattttccaaaaaaaaaaaaaaaaaaaagtgatggctgcattttaattatggttatggtcatttgtagagtctttgttttaaattcctgctactatagtgagagatttaggagattgtaaatgaatacgaatttagtttgggaaaacagaattaagataaagaaaaatggtcttttggaccactgcactgtttattttaatctatcacaatttaattcctactataactttttgagattatttggggagttttttaactacaaaatattgtttaaataaaaaaatttagtgataataattccagagtaaatgaccatgatgcaattgcaaggactttctccgttgtctaaaaaagcaaatagatgattgatccgtttttcttaatcttttagggaatatataaggacacagtaaagagagaaaaaaaaatccaaatattaaacactcggacttggatctaaaaatggatggtcaaagatcttgggaactaaggggccttcttgccaaataaggaaacttggcaagttgcactgtgtattttaacttagcacaagagtgagtgttattggcaatatattggctcagagcctatctggaatgagcagtgaaactgactttgatagggctacaaaattataaataggtttgtgggggcgtggagtgaataatcgaatcatcagagaaaacactgaaaacttttcatgaaaataagtcagatgtaaggtgaagctattagtgtggagtgacagagcaaaatggacagtttattttagaaagtggtagattcagaagagaggagagaatcagtggtttttttgtttttgttttgtttttgtttttgtttaaactggaaaaagatgtttgtggggatataatacttcttggaataagatagccctatgtctgtatcctgagatgttggaaataaaaatgaatttagatcacttgttttccattttattctacccaggacagattgacagggtgagtatcttgtctatctaaatgtagtaggaacagttaaggcaccttttggtcttactgcaaggaagatttaggctagttttttggtagctattaactttgccccactagacacaaataagcagagttccagctgtgaccagaaaattgtacctggtaagggaagaggactatgaatgctagagcttagattgattc

SEQ ID NO: 97326 - DNA, 1077 bp, Homo sapiens
tgtggattttgcattctcttctgtcctacactgttttacttaaattgaacaaatcgatacagacacatattttaaaaaagacaaattttttttttttttttttttagaaacagagtcttgctatgttgtccaggctggccttgaactcctgtgctctagcaatcctcccacctgaactttccctgtagctggggctgagggtatgtgctaccttgcctggcttattccccatagtgttaaagtgaaattgatgctgtaggacagctgtttattcatatcaccttctgcacagtactgtgtaataccacgtatgggaataagcacacgaggaacatgggattggtcctaataaagagtcctgcaccattaagctctgcagcccaatactgcatggggtagtgcaattccattttgctgataaaagaataggggtagatcatcatccaaagagttttgatgttaggtggttatacgatggctttcaagacaaagagatctctttgctttgggaattggggggaaggaagaggaaagttttaggatagaaacctggaatgtggctcttagcttctcacccagtttgggaggagaaattgaagaagatggccaaatcgtttcctttatttccatcactgatgtggttcactgtgcttctccatgatgtttggtgtcgggttcatgactgcttccctcagaaaaggagggagaccgtctatactttatagtagattagtcatcaactcaacagggttggagtgggtcttaaagtggtttcattctgccctcttagctgatgcaagagtctcccactcccactctacaccgcatatcccattgaacgctcttggtgatgggtcactcactactaaagagggtggcagattttcttgttggccaactctaaaccaggaatcctttgttttttttttggagacagggtctcactttgtgcagtggcataatcatagcttatggcaaccttgaactcttgggcccaagctatcctcccacctcagtctcttgagtagcagggactacaggcatgaaccaccacacctggctaatttttatttattc

SEQ ID NO: 97327 - DNA, 1032 bp, Homo sapiens
atgctgcaagaagctcccagctactcaacacaacaagcccacgcagcggcctatgccgtggccgtaggttgtatccacttcatgtttccttgttgggcttctgtttgagcacagacatgtttccacgcagcatttctgtggcgttaagtgctcccaccaactacattcctgtgcctcccatcttttacttctggtaacaatacttttggtaaggaagtgtgttgtggaagttgacttttattaaattactttaattatttcaataagaatgcctcactactaaattactttaatatttcaataagaatgtttagcttatttttattcttaccattgctctaactagagagttacattacttttatatggtaaagatagaggaagggggaaaatatgaaacaatggctattctgttttttggattcttatttaaagttgggttctctcagatatctatgcctgaagtcctatttactgaacccaacctactctgtataagatacactatttttctaggagcagccttggaggaagaaaggaaatatctggtagatacagtacaagttggttctgttcctatacctagtcttgcaacttttatttttttattttttattttttttttttgagacagagtctcactgtcacccaggctggagtgcagtggcgtaatcatagctcactgcagcctcgacctcctgggctcaagcgatcctcctgcctcagccttgcagagtgctgggattacaggtgtgagccactgtacccagccagcttttatcttttttagtgattaaaaaaaaatagtagaacagcagtcctgttgaggaatagaatctttgaatctttgaccttggtgttacggacaaatacactgaaccagagctttcctcatttttttgaagataagactcaggggaaaaaaattgcagaacagtgattccaagtggtgttctttttatacacatgatgacaaagcacatattattaatttattcactgatctatgttaaagaggctgaaataatacta

SEQ ID NO: 97328 - DNA, 1065 bp, Homo sapiens
atagatcttagcaatgctaatgtccaaaaagtgcaaaaaaaaaaaaagaaaagtattgtgttttagcaatttaaatacattatgaaaaaagcttaaaagaaattataattacttactaataagatctttcagaaatgacaaaaaccaaaaacggcagttaaacagaggaatgagaaagaattagaaaataggcaaagagagggaaaggattcagggatcaatagcacctttatttgttaataattgctctacaaaactaagagatataatataaaacaattctgaaaatggggagaggaaagctattgagagcatacctgaccataaaaactgaaggaatagatggctaaatatgatatcaagggttattaaaataatgagaaaaccataatttccattaattgcatgtataccatatactaggcactgtgctcacgtatgcactttcacagcactggtattattgccagtgagaacagtgaggtcagagagacacagtgccttgcccaagtagctaataacagatctgctcatagatctctctagtaggggtctttaccctgaatcatgctacttccctgttgaaatatctcttatttggaagtgagatgtatcaatgaagtcaaatactatgcaaacttgataactttggggctatcagttttgtgacattgaatggaaaagatttgaaattttttatttatgcatctggaaatgccacagtctgagaaaaagtgatttgttaaagttaccgagaggtggagggagagttcaaactcctatcaatctaattctaaaaccttgctttttaacattagaactgtagtggggtcatttttgtttttaatttggggcaaaagtaacagtgaaaaggtaaatgacttatttgaggtcaacatggatctgaaaaatcaagaagcaaaatagaaggtctgtgaatagagaaacttaagtctatttttttggactagaagattgaaaactttaaaaagtaaaataattctttaagatttcctaccttcttatgtttccacttttcataattaggtgatgctgctatatatg

SEQ ID NO: 97329 - DNA, 1029 bp, Homo sapiens
aggatttgcttcagaaccctccggggcacttgtaaaaattacacaccttaagttttacatgacttggttgaaacctttccagctacaaaaggtataatggaagaataaccagaagctatttactcacttattcaacaaatgcttttttaatggaaaagctgcctaactgtgtacttggctgtgtagtaggtgctgaggatccagatgtaaacagaactgagttttgactttagggaatttatagtctggtgggaattaagtgggaaagataaatgggtaaagaaaggtgctgtggcacatgagagggagaattcagctgtgctcaggagactcaaagaggtggtcagggataggagtttgctgtgcagagaaaagtatttgaagcagagacactagcctgtgtagaaatgtggagatgtgagaggtcagtgtatattgggaagtgcaggcagttcctcgtgtgtgtatgggaaatgagatgacatgaagtcaaagtggctataagtggtaaatgaataacacaagaaactttcttggaattagaatacatgagttacagatagaaagagttcactgagtgtcctaccaatgaatgaaaaagactcattcctaaacatatcctattaaaattcaggattcctgggatcaatagaggatcctaaaagctttcagagaggaaaaaataatataaaaatggttaataatcagtaacatcagactgctcagtagccacattagaaactaggagaaaatgaagtaatactttcaaaattatatggaaaatcatttcctacctagaattgtatgcccaaccaggctaccaatcaagacattttaagatatacagattctcaaaaaattctattctgtgtgttctattcaggtaactaatgggagatatgtgtgtcatcaaaacaagggagtaaaccaagaaagggaagatgcgaaatccaaagacaaggttctcacagaggaaaaaggtgaaggaaattcttaggatggtagccaacaggagtcccagtccaagtc

SEQ ID NO: 97330 - DNA, 1143 bp, Homo sapiens
cagtgccagaagaaaatgctaaaggagttgaaattagttgcgtctagagagtgggaattgggtatggggaatggggagacaggaaacttctattttttatgataagctttgtagttcaatttcattttaatgcttttataaaaataattaacaaaaatgtaaacctagtgtctgtaatgctgagggaaccttgcaaatggtgtttgacatttggttgaacaaactttttagcttgcatactctatatacctacccttggcaacattcctgaattttatacaaattttgttcttttccatgtttaactaaataggaattacaaaaaagttggtaacataaactgttgattcacatatgtttatagactatatttggatactatgatctttccctcactcatatttttatgtggagtgtatcttctaaactttagaggatgaacaaataacccttcctctttctcgccttctccccaaagtagagcagcgtttgacttcatgtgagaaatcagcattcttcagtgacctgattttcctgaaatgggatggctagccagctgcatgctaagatctttgagctgcctgtgcacttcactcagcagagccccaggctttttatggagaaatgttgccagtttatatggatacaaaccaaccccttctacctttttatttaaaaaaaaaaaactcacagaagaatggaaagagtagtaaaatgtccagatacctgtcacctagatgtgccagttcttaacgttttggcacacttgctttctctctccctctctctattcctatgtacttttttggatgtgtgtgtcgggggacagggatgaggactgaaccattttaaagtaaattatagacatcatactttaaaatggctacatgcatttcccaagcaatacatccaaggacatccatctataaagcaaaaataccattatttgccatggataaaataatatcatctaatttatagttaatatttagatttctctaatatcccaataatattttctatagatttttttatccagaatccagtgatcataaattatatgtagtcatcgtgtttccctttttttttttgagatggagtctcgctctgttgcccaggctggagtgcagtggcactatctca

SEQ ID NO: 97331 - DNA, 1010 bp, Homo sapiens
taacattttacatttgctttttctctatatgttattgatttatatgtattcatatatattgtatgatttttgctgaacgatgagagtacattacagatgccatgtacctttatccctaaatacttcagcatctcccaaaacacaaccacagtacaattaacaaattcaaaaaatgtaacaatgataacaataatgttacttgttatacagtctatattcacattttgccaacttttgcaatgcgagcttttgatggcaatttttccaacccaggatccaatccaggatcgtatattgcatataatcgacatgtctgtttagcccggcttaatctggaacagtttctctgcctttctctgtcttttaagacgtagacattttggaaaagtataggataagtgttttgtataatgtccctcatttggggtttatgtgatttcctccccagcccccagcctagtcagagtttatgtagttttggcaggaaaactacataggttgtgtgtccttggtgtgtcttaatgggtgtcttgtgatgttggttagtctcattattgatgatgttagttttgaatgcttagttaagaggggtttacccaatttctccacagtacaagaaaatacctatttttcctttgtaattaataattaagctattggtagatactttgaagctaagtaaatatctttcctcagcaaacatttactaatgtttttagcatctattgatgattcttgtttggatcaaatagtactataacagtttactgtgcagaaagtaaaaagttctagcataagtgagtttgcccttattttttcctttcttcctttagtcaaccattcattcatgtatttattgtttgatcgtatacttaaagactttttggaattcagaatgttataatccattagtgttattcattttcatgcttaaactatcccaaatttagcaagtaagagctctttccagctggctcttgtgtccttttggtatgtcgctgtcatttttt

SEQ ID NO: 97332 - DNA, 1046 bp, Homo sapiens
aaaattagccaagcatggtggcgggcgcctgtagttccagctactcgggaggctgaggcaggagaattgcttgaacccgggaggcagaggttgtagtgagccaagatggtgccagtgcactccagcctgggctacagagtgagactctgtctcaaaatcaatacaaaaacaaaaacaaaacacaattaatcacagcaacttatttgtactcttgtgtatatttgataataaattgaacaagatatgtctgtacatagtatttttttttctgtctggaagagatgggaacctgacagcctttatgttaacttgaaatctgttgatactcaattgaatcaaaaggaagcagaatccttaagaggtaatatataaggccttttcttcatctgtcttggcttttgtaagacaccactacccttattttaaaagaaaaagcatcctaccaaatttcactgctttagaaatgtcggaagccagataaattcaagtttcaaatttattccacgttataaatatttatagataaggagagaagatcaacatgtcaaactggttataataacaggaactatcaataatttttatataaaggggaaaatacctgtgtgaaataggaaatataatcttgaaattgacagagaaccaagagcaaaaaataaaaagcttttattatactcagttaatcaatatgatatcgtttagtgatttatggaaggctagttaaatgttatcactttattagctcatgggagggagacccttcttcttttctatgcagttctgttgctaactttttattaataaattctttaaatttgttttaattgtaagtgctattttaaatatttccccctgacccaaacacgttaaagaagaataatgccacatttactttctttgtaaatcctctcaatatttaagtatatcgatgggaccaatacaaataaaaattaattatcttagatatttgacaatcgctattgagttctggcatagtttctataataactcgtccaaagcggtgctcaagagtggccactggtatt

SEQ ID NO: 97333 - DNA, 1026 bp, Homo sapiens
tatctaggcctcatgctgagaagggatcagatgccacatatacagttagcagcaaaggcagcctggcaaggctcagggtgaatacagtgggcaagcacatgtgtggtgcatttgatgtcctgttgtgaactttctgagagcaggactgtctttgtagctgatgctgtcactagacatcatcactctaccaagtactgctaccactgtgagcctgaatttggtgaagggctttacaccattgccctcttcttcttcacagtcactttataagattataatctgcatttgatggaaactaaggctcagggaagttaagcagcctgcctaatataaacagcatcgttcacttgggtcttccttgccagcctcacaacacctgccattgtgctttgctcccagtgaacattgaagtatttgttccttgatacctggtattgtgtcgcagtggacatacctctcatttttgttcatctaggaaatgtatcttgtattgacatacctacattttcttcatttactctgctttgagctgtgaagagggtagaactcgtgtctttaccatgtcactgtaagtacagtaacacacttgcattcacctacatagtaacaaactcttaggtattgccctttctgtagggttcctgatgtctggtttttataaatgcccttgcttttgtgccttttagactggcatgccatttctgcttaaggaattttaaacgtgtcactgtgcagtgctttaacattgtgctacgtatataaatcatcattttgaattggagagtaagcaatttaaaataatggatcattttatttgataatgaacatagtcatcatccggaagtatatgttgaatagccatccatcactctgctcttttctaccagacatttctgttactgggagcttgtaatctaagacactccaaggtgaactgctataaaggtgttagaggaaattggacacatgttgagcaaataaatgtattaaaatgagtaacatgtattactgatatgtctgaagata

SEQ ID NO: 97334 - DNA, 1605 bp, Homo sapiens
tgaagtaaaaccaattaacgtatttcagtaaaaatgttacagcctgagtagctgatgttatacaaagctaggctcttgctattagaagaaaaatagtatacagcatgaattcaattcctgagaaactcaaagcctaatatagagaattgagaaattgaaaaattggaggagagaaaaagcagcccgtaagtatttcagatagtttcaaaattgatatgactggctcttagtcttcaaaaatagaattatctcacttgaatatttaaaaagtacctagaattttcttctctgttctgtagtgaagatgggaagtcactgacatgaaattacccaagaatagaggccatgttatcaattttttttcactgatgcttgactcatactcccggttaggacatccagtttctgtttgaacactgccattgatgacatatgagatgcagtctgctctagtttggaacagcttcttagaaagtcctttataatgtaacttccagccattgttcctggtccctgcctccggggccatatacaacaaatcttaccttcttccatgtatcagcttctagaggatggcatctgtaccttattgatctttgtactttctggactctacacagtacctggtccacaataagcagtcaataatggataggatataaatgaaaagaataataaacataatgatcacatctcaactttctcttctttgtaagatttacagaaaggtttcactgttaatgaatcttcagaaaagaatacagcttgccattcctaccctactttatagccttttcttctccatgtttggctgattttttgagttcttaataaattactttgtctttgaatgaagggttctgttctatagcagctagaaaggatgttttcctggccgtggttcttatctggtttgtttttgaacatatttcccaaaaaggaatccaagatgctttttcttagccctgctaatatcagatgttcactgattcatgacctgagaaaaattaaggtgtcctaaatgaaatgagactgccagaattttaatgacttgaaaatatgactcttatccctgatactgttcttcaagaaaataatgcttggcagaattaggtgcattagagaagcagcactggtaagtatgaaaatgtttgttaaagagggaggagactgtatggcagctctgctttccagagattgtattcagcaagtaatgtacaaaatcagctgatctcacgacattttaaaaacatgccaagcagtgcttccattagtcggaaactgaattgcttccattattggaacatagaatctaccttaagaaacatatactcataggtgggcagatcacctgaggtcaggagttcgagaccagcctggccaaaaccctgtctctactaaaaatacaaaaattagctggtgcctgtaatcccagatactcgggaggctgagggaggagaatcgcttgaacccaggaattagaggttgcagtgagccgagatcgcaccattgcaatctagcctgggccgcaagagcaaaactccatctcaaaaagaaaaaaaagaaaagaaaaaaagaaatatatactcatttttattttaatca

SEQ ID NO: 97335 - DNA, 1034 bp, Homo sapiens
agttgagaagatatgggaggaggatccagctagaatacatgcggtcctgtaggaattggcatgagaggtgagggggcagccggagccggttgtcttgtgctgacctgcacagggataagggcacccagagcctagtcctggagtattcaggactcgcctatttacatgttttaaaataaaatatatgttttaaataacatcttctgccttgcgctgcaaatggaggcatttaattcctaggaagcaatatggcttcgtgtttaagagcctgggctttagcgtcagacaggtgtagattcagatgctttctccactacttattagatttatgggaaagtgactgcaccaagccttagtttccttttttataaaatgcagataataatagagtccacttcataaggctattgtgaggaccacatgaggtaatctgggtaagtacagtgcctggctcctactcagctctcagtgcgtgttacctgtggcggttagggctatgatttcagcagcagacagtcggaacatattcgagatttctcctctcccctgtggcttgttagcactatttcagcataacttgcttttttaagacttatagataactagctatttacatcatcctagagtataatgtttcccaaacttaaaaaatctttgttctctatggtggtttctcatcctttttaaaaaaattttctcaccagacaacaatattttgtcatttacttactatattttgtgttataaactgggatttttatttttttttttatttttttttgagatggagttttgctgttgttgcccaggctgcagtgcaatggcgtgatctcaccgcaacttctgcctcccaggttcaagcgattctcctgcctcagcctccggagcagccgggattacaggcatgtgtcaccatgcctggctaattttgtatttttagtagagatgggtttctccatgttggtcaggctggtctcgaactcctgacctcaggtgatccgcccgcctcggcctcccaaagtgctgggattata

SEQ ID NO: 97336 - DNA, 1248 bp, Homo sapiens
gaaacaactggtataagataggagaaaaagttaaaatatattacatttacagtaaataaaccgaacctttcttctttcttggagaagccttttaaaaaattgcctaattctcaagtgagatgggtgtgggaattggaaataaggtactaactccaaaaatgcatatgttggttgggaatacatcagtaaaatttatcctatgttaggacaaaaaaaaaaaaagtaagacataaaggctgccccataattcatgcatatcaaccaataataagaatacctgcaatcccttattgaactcttcccatttgtcaggcattgggctgagtgccctgtgtgcataggtaacaccccagtgggttaggaattattgccaggacgcaggtgaagagatggagagaagtgaacatacatgcccaaagtcatatagttagtaagtgatagaatctagaccttcgtacctgccatgcacacacacattatttcaactgtccctctgtcaaatgaaccatacctatttttttctcatatctcataccagttgaagcctttccacaccgagtacaatttcatgttgatgcaaaagattatgaaaattcttgaaatgatttcaataatttattttcctctgacacaaggttcatctcacactcctcctccttcatgccttctccagtatttccaatgatagttttctaattgcagtttccaagaaatgacattgatttgagtttatgcatctgtaaaagatccaatcacagcagcatatggaaaacattatagttgacttatttatttatttatttatttatttatttatttatttcagatagagtctcgctctgttgctcaggctggagttcagtggcatgatgtcggctcactgcagcctctgcctcctggtttcaagtgattctcgtgcctcagcctcctgagtagctgggactacaggcgcgcaccaccagcccagctaatttttgtatttttagtagagaggaggttttgccatgttggccaggctggtctcaaacttctgacctcaagtgatccactcgcctcaggcccccaaagtgctgggattacaggtttgagccactgagtccagcctaaattgactttaatgaaaagtttccatgctgttctttgcattaattctcctttagctgtttggagactttgcttaatctcatgattttagtacattgttgagctgattctttcctgaaagtgcaaaataatcacttcctgttc

SEQ ID NO: 97337 - DNA, 1107 bp, Homo sapiens
attaaataagaacctgtttttcctgtggtaattttaaaatttaaaaatttcaactattttatatgaaatatgctccttcaaggaaccaaaaacattcttcagatcaattttagaaatcttttctttttttttttttttttttgaggcagagttttactcttgttgcccaggctagagtgcaatggcgcaatctcggctcactgcagcctctgcctcctgggttcaagcgattgtcctgcctcagcctcccgagtagctgagattacaggtgcccgccaccatggcctagctgatttatttttttatttttagtagagacaaggtttcaccatgttggccaggatggtctcaatctcgtgacctcgtgatctgccctcctcggcttcccaaagtgctggtgagccaccgcgcccagccaattttagaaatcttaaacatttaaatcaaagttgtagaaatatgtaacactatatgaatacttactaacagttttttggagtatttactatgctaagctcttgcatgcattatttcatttcattcttaccacaatcctgtgaggtaagcactatcatagctcatcaaatctaagatgcctttggtttaaaatattatgcaccactaagaaaaaatgctgccaatggaaactgtaagatgccaccaattgtaatacagccccagtgtcagtgataccaaaagaaacatgcatcttacaatccatgaatacaacagcattatcactgttttacatctgaagaaactgagacatagagaattcaataattgccagagatcatgcagcaaataggagcagagctgggatctgagtcctggtctgactagataggtcttgtgtttgtaactgttgcatttgtgctttcataagtgctttcattaagcgatatggaggtatttagaaatgaaactttaccagatgttttatctatacttgacctattaaaatcaagttggaattgccttttctaaaattacgcataatcagaaattataattgaagctcacttaagtggagtcaagaacttggggccaaacatactattacaaaaatagaaaaaggacatgaagagacatttcacaaaagggtag

SEQ ID NO: 97338 - DNA, 1049 bp, Homo sapiens
tcaatactctctaaatttgtttaaggaacctctaaaattgaggcaacataagttgatatatttccaaagtgcagaattgcattatgcgtcaaaatgtgcttacttttgacctcggcatttcacaactcagaatatatcctaaggttatggtcaaacaagtgcatctgatgaatgtgcagagatgttcacttaagtgtttttattatcatgaaacatttgaaacaacctaaattttcaacagtaaaaaactgggcaaataaatgttggtattttcattcaatgaaaattaagctagtatggaaaacaattgtctagacccatatttactgacatggaaaaatgtccatttttttaaataaagcaccttatagacaatatagatttgcttaatgaagaactgccctgagataatatccattaatgtttattattctcaaaaatcagaaacaaaaagggtaatgagaatatgtcagtatttttatgctatcaaggagacagggatactcatatttttatcctggactctggaattagttgcttccctctctgatgtcttcatctgtaaaatgagagttaaaaaatagaaagattgaaatctttccagttttagattttaaatgcacgttcactaaagtgcagaattaaatatgatatgagaatgtgttggatcctgtccaaagtatgctggttaacagagaaccaacatgctagggtgtgatcagtctgggacggtgctgagcactgagctgtgaaagtgttctatatggaacagactttgcgattctgttctcaggacactgtctagtagataaaatgagaccagcagtgagacagtgggaattcttgctgatgattgttttatgccatgtaagtgcaaaacaacaactttaactgcaccaggattcagaatgtgacaaggttttaggatctatcaaaattctactgaaacatgtggctatgactaaaacaaataagatgcttctaagaacagattgtgacttgtctatcagcccctttgaaaacaatgtgcatgctatttattagggatt

SEQ ID NO: 97339 - DNA, 1066 bp, Homo sapiens
agatagggaaagagttgcttaggaattcaacgatttcattttgaggtggagtgaaaaataaactgcccagagataggaaccatgaaaccagtcatatatacaagtagttgtttttgaaattgtcaaatgaaaacatgtttgaaaatgagtaccaattaataacagttattttatattgtctgtaagccaaagggctaggcagggttctttatttcagctaggaaattatgtggtatattagatatttgcagaagaaagtattttaatcaaagctgaataaaattcagaaaatcatgtgtagaaatatagaaagatggcagtggaatggtaggaggcaagttctctaagggtctgctcaggtgcactcagtgttgtgaacctcaggttgccttggggttgatgacaaagcaaagatttcagaaaggagcaagttttaagaataaatgtgatgtgatagaagcagaggcaaggttggcagctaactggtttggtgtgatttcatggtttgcaaccaggactgagtgtctgattctttgattttctagagacattcctaatttcatccctaactctccccagataaattctcatctcttatcaaaaacaaggtccctggaatggaaagtcagggaactccctgaggaaatgagtgtttagctgtattctcagtcatgtaggttttgttgatcatagatatttttgaattgatgctttcttgtccccatctctccttcccttaattcaagtcatacttatcactcctttcagcctctggttattccccctttctgattcatctgtcatatggacctcaaatttaaaaagaagaaaaaacagatcagatcatgtcatttctgcacaaaaatggagaaacttttgttggttctccattacctatagaaaacttctaatccttaatatggcatttagtccctttacaaaagtcaccctcaacaaagctttcgtcttctcctccggctgactccccaccccttgcaccccatgtaggctgtgtatcagctttaagagagggaagaatcctctccgaatgagcagtgtgcttttt

SEQ ID NO: 97340 - DNA, 1764 bp, Homo sapiens
tgtctgtaactggccccaaaaaggatttttaaaaaagttgtctgattttgtttgttaatatgcttatatcctgacctctctgaaaatctgactttgaccgagaagcattatccataagtggcctcacagaaagactcaaaaataaattttctggatttttgttagtatggtttttctgaagttaatcctacaagatggaaggaatacactgtttcttatgcctctacccaactctctgcccctttatcctcccctgtcccccctcacaccagttctcgtctgtctttgttggctaacattacataattttaatgggtttaacaaacatacccttaagtggacatgtttttggcctctgtactgaaatctcttagtattctcccttgctcttgggttagaaaaccttcttgttaccactttctggtaaaattttatgctatgagaggtaggctgtttcatggctttcagtctaggttaagtgccagaacatgttctttattttactattcgaaagggacttggaatttattccactatctcctgatatccttaggatgagtggtgtgagtagaatgggtcctggtcatgctttatagaattggcccttgagcagaccttcataaacaccttgctaaatctaggacagcaggaaagacaagaaaggggcagagttaaccagctggtccactgagggataaagaaaagcatcccttccctgcctccttccaccccaggtcgctccaacctcctgacgatgcctggaagcggtgtgcagattgtttaacaggaaatgtgtgggtatttgttattttgctgatctctatggaatgtcccttactgaatttcatggtttgccaaatttggcagagttcttcacttctttgactgtatagctctgaggtgtgagattgatgttcgatgatgaagggaaacctaagtgggtcctgaggttccattaatacctctgccttcactctgcctcttcttctgtttcctgctctcccagattgagccaggtgtttacaaaaatctggtcaagggctgattctataaagctgacttcctacactgaaaataaaatctgtggtcatagaaggaattttgaaccccagacatctgttgtagacgtatagaattgatcacaatgtaggataggtagaaatatttataatgatagtgctgaaatcaatatttggagcttaatatgtgacaggcagttttcctggtgctttacatggatgtactcatttaatgcataagaatagtaaagtgtattctcatggtacttttcactgtacaaagtgttcttgtatttatttgattcttataaaaaccctgtgaatatgagaccagagtagactaaagagacatgacaactaaatgcagtgtggcaccttgggttggatcctgaaatgcagagaggacattagtggagaaaatggtgaaatccaaagtctggagcttagttaatagtaatgtactatatatagtaacataagatgttaacaatgggtgaggggtatatgggaacactcctatatttttctctgaatctaaaattactccaaaataaaaaagtttatttttttttaaaaaaaacccttatgatctagtcaatgcaagtctcattatcctcattccccagatttgtactgtttggaaaggctgagaaccttgctcaatagcacaggggggaggtggtaaaagaccaggacctaaactggagtccttgcattcttacctgagtgctgagtactgaggagt

SEQ ID NO: 97341 - DNA, 1090 bp, Homo sapiens
gttaaattctttaatgtattttctcaatgaaaatataaagtcttatttctgaaatgtatcttgattttaattatatgcttatctttccttttaaaatagaatatgcttctctgggatcactctatgattacattaacagtaacagaagtgaggagatggatatggatcacattatgacctgggccactgatgtagccaaaggtaataatatttggtatattcttatagaattagtggggtgcattttcccctcctgaaatggggacttaacatcagaaaatgttttattctgtctttagatgttctttttccagaccaaaagtagtaagaattccacagctgatggtacagataatattttaggtcattgcctttccactcctgaattccttttatcttcctcttaagactctactttatttctatccacgaaatctagttgtagcttcagggcagacatgtttgtcatgttttgtgatattataattgactagcttgcttgacacattaaatggaaaaatcatagttctgttgttctgaaagtctctacttagactcagtatccagaaaacatgatttattgtaggattagttctactcattttgtatacataatatgctaaaaatagaaaccacttgcaaaaaaaatttttatttgtcctgccatgtaaaagcaattcagattttattttacatttaatgtaaacttacttaggcatcgctgttggaattaaatatttttaatacaccaaacccctaaacaaagtgcccagtcttttttctcatacattcttgcatagatgaatgctttctaaagcaattcaaacttcatttatttttatcttttttttttccattttcctaactgaacatttctgggctttatttataactgtcagagttgctttggaaacaacttcatctaaataatgaacaccgatagttatatttgtattctagcaacccctacaaagtgtgtctgaattttcctggggcaattaactcctctacattttactactccattctctacaagcatctctttacaaagcaaatataatgtgatttagcactcagtaaggggagcaac

SEQ ID NO: 97342 - DNA, 1045 bp, Homo sapiens
cttaccagatgaccttgtccatgtctgctgccagtcttagagtagcagtgactatctgaagcgtgactctaaggcattacataagaatcacagcagagccacatagagaatagactaatgagggggtggagtgctcaaggaagagaccacaggaatgaatccgttaaggagcagaagctcctggaggaggaatttggagatgggccatttcctgaggaataggttatacctgcattatcagagagaaggaagtggagtgggagagttctttgctggaggaaggaattcatttgttgccttttgttgaggataaacttttccctaaaatgttacgtattctttaaaaagtccaaaatagttttggaattccctgtctttacatctcatactgccctgctatttatactattatactgccctgctgtttatactattacttcctaaaagggcattttcatagtaatgggtaaagaagcagcctgttttaggtccaaatcagcctgtctcttcgtcctgaacttctgtgttttcttactgcaggtggtagccaatgacacaagaggagattcacgttgtcagacctgttttgttttgttttgttttctttattcggtctctaggtatttaatgctggcttcacaggttttggacttgtttcagtgactagctttttgtaaatcataacacatcctatgtataccaaattaataaagattaattttgttagctattgaaaaaatcatttcaagaatgaaatatgtttttgaccgaaggctagaattttaaaggtcagaaggcaagagtaacatcaggcttaatacctgatatccaaaaaaagaaaaaaaatcaatacctgatatcccttgattctggtttcttaagaatgaagactataagctattacagtgatcaaatatttctcataagtttcagaggagactagcttataaaactggtctcctatgtcaaatgttactacattctaaccatcatacattcatctgtgggatattctgaaaatggggtatttgtagcaatttaagac

SEQ ID NO: 97343 - DNA, 1357 bp, Homo sapiens
ggcaactatgtttctagcttctcatagcctcccccaaatccagccaagttcagttttaagttttttatttgcaaaacttctttggcaaacagaactgtggaataagtcttaatacttattacagcagttctcaactccatcacacccaatgctcattttataacaactatgttaacaaccccttacactcccttgaggtgaaattcaaaggtaacacaactacctacacacattatattgtaagttaacataatgctctaactgtaatataaaagagaaataaatgaaagatgttttccagtgtacaaatgctcaagcatgaccacaccagaggagattttggaacagttttaggggataaatagaactcagcagctacaaatgcacccggatggagttgggttgtattaacgactccagtactgggagtagcactgttgttgttatgtcagaaatcatgataaagttatgaatcatgcaagaatcaataagcctttgatttattttatttggtagatgcattctgcagagttcagtgtatcttaaaactgttcaaaagaatactttgtgtttatttgtaagttagagttagattctaggcccagaaaattataaacttcattgtttgcttgttttacttacatgaatgtaaatggggcatttgaaattttgtgggatacaggggagttcctggttatgcaggatagtatggtatattgaattgtctagcattcctgacctgttatacttaaaagtcggttgcaacccaccagtctctaaaacaaacacaaaatgcttctgtggaatagaggcaccacaagttctatgagaagcaccactgtaggatgttagaacaggaccatcctcacattataatttttgttgtatcgggtccttaaagtatatgggtttgaccaaaacaaagccgtaatcagtcatacgttcagaatgtcttatttaccactgagaaatgtagagtttttaaaattatctctgtgatctgtgctcagatgttttcagagttgtatacctactgccaaagctaaactggtttctagttacctggcctatttacatatatcgcaagttgcctataaacatacagtgacatatggttttatatttaatatttaagttccgacttgccccctcctactgtagttctgtttagatattttatgttttgttgcattagttgtactgaacctgacttctccgttcactacagttccctttcaagaaaaagtatgagtctttagagattacagatctaaacataaattgtcacttgtcacatattaatcaatggaagctttaaatttcatgccttatgttcttaaaataactctattatgac

SEQ ID NO: 97344 - DNA, 3149 bp, Homo sapiens
ccacatttccctagaactgtatagactgctgaactgttttttgtgcttcctctaagcttttcttttgggtacaaagtttcttaatttttcatttgagatttaatctctgcttaatttatttttttaaaaatataatggtcaactaaatgtttccttatgaaagtgaaattgggaaaagtcaagataaatcctagaaactattttgttttaagcaaaatgagggcttaaaacttgcaacttcttttccatttgaaatttggcttgctgtggtgctttgcaaacttttggttgtgatttatcctgtcattcataaattatggcaaatatgctggagccaaatctgccattaaataaattctcacataattccctacattcatttatttcactaatcatttacctcctgtgtagtgccaactaattttgtggtatctattttcctgatttaaattggtcctaatttctctttttacttctgtcctttcttcccttttgatagcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaaagaaagaattgatagtacaaaatccaacaacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtatgtgtggtggtttgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctca

SEQ ID NO: 97345 - DNA, 1121 bp, Homo sapiens
tggggctaacttcgggatccctgcactttatgtaagaatgtaaacctggagtctcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctccctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgat

SEQ ID NO: 97346 - DNA, 1053 bp, Homo sapiens
tgtaagttagaaaggttaactcacctaccctatgatttttatactaacagtaaaagcaaccaaactcaacttttttttgaaactcactcacaagaaaatatttgtaacagaagatgagtgacaatttgccatattatctcataagcaattcatttttggggggcaagttaggctagttaaagctaatagctgtaccaaactctaatttgacttataggacacacagacttctaaaaattatgtaagcatttattatttagatggccatggggcatatattgaagacagtaagtagttctttggctctgaaaatggtgcaggctgaagtcctctggaggcatcttcatttgtacttgtgaacctcacagggaggtattttaatctgttttagttagagcaactctgcagcctgggtttcttaggaccgtaccaatttcccatgtccttcttcatccgtgagtgctaacatttggtttttaaaatattgtgcaaatgagatctttcaacacttagaaattcccccttgagaacaggcataatacatgatctggttactaagtggttgctttggaattttcattaataatccaacagtcctcatgttggctgagactctgaggaagactctaggtctctgagaaaatgtcagaaattgcttgactgctgaggcttgattgtgggatgtaaaaaccaggtaccaacaaaggaatatgatacagctcccaaagtacatgaattgttactgagagattggtgaacattactggagcactgagaactgcctcttaaggtcaggaaaactgttttccattcaacccaacctgcaggaggaaccaagccagagcagcagctgagagctgaaagagtgagacaagaggatgaaccaaaaagacaatgataatattacttttttttttcatttcatgcatatttcccatgcagctgctgccttcctttgagattggtgcatggacggaagacgatgtggtaagctctttgtattcatgccttatttgacttgagcaggtatttcataaatttttccctaagttt

SEQ ID NO: 97347 - DNA, 1053 bp, Homo sapiens
acgcgtccgcttctaaccgctgagggccagcgcgtctgaggtttaaggtcttgcgaaccggtctcctagaacttgggctgcgcacgcagtgtgaagcgaccgtagtcccgggcggtggttaagtgcatttaaagggcttggtgggtcaaagcgttcgccgaccatttgctcgtttcctacttcctccaccccaacccccaaccccccaccccccaccccccagccttactcttagctgcaggacgttgctctgagtggaacgttactttttgctctaacggaagccagaacgtagggtcgggctcctggagagggtagaagagtgggggttgggtgaaacggaagacaatgacatgtttaaaataaatatcaggggttagggaccctcgcgggggtgggtgcgatggggcgtggtttcagagctgagtcgccgccccggtggagctgggcattggctttccggatgaagaaaaccatgtgtagctggtcttggaacctgacatgcctgagttcaaatctgagccaccatgggacttgagtaatccatttcgctttcctgagcctcagtttcctcattggctaagtgagaataacgatagcacctttgttgcaaagaattaaacctgacgtgaaagtgtacttaacatagtgcctggcacgaaaaacgcctactataaatggtattagttattacttacctgccaaagaagttcatctccgtcttgactatttgccttgctgcttttttgtggcttttcctccaaagatacgtttgcctggtaaataactcttggcttgtgctgacttgttaaagctcagcctgtatttctcggacagcttccaatagaatgccgcctttgaggctgtctggggcctctgactgcttgcaggtagattgatgagtaaagggtggtaattcctgcagtaatgcgatgaacactgctgcttaagaagatggcagacttgagttctccttcctgcccctgtgatcttgcagtctattacaccttcctggggccttgaatatcctcatctggaaaatgggatctgaga

SEQ ID NO: 97348 - DNA, 1029 bp, Homo sapiens
ctgtaatcccagctactctggaggctgaggcaggagaatggcgtgaatccatgaggcggagcttgcagtgagccgagatcgcgccactgcactccagcctgggcgacacagcgagactccgtctcaaaaaaaaaaaaaaaaagaatttgacctggttttaaagatttttgggtccagatacagtagctaatgcctgtaatccaagccctttgggaggctccggtgggaggatcacttgagcccaggagtttgagaccaacctgggcaacatagcaagaccccatctctaaaaagaaataaaataagttagctgggcatggtggcacatgcatgtagtcctgtctactcaggaggctgaggcaggaggcttgcttgagctcaggagttccaggttgtagtaagctatgatctcagcactgcactttagcctggaagacagagcgagatcctgcttcttacaaaaaaaagaaagaaaaaattttttgtagcagttaacaaacttccttttctatgtagggtatgataaatggacatatctactctgtgctgtttgaacctactaaactaaaaaaaaatgatgtctttagttaaataaagtaagcatcacgcttaataggattgctatttccatttgcagcagaaagatctcagagtaaagaagaacttaaagaaattcagatatgtgaagttgatttccatggaaacctcgtcatcctctgatgacagttgtgacagctttgcttctgataattttgcaaacacggtaagtgctgcctgagaataaacagaattgagtctgcagtgctcaaaatgccccagatgctttgtgcgtgattaaaactgcttgctttttgcctacatttctatacagccgttatgaaaatacagtatgcactataatttcatttcactttttgctgtggttctaggtagtaattgttggaggtagattagctacttattctatccttttgaaatgtcgcctaacctaacatgcatgatgatttgccataacaactcagaaatcat

SEQ ID NO: 97349 - DNA, 1049 bp, Homo sapiens
taaatgttggtctcatagtagatctgtggctgcatcttgaaaacctgtgataacttacgtgcaggagctccattgcagataatgacattgagggcccttcctgctgctacttttgctccttggttggcttttcctatgcacgctaccttcctttaactgccgctgccactgttgtgctgtgcctcggtcccactcttctgagcatactgcttaattctgcacacattttcctgttccaaagactttcttgacaaaggaagcagtgcattcactgataatcaagtgcatgctcttcaactcactggtctgacatggatccactgcctgaggttcatggtttgagtaacattgatagaagtggcagtgcctggccaaggagtgttttggtccaaatcagtgcatactggagtttgttgcagggggtccagtctgcagatctggatgcgacacaaacattgtcaatagcctgaataatttctgggcagtgtttcagttctttgaagatactgtcatgattaataaaatgccaattcattataattgttaggaactcatgaaaggtttttgttgttttgtactctctcaatccatggacactaaaagtacaaaaagctgtttgtgggcatgtaagacttttgagacagggtcttgcactgtcaaccaggctggagtgcactggtgtgatcatggctcactgcagcctccacctcctgggcttaagcgattctccctcagcctacccagtagctgagactacaggcgtgtaccaccatgcctgggaacttttaaaaattttttatagagatgtgggctcactttgttgctcaggctggtctcgaactcctaggcccaagcaatcctcccgtctcggcctccaaaagtgctgggattacagccaagagccaccttgctggccttgataaatattttaatgttaaaactgagtctttatgggtgaaattctgggatttatgggtgatttttttcttctctctctctttttttttaacctgcaaccattaccatagtcaattttggaataactttat

SEQ ID NO: 97350 - DNA, 3592 bp, Homo sapiens
attttttaaagtagagaattgagatctgttaatataatttaatattgccataaacattgaagccatatttataggggaacacatttttttccctttttttttttttcaagacagggtctggctctgtaacccagccctggcatacagtggcacgaacacggctcactgagcctctgccccctgggctcaagccatccacccacctcagccttccaagtagctgggaccacaggcatgcgccaccatgcccagctaatttttgtatttttttttgcagagacggggtttcaccatgttgcccaggctggtctcgaactcctaggctcaagtgattcacccgcctcagcctcccaaagtgctgggattacagatgtgagccactgcacccagccaggagaacacatttgttcttgtcagaattcttttaaaatacataaagatctgtttctaaagaaatgaaaagcaggtggtaggaattttaacattttaaaaaaaggctcagaaccacaggcctagggactatgaaaatagcttataacagtgtggtccagatgggctacatggaattaaactgcactctgttgatgtactctttgtggttcctgattttgttacccagaggtatcaatgttcagttaaaattcatttcatacaagtgtctcattgaaaagggactttgtagttatactgatgcagcttgtctgctgatcaagtcctaatgactcaattgttgtgattagaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaagtcttcaatgtgtgcctcaaaatgtgtttctttccctgaactactttttttaaatctgttaaaggcctggttaagtgtataggggaaatcagaaactctgaatgtgtcagcttactatcaaatataaaaccatgagatgtacttgagtattttccagaagttagttgctcattttcgacagttattctaagccaatgatatcagtttaatttcctccctttttagcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctattttgcagtgtagaaactgaatgtgtttctacagggtcaagagacatcagagaaaatttttttttttagaacagaagatcatttcttacatcttcattaagtaaaagaataaatagctcatctctcaagttgaaagaaactgggcttggtattacaaaagcaaaattaagatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgtgagttctccgcattggtacttgctcttctgattctcatcttcggtaggcctggcatcatacacagcacaggtacacgcacatccttaacaccaggcgatccatagtaaatgttttcctctaaccattcagaactgtaaacgtcacataagcttacttggtaattttattagcaggcgagaattgggttttcttcatctcttcttaattgtaggcatcgtttccaaaatgtccagttaggctacagtaagcgtatggcctgttcccctaccataagctctaggagagatttccaggttgaagtttgtgtgaagaaattacaagtcaagtatctgagattcaaagctggggagagccagttttgaatctctgtgtttcatatttgaatctgttttttcagttttgaatctctttcagtttttcagttttgaagttctgtgttttgtattccttgtaatgcaggaagatgacctgcccagaagccgtcgctccagatcatccgtgacccttccgcatataattcgcccagtggaagaaattacagaggaggagttggagaacgtctgcagcaattctcgagagaagatatataaccgttcactggtgagagcctctaaattacacctgagaatgtaaacatctgtgagaggaagagagcttctgtccctaagcgttgcccaggttctaaagggcctagcatgtgaaatctgtacctatatgtttttttcacacaaggaaggaaaagttttacagtatccctgggatttagccctctttcacagtggaattatctgcttagtaagtctgtagtcatggtaaatcttttctcctaatttagaaatcaattcattcaacatatatttactgcatatctattatgtgtgtatacatagctaggtgctggagtgtggtggtacaccaaagataaaagtggatttgggtaggttattttttaataagaccttttcttaaagggaaagcggttttaccacaccaggctaatttttatatttttagtggagatggggttttgccatattgcccaggctggtcttgaactccttggctcaagcgatccactctcctca

SEQ ID NO: 97351 - DNA, 1048 bp, Homo sapiens
cacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaagtctcccttttgactgaagtttctgaagttctaaggtcagcttgtttgaaaggacctcactaggtgacaggactaatacctgtgatcagaaaacgggcggagacaaccacagtgcctgatagaaaacaatatgtgcccatgaagttttgtagtgttttcttttcctttatgatgtgctttgcaatacctggcttacttttatcaaccattcaaacatatattaaatgcatgctgtgccttgaggcttgttccaggactgtgagaatcaacaaaaaaggcatggtctaaaagctctcatagcccaattctttttttattttttgtagagacaggtcttgctatgttgctcaggctggtttcaaactcctgggctcaagggatcctcctgccttggcctcccaaagtcacaggcaagagccaccaccacaccggctgtccaattctttagaccagggattggcaaactacagcctgtgggctacatgctgctgcagagtttattcgtatggcatatgaactaagtatttttttttccatttggaaagggttgttaaataagcagagacaatatggttcacaaaacctaagatatttacaacctggcactttacag

SEQ ID NO: 97352 - DNA, 1039 bp, Homo sapiens
tttctcaacaacttgtgtataaggaagtatttttatacttatttaacagacagaagatgtgaagcagaggacttgtgacttaccgaagttaaaatcacattgatcctttggaacaaactttatgacgatacacccatttttatagaaatcaaaccaaagcacaaccaattatctgacatacctgggcaacttttgaccaatgccttttccagatcattatctaaagaattaacccaatattcttattactttgtaccagaattttatatataaaaattgttcattatatacatctatgtattggtatataataccatctctatgagaaaatgtcttatagatattacactctatatatctctatatatccatgtagaaaacctatatctatatttatctatgtatctatattataaaacagtcttgcggtcctaagaacaatactggcacctgaaattgcttctttgattggataataaatcctgggtggcttgatttaagttgccagtttcaatcagagttttcctttgtgagacaggcagtcatgtaaactgatctagttcagctgatagtaacagttccagaaatccaacagagtgttttttaataaaaatgtatacaggattggaatgttgataagacatttgcaaatgtatatagaaatatgataatttatactattttgtgataagattcctggttggcattagtgatgcatcatatgattgcattaattgcaaagaagaaactcaaaatggcataattgtgcctgatgttcaagtaatagaaatagaatttaaagtgttcttagaaaatggaaaaatgttactgaggtgaaaagactttaaaaacatgaattcaaaaccaaaccattagcacatgtaaccctttcaaggtaatataaatcctgtagtagaccttctaccaccacccatcaacctggacaaggataaaagaaagtggggagatgagcatcagccgctggtaggttatctctgaaagcactgaagagagccgttgcatgttgtaacatcctcag

SEQ ID NO: 97353 - DNA, 1011 bp, Homo sapiens
tcataacaacccacaactaactactggaattcgtattaggctaatgagaaaaatgaagtagccaaggacatctagtaagtggtggagctgggatctcaacttgtttgatcagtctcctgagactggggacatgaccactgagctatgctgactcctcacttctccaacccgtcataagtgtcttcgattgtgtactggatgaaacagcagacagttgaagtaccctgccttggagtgctacagtatctttgggacatagtttaacgtttgatcttctagaacctccgcgtcatggtttcaccagccatcagctctaatacacaactatcatttgcacaactcttgattcctgaaaattagctaggtcactaagtatgtcagctgtaataatgtagcagctaattcttttaaaaacagaaaactgtatattagaactgccactggcaataaatctgacctagaccatctatcctctcttagctggaaatttatcattatgtagaaagtgattttgttctttccaaaccctcagccaccaactgggccagttttttgcttctgcatatttcattgaagttgctgcttggaaaacaaccaaccataattacttatttatgtgcatatttctgaaactgtaataatcggtgaacctgccttggatatttctgacaacttggtttgcatgaaagtccatcaattttgtccttaaattctttgttcctgatgaacttctgtaaaaatctttgttctggaataagagatgttctttctaattcctccaaactgtgtctcctgctcccattgttaacaaaatcactagctttcctctttatctctctggttcctttgtttcacgttgttctcctctttttcatttgttacccatgtaatacatgtcatttttggaaaatcagaaattgtaaataagcaaaagaagagaaggatgaggaggaagaaaggaggaaaaaaggggaggagaaaaacaagctgtttcaatcttttggtgcttat

SEQ ID NO: 97354 - DNA, 1026 bp, Homo sapiens
gcggggttttgcagggagccctgttggtaaacaatgcctgtttgcaggctactcaggaacgacctgggaagtggaaggatctgaaaatgttgtgcatgaagtggcccgttggctgtccaatgaagtgtctgttatcagaaggaaatgtgtactttttgaggtgagatcggttctgtgctctgaaccgaatgatttttcattttttgttctgataacaagctggttgtaagcttcactgaactgataaattgtaaactcttagaaaaggctgtctaaagataacaattcaatgtttcttggtaatgtatcctggatgaatctgataatttaaagcccacttcaccaaaatgggagtggtgcttgcgtcctctttatcttcaattatgtctaatctgtttctaattcaaacactgtgctgctgttgtcagatcaaatatagattttaaatgttttatgcttctccgctgggaaggtttaaaatgtatgcaggctgtctgtcaggactgtgccagttgaatctaataaagttttagataaattcaaaggaaataaaagagtacttaaaaatgaaatgattcacggttcatgagatggaacatgcttaatgaacggcaggcagttcgggaaaagttatggtagagtctctatggatcacctgcctaacctttacagagctctccttgaataaatatattgtgtcttccagctttacaggcaggagttcagaaaccaatttaaaaatcaagtcatctttgggcttgtttcaaacagggcctcataagcctatgggcgcagggactataatccatggtttttcattccacatgatgacacttccatcactgagagcagattggaaaacatagttgcagttttcagtcactgaataggatgcagttgttatcgttattagaattctttttttctgctcatctatgtagatgtgctccaggtatgtgtgtgctctggaatatcaaagcaaaaacatattcggagataatatcgggcattgttagacctgggacc

SEQ ID NO: 97355 - DNA, 1026 bp, Homo sapiens
ttatcatttcataatttctaccctgaaggttatagtaagagaagctgataacattctgactataatcaccttcctgacttaaaaaaaaatccatttggtttcactagtttcctgtacttttttcattataagaacatattccctttatttcaatgttagggaagggctacttttttgttttttgtttttccttaaacatgatcctctaagagctacagtataactctgctaaatatccacagatgtgacatctggagcactgtgccccaagcctgggagagcctgcgtataggccttgtctacttggcacgtttagattcatgaggggacctaataaaccttttatgactttcaaagaaagaacatagggccttacttgctcaggctctagtgttaaacttgaggctcacttgataagccaaattcagggcagcaaaaaactaagaaaagttgatgatgggaatgtatctttctaaccaaagtgttcctcaaatctactccaatattggagacagtgagtcaaccctgaaatggagactagaaactataaggcagcaacatatgcacaaaaccaacttttttttttttttttttgagatggagtctcattctgtcacccaggctggagtgcagtggtgcaatctcggctcactgcaacctccacctcccggattcaagcaattcttttgcctcagcctccccagtagctgggactgcaggcacatgccaccacgctcaggtaattttttgtagttttagtagagacgggatatcaccgtgtttcgatctcctgacctcgtgatccacccacctcagcctcccaaagtgctgggataacaggcgagaaccaacgcgcctggccaaaaccaactttttaaagcaatattctgccctataagtcattatgtgactgatgacgcacagcaaaagcgacagtaggtgtgaacaccatccggaaccaaggtcttgtgttacctagtctcctctctgctgggctggtttctttttcaattggcaaaggataaa

SEQ ID NO: 97356 - DNA, 2588 bp, Homo sapiens
tatttagactttaaagtgtgttatagatgcttattttttagctggcatcttaacacaggtatttcaaacaaactcttagcgtagttgagatattaaagtcttatttgaatatccatctattatataatacatgtttgaagactgctagtcatcaaaaagtaaagatgaaagatttaaggagaaatattctgtaagagaaatctggcaggggtagctcgtaaaatgaatacaattttaatagacccctgctcccatcctcacctgtcagcgttgacttactttctgttttgggggagatgattgagctattaaagttgaatttttaaaaccaagtaacttaatttttttcttaacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaa

SEQ ID NO: 97357 - DNA, 1039 bp, Homo sapiens
ttttggtttctgattgactttgtaatgataatgtcttctatttaaaattcaacatggggatatatgatgtaaatggtaatgtccatttgaatattttcatataagtatatattattctatgtgtgttttttagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggttactaatacttacttttaacagacaaaaatgaattatagggctacataactgccttgacttcttttttattagcattccttactgaactgaatcgatttaaaatacaatgaattacatccaatttttacctttagtaacaccatcttaataacacaaattccaaagaacaagtcagtctggcttatcttctaaaataaagttatatttaagtagactttgggtggcttttgttgacattattgaatgctttaaaccacatttatactatttttattctgttaacatttttaattagttgtcagcttttactcttgatctatcctattttttttctttcctcttaacactgtaacaaaaaatactcctgtttcttctgacatatttgggcatttcaccttttcttttgtttttagtatctctgaggtaagggaaaggtatttcactgaggaataaccaaggcaatgttgatgtgaagactttctctgattatattatttttacatagtgttgtgtggttgttaaatgaaatggacctgtgactgatctacactgaaacctaacagtgttaacttagagatagttttttcctactaccatgtaaatgattaaagtgttcatcagtctatgctcaacactggagaattgaaaactatgtatttacaatccctagagagcttggaagaagcatggtaaaatggagaacaac

SEQ ID NO: 97358 - DNA, 1406 bp, Homo sapiens
tcttagggatttttaaataataaaataaatttaaaaatctaaattaaatggaatcaatattggctttggttagtaagactttggcattgcaagggagccagaaaaacctgtttcacttaactcagctctttgaagagttgtagaaattgggggtggactggagcagaaactagaattgtgttagattatgacatccttgcccttgagacaacagcatgactcctccttgtctttacttatgctattcctctgcctggaatgccttccctcctttctatctaaatcctacccacctcctccacgaagccttctctaactactggagcccacattgatgtctccctgttcagaacacctatggcatctaacagccagcactgcaccgtttagcactgtttgtcctatggcaatttcacatgctactgagtgtgagtacattaaaatataaatgtggggaaatatgcatttttccagtaaatttgaaaaacgataggtgtattgtatacaggaggatttacaggctatagaaagttttacaggatatgcctaaactgtgagattgggggaggaggggagttggggagggggctaaatgtacttttttaaaaaaactcagaaacattgtaaagtttatacaaattgttttgtccaaagtgtcatgttttttaaaaactaatttatttttattcagtaacaagcctaatttttttttttattttaaaaggttgagaaataacattttctgtagtgtttaatactattcaaatgatcaattctgggatcaaaaaagttttcttcttgcttaggctaagatacctctgttcacccatctaatctcatatcttctaaaccctgctcttggtatcaaatactgaaatgtaataaatgtccaattttgtgatgtggagaaaactgtattttattatatctcttgtgtctaattttgggtatcttttacatggttaatatgaagggaattttaaatgtaaagataattttgatttgtatttatctcatctaatgctaagggagttcagaccattgctttaactagatttaaaaaaaagctttctccaagtcagtgtatattcagagtgtggccacacaaatatgaacaaatattcttaaatcatattaaagtctgctaaagctgcctatatcttttaattgtacctgtgatcagttacgtattcattctttggtttaaatatatttttgattatctgacgacttttgaatacagaccacatttagtttcctatataattaagtggatcaggcttatgcgtagaatttgtgaatggttctgatagaagaataaatagctttattgtacattctttacatatgaaatgtccttttaattacataattcttgagcatatttacatttggacaacaatcac

SEQ ID NO: 97359 - DNA, 2704 bp, Homo sapiens
tcacggtcccttttttgtgcagctttgaaatatatagagcaaaaacggatagaactctaaagccatacttaaccaaatcccttgtcatggtgaaaattaacatacctttcttagaaatgcactgtttaagtagataaaatgtacttttaatagagttaacaaacttgatctaatagagcttttctatctgcctttgagttgcacattggccagccctttccagtaataataattgctaacaactggtaacattgagagtttaccgtattcccagtggtgttagaagtgagacatagagaggttgagtgactcctaagagcacacacaacagggatttggacctagttttactccagagccttaaccattaaactatactgcctcccaagtgactctccttctacatctgatccttaggtattcatgtttattgtaattagtttaaagttttgttttttgacatattttggtcaattaaaattgtgaattctaactaggcagtaacttttctgaaactcattttagaggggcttttaagataaattattcacaaaagtcaaatctaacggaggcctggcctttgtttcacttattctttattttaaaatgaaaatgttttaattagtttatgtttattaaactaaaacatgctcataaaaatgtagacacataggacatttaaaaacaccaaaatctcacccctcttcaagttaagctagtaatgtgtttgtgtttgtcctttaagatgttacatgtattttaaagtagaatcatcttattctcactgttttatatgtctgttcttgttttgagaatttttgtgaccatattttcaagtctatatagtctgaatcatttttatggctgtatagtattctgttgtattctattgtatggatgtagggtgatttaacatcttttgttgggaatttattgtcataatcttacacgtatgtctttgcacatttgtctgattattttatttgtataagttggcagaagtgaaattgctgggttaaagggaattgtctgctagaaaggctagtttatactctaaccagcagtgtgtgagagtatctagtttcccacacctttgccaacaatgaattttacaattatttttaacctttgaaagtctgacagatgaaaaataccttaatattgtcttagtatatttttaaattacttggtgaggttgaacatttttggggatgttattttgccattttaaaatttattttttgaattgtttctttttttttgtaaatctgttaatttatgtaactctgtcacgtgcaaatgttttttcccagttttacattgcctttgtcagtggtttgtagaatgcattgttattacacaagtaaagaaacagttccatcacttacaccttgcaaacattttaagcacaaaaaattaaagttggtcagcctttcctttattagatgccttgttaccatgctattacaagttttccgtattctgagaattataaaaatgttcatttatattttttctagaacttttgtgacttcattctttaatagctcacttattctaagcaataaaaattgagattcctaagaaaagaaactatattgtttcttagagcttgtttgaacaaaattcaagcagtatatgtgtgatagacacacttgtataaatgacaattgtacctaattgatagaagcataacataggtagtaaatccaaactattctaaagtattctgcaagttgatacagatagtaattaaaaaagttttttagaatatttgtctttttttgcaaccattatttttttaaagaatatgggcaagatggcatttttagagaactgattttattcatctttagagaagtaaattttatttgtttaccttttaaagtaaggtgtaaaatataaaatatttaaaagttgtaattatttagcaaatatttattgagcagaaccagctttcagagactgtttaaactagtgagagataacctagtgagagacaaataattgtaagtaaaatacattctagaggcatgattgttatataggttttgtatggattaaacatcagtccatatttttaaaattgtgcacaatctgttttctttgtcagcatttcagtttatgtcctgtttttcccaccctgagcagaagagagtgtatttacttaacttttcttaactcctctacccacagtttagcttccactctatcttagcattattaaattattgggaacaagtttagacactcaagaataaaaacgtaaaattattagtttttcctatattataggcattagtggtgtggatattaatcaagaagaaaactttaaatcttttattcctgaactttgttgagaaattcacttcagttctctcccttcaagccttggtatgacatgccgtaaatccacatctaccatatctatatcttactttgaatgaaattttctttttaaatagaattttgggcctggatgttgagctttttccttaaatatgtgtgcaaccccgcccctatgttttttctttcctagatgcctgtcccattttcaaataatatttcttatttcctaataattcagttaaaaataccttccctagcttcttgcttctttgagaacccagatctgttgctgttaatttgttagtcttgtgctttgttagtgttcccatgctaaattttgctaagtttgtgaaat

SEQ ID NO: 97360 - DNA, 1050 bp, Homo sapiens
gagaaagtttttccaggtagattattacctatattggaagttccttcttacagaagacttgttcatttagggagattgtattttccgagaactttgagtgaagcatttattatctaaagggacatatgaactaattaatgttattaattctactataagcatttatacaggagattactctccaactagtcttgaagaatagaggttagttagatgaggaacaaaataactggaaaacagtctaggcaagagaagtagtgcatgcaaagttgtaacattgggagaagacatgtaatttcatgctgtctttttgggccatttggttgcttctcatctgtatttggtttttttttccctttagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaaggtatgcatacatgaaacacatatatatttttaagagtgctaatatcattctgatttttgaaatactgcatgctatgtcatttaattatgagaaattattacatgatcatttttggtgtgtgtgtatgcgtgtggcagaagttagagaacaaaatatatggaattggattttcagttctcaatgttttttaaactaaaattattagtttgctgtttcaaaaatagtacagcagatgccatttaacaggcccacactgatcagaaattagcctgtttgcaaaccagcaatggaatttgcctaaatatagataaaaagttgattttttaggttgagaatagtagttacgtaaaaattaagttcaggaatggctgataagcataagtatttccattttcttagaagtgaaaaataagccttaatagattgaattttttaaaaaatgggattgtatttcagttcagtctttttaaaggtaaacattaagacagaataacat

SEQ ID NO: 97361 - DNA, 2472 bp, Homo sapiens
aacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcaggtgagtcttaagttatgtcatgccataaataagttcagtgataatacatagagggaaattttttgctttaggtatttatcagcatcagactcacattagaattaatgatcaatgtttgtatgaaaatatgtttgtatgaaagtagacatcaaagtatcttccaaattattctttgaaagtttgtagtttttgaagttagggattcatgtttctattatgccaattaacatttatagttttttcttaattttatatttgttttgacatctgattgatattgtcaggcattataaaatttttatttggcaggtagggtgtcttggttggccttagtgtgatgtgaattaaaatttttatgcattatatttggttgaggagtcaggttggtatagtgaaaacatggtacagggagtaaatatgcctcagccacttgctaggtgtgtgattttgaccaagttatttttctttcgcaaactcagtttccttgttgtgtaaaatggaggtgttggactaggtaactgtctaggtgaccttccagaccaaaaattctttgattctgtgatagtgggcattaaacttagctgtgctagaaatagttgtcaatagtatgggtagacatttctgaagtctgctctttgaatgttgtgtaagaattaaataataaagtttaaaaagagatagtgtcatttttaccctattaatgttgtctgtctagataacatttgattgaatgttttgttgtgcagtaaatcctgaactttattactttaattctgttttgtatttggatttctgtggagattgtactactaacattctttcaccaggtcagtgattctaaactcttaaattgggacactttaactgaactgattgacataactcccatcaccatttaaagattaccttttttcttttgataaatttgtgatacatgcttagaaaattgaaatggtcttagaacctcagatccgtatttggaaatcctttaattgcatttaagccttctgaagctgtgattatttttttttaggggttgggattaggatttctgaaactggtttagagcagtagttgtttttttttttgttttgttttgttttttgagatggagtctcgctctgtcacacaggctggagtgcagtggtgtgatcttggttcactgcaacctctgccttctgggttcaagcaattctcgtgcctcagcctctcgagtaactgggattagctcctgaataactgggattacaggtgcacaccaccacatccggctaatttttgtatttttagtaaagatgaggtttagtaaagatgttggccaggctggtcacaaactcctgacctcaagtgatctgcctgtcttggcctcccaaagtgctgggattacaggtgtgggcctcccaaagttctgggattacaggtgtgggtctcccaaagtgctgggattacaggcgtgagccaccgctctgctcctggcctagaacagtagttcttaaaatgtgatctgtggaccattggatatccctgagaccctctcagaggtccttcacatcaagctgcactaagaaattgtttgccttgttctctgtgttgacactttcagtggtggtggataaaactgcttgtgtcttagcataaatcaaggcagtgacagcaaactgtaatagttgttgctgtattcttcatgaccatgcacttgcagttaaagaaaaatcccagtttcactcaagaatgacctcgatgaaccagtaagaaaagatatttactaaatcttgacccttgagggctgcatgtcttttaaaaaataatagctttattgggatataactcacataccgtaaaactcactctttatacaattcactggttgtaactatggtcatagagttgtacaaccatcatcactatctaatttcagagcatttttattacctcaaaaggaaacccataccctttagcagtcactcatcattcacttcccctcagaccctgacaaccactatgctactttctgtcccttcagatttgccagttatttcgtatcagtgtaattgtacaatatgtggcctttggtgtttggtttctttcatttagcatgatgttttcaaggttcatctgtgtcatggtatgtgtcattacctcatttctttatatatggctgaatactgttccactgtatggatataccacattttatttatctactggtggacat

SEQ ID NO: 97362 - DNA, 2190 bp, Homo sapiens
atgactagtctgtgctacttttcacattgtattagcatggatgtgtgtatgtctgcttggattgacagtgaaccgtttgaagattgggattgtatgtcatgggtttactcacgtgtgtatttcatcttggtaaattacgttcaaatgtttgaattcagtcatttaactgtggttcatccactgaaataactgtatatatttctcaactatgtcttcatgaaaattaggtagtgagtttctttaagaaacttaagatttttttgtttatcatatttgcattaagttttatagaatggtttatgttgagagaactgtgtatgtctcaactgatttttatggtcccattgagattcccattgagaatataatgaaaccctagattatctttctctccctcaaattgtattaatacaccagaatacaaaaggtatatgccagacattctactgaaaacttagactagtaagtaaagtcacagtgtgtatcctccagcttctgatcctagagaaacctttcaaatggggctacgttgtcatgtggtcacagggcaatgactttttctcattaagtttttttaaggtctttgtttttcattagttcatggaaaaagtagagtttgatagcttaatggaatagccctagccatgagtttactttagagtatgttaatagatgccacaaaagagtagatttcattgtttgattttaggcttatagcaataaatcttttctaagtcggatgacttaatacactatgcttatgtttcctttttatacacaaatataatgcacctgatttggtcatagccatctccactgttttgttttgtgttttaactgtgtagtgttagagatcatagatgcaggattagaaaattggtctgtggttgtgatgaacattccgagaattttttttatcccactcaaataggatgaattgtctttgcagtaacaaaactggaagtgataattattgtagttcatatagtactgctcctgtatttgaactccattgtgttttaagataagttgaattttcaggtagtaggatttataccagtttttagaattttttgagggttgatttaaatataccacaaatatatcacctttttgttttcttcatccagacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaa

SEQ ID NO: 97363 - DNA, 1270 bp, Homo sapiens
aaattgagttgctgtaactcacacaattccacagtgtagccagaactagaactcagttctgagcttttttttttttcttgtgtaatatattgtcgagtgtagttttggcataaatcatctagtagttttctgattcaatgtgttttttccattccatttagaaaatagggtattcagcaaatttttttaaaactgcaaatttattaaattaaaaaagttccttttcttgcttgattcttttccttaaattacctgttgctttttttttttttcccccatcgttgtgcttcacaggtattttaataatgcttttcatttcaggcttattcagaaaagttcggaatacatcactttgctctaggtttagagattttccttcaattaatggcctgaattgctgagaaaaatggcactacagtttatttttatctagcttctggagaggggatgacttgggcaatatttactcagatttgtcatttgcgttagctgtatttattttcaaggaatttcttgactagaaagctgttcagtgatggttgaatatctgcctttattactattttgtaaaaaaaaaaaaaaaacactttaggtgctgtaaatttgactttgttttttttaaagaaaggaaaagggacaaaatgccagtatcataaaattaatttgtgtctgagttactatattctttgataaaagttcaatacctgtaaattttatgctggtcagaaaaaatttcagtggatcctccaggtgagcaataaccttaagaagataaaggttagattttagacacactttagtgtagattttagtatatagatttaaatatttgtagtttacttaaaatgccaagagaccgaaatgaaacatttgtcactgtaatgttaggaaaggtgacttaacattgtaatttctataccagattgaagttgcagagtgacatgtgactttaatgtctgatgcttcattttaaaattgtttagtaaatataatttaagtgtatttaagacagatcgctattttatagttcaggcctagagatttgtattgggttccacaatttctcagcctttagtctcctccctttctttcagtctccttcattgagccttagtttatctttataagacacagatgtgattgcaccactcacttgcttataaaccttttatagctttcactcactatctacaggataaagtctaaacaatttagtgggatctgtgaagccatttacaagcgttgataaaaatatctagtcctgttcccc

SEQ ID NO: 97364 - DNA, 1095 bp, Homo sapiens
atttgtttccacctcagcttcacacctgttcttgtttccagttatactccttcctttcctatttctggctttcgtaaaggcattcgtgggaactaagttaataatcatttccaaatgctatgcaataggtggtgtgaattttttctttttccgtttccaccggtatatttgtatgtagagagacttagagtgccttagttacaactttttactgtactaatgccaacattcatgttagatggtgttttgtttgttttttgagaaaggctcgctttgtctcccaggctggaatggaggtgtgtgattacaactcactgcagcctcaaccactggggctcagttgatcctcccacctcagcctccctagtagctgagactacaggcacgtgccaccacgcctggctaatttttgtattttttgtagagatggggcttcgccatgttgcctaggctggtcttgaactcctagactcaaaggatccacctgcctaggttttgtttgttaattgtccggtaagaaaggtactgagagaaacactggtggatttttaatttggtttgtaaacttacgtagacataggttatgtagaggattatcttgcttctaaaccaaatactagttctcgtcttggttgcctgttttaattttttttatttttatttttatttttttgagactgagtctcgccctgtcactcaggctggagtgcggtggcggaatctcggctcactgcaatctccgccttccaggcccaagccattcttccgcctcagcccccagagtagctgggactacagccccagagtcccagagtagctgggactacagatgtacaccatgcccggctaatttttgtctttttagtagaggcggggtttcatcatgttggtcagacgggtctcaaactcctgacctcaagtgatctgcccgcctcagcctcccacagtgctaggattacaggcgtgagccaccggccctgtcacggttgtacgtttttaaatctccttttattcttttgtttctgtagtgtttccagtagtctaacatcaaacatttttcaaacttttttttttttttggtctcagatgattttc

SEQ ID NO: 97365 - DNA, 2688 bp, Homo sapiens
tgcagcaagatagggccgccatcgccgggcgacgacgaggaggaggcggccgccgcagccggggcccccgccgccgccggagcggtaagtcccgcgcgcggcccgcccccgccgaggccgggcgcccgccatcccggacccgtggcgcgcctgcccaaaaggcctccccggcgcccgcgcttcccccgacccgcacgggccgctgggctccagggcgccctttcctgctctttcgcatcccggtttggatctgaagccagcccaggctttctcgaaattgtcactgcagcacctcgcgcaaaatcttcacaaaatgaagtctgagagggcgggggtagaggactccaaaatggatgtttgagcaattcatatcagtgctgaaaactccttcgcttaacactacaaaattttcaagcacagcctatcggccatagatagtatcaactagaggcaatgtctttagtttttattatttttgaacctggagcattttctgttggacgttacaggatcttactgctttaaatcatacattattaaaaaaaatgagggtttattctttgaattacccttttgtatgcaggagtgaagactgcttttttagttgaccattcaaaatcgttgaattttagtttttgcagactactaaaatttgcagtgactttttttttgtaaggggggtaaatgaaacatttagcagcctttgaaatcagcaagttgcttagatagtactttagattttgaaactgaatataacagtgttagaaaagtatgtgtaaggaattgtatttacgtgcatactagtagtacaatacttatagctgaatttggttggcaaaagtatgttttcattttattacgactgctagtcaggtaagatatggtgggattctttctgtagtgttttcagtgtctgggcaaggggaggagctcgcctgtgttatatgaggggttaataccaataggataggaacagtttttagactgttaattgtgaattttacatttgggtcatcactgttgtgtagatttgttcacctattaaaataatgaaaaccctcatttgagtgtgtgtgtgtggtggatcataggaattgatttgtggagtgatactttcaatagtcactgaagacagaagtttggtatttggtatagtctacaacaaatgcttagtatgtccaggtattttttttttttaagttaaaccaatgttaagctattactggtaaataatttgtaattttagtgcttcgttataggggatgtgaatagttttaatgtcttgttttttcataagcagattaacatgtaaaaatgtaaaattatattaggctttgttatttttaaatacatttatggattggtacgccttctgttcacctcatttcagcttcgctgagagttggtagatttttttatgaactgtatccctctagttccaaagtgccaaaacaaattgactgtatcttaaaaaactactgcataagtaaaattaaaaagcagattgcttctcctgatcttttttgtatttcaaatggaacaaaacttttcttgtaactgtaatttgtaaagtttagatatcagtttacagatgggggaggggagaaggaaggaaatatgggtgaataatatgtgtatgtacatacatatgtgagtctgaggcccaaggatagaatactgtctccaaccttagccagctgtggccatatacttgtagggaagtttccatgcttcttcagctgcttttctgaattaccaaatcactcctgacaacacatattctgccacatgaagacgaactagaatcaatctgataaatctgagatttatcaatcaaatacatcataatttgccaatcatagtaaaatgaaaatagttttgcctaaaaaaaaaaaaaaaaaaaaaaaaacccaaaccatatatttatgatgtctggtacctgcacccaagatttttcactttgagtaaaattggtaagactggcttgtgtgtatttgccttagcaaatagaaaatttgctaaaaatttatttttccagtgcaaatatgaacttaagacatcttttcagcacatcttagaaaaggaaattcacatgagttcatgggcttagataatcttttattactcaaatgactgggaattatgagaggttatagctgtgtttttaaataattgtattttggaataattttaaatttatagaaaagttggaaatacagaactgagtaatctcatacccttcatccagcttcccctaatgttaggataatgatgatacatttgtccaaattaagacatgaacattggtatgacattactaaccagactttgtttgcgtttcaccagcttttccactaatgtccattttctcttctgggatccagtccaggattccacattgcatatatattgttgtgtttaaacaagtggaaatatacacatacagatgaactttatgccagtttagcttggtattttgagattaaaagggccttgaaaagccaatcaactgtgctgaagattgcttttaatatttggattttgaatttggaatttgtcataaaagaggatcctagccaagggtgtttggttacccacagtacattgctgaagaagtctagtcataaagcagtctcgtatataatgtcgtacaacatggactctgaaagatggttttatagcaacgct

SEQ ID NO: 97366 - DNA, 1051 bp, Homo sapiens
tatagtcaatattcctgtcttactcattgcattggaattattttgtttctggcatgcttgctaactcatgagtttgtacttttttactctattttgaatattctgatttcacattactgagataatctttctttctttctttcttttttttgagacaaggtctcactgtgtctcccaggctagagtgcagtggtgccatcttggctcactgcaacctccacctcctaatctcaagcgatcctccttcttcagccccccaagtagctgggactacaagcatgagccaccatatccggctaatttttgtattttttgtagagatggggtttcaccacatcgttgctcaggctggtctcgaacttctgagctcaagcaatccacctgcctccacctcccaaagtgttaggattacagacgtaagccaccgagcccagcctaccatgagataatctttctacttcatatttcctccacactgaattgaataagccacttatctgcttatgtccctagtctactcaagtcatttcattccttctttgtattgactgaccctccctctagttttgtataacaagcttactgcatgttacttcttccaaatcactgacatataaaaatgaacaaagttggtcctaatattgatccctggagcgttgtaacccatccattccaaactattccacactttgatatcaaagtcattgtttacttaagtagttcatccctatactacttatctaacttctagattagttgtttgtctggtattcttttcatggtattttatcctaaaatacaagtaattggttcatggcttccctcagctgatatttgttattagacccagaagttatttcatatcactgaggcagataagatgtgaatccatgctgactctttttaaattaaatcataactttctgatatttccatttgctgatttcctacaaaatttaccaatgtcatcttctctacagaatttaatacttctgaatctcatgctcaagagaaaaagggatatttagggaatgaacaataatttaatgag

SEQ ID NO: 97367 - DNA, 1048 bp, Homo sapiens
tcagcctctcaaagtgccgagattataaacacgagccaccatgcttagcctgcttcttgattcttaatagatgtttaaattcatcaataaggagaaaagtgacttgaaatactttatctttgactaggtctatgtcagttttaataagtaaaaccctcattaaattattgttcattccctaaatatccctttttctcttgagcatgagattcagaagtattaaattctgtagagaagatgacattggtaaattttgtaggaaatcagcaaatggaaatatcagaaagttatgatttaatttaaaaagagtcagcatggattcacatcttatctgcctcagtgatatgaaataacttctgggtctaataacaaatatcagctgagggaagccatgaaccaattacttgtattttaggataaaataccatgaaaagaataccagacaaacaactaatctagaagttagataagtagtatagggatgaactacttaagtaaacaatgactttgatatcaaagtgtggaatagtttggaatggatgggttacaacgctccagggatcaatattaggaccaactttgttcatttttatatgtcagtgatttggaagaagtaacatgcagtaagcttgttatacaaaactagagggagggtcagtcaatacaaagaaggaatgaaatgacttgagtagactagggacataagcagataagtggcttattcaattcagtgtggaggaaatatgaagtagaaagattatctcatggtaggctgggctcggtggcttacgtctgtaatcctaacactttgggaggtggaggcaggtggattgcttgagctcagaagttcgagaccagcctgagcaacgatgtggtgaaaccccatctctacaaaaaatacaaaaattagccggatatggtggctcatgcttgtagtcccagctacttggggggctgaagaaggaggatcgcttgagattaggaggtggaggttgcagtgagccaagatggcaccactgcactctagcctgggagacacagtgagacc

SEQ ID NO: 97368 - DNA, 1002 bp, Homo sapiens
cagaggtggcagtgagctgagatcatgccattacactccagcctgggcaataagagtgaaactcagtctcaaaaaaaaagaaaaaaaaaaaacttactataaagctacagtaatccaagaaagtgtggtgctggtgaaaaaatagattaaaaaaaaaatcaatagaacaaaatggagagcccagaaaaagacccacataaatgtagtcaactgatttttgacaaaggagcaaaggcaataaaatggagcagagatagccttttcaacaaatagtgctggaacaactggacattcacatgcaaaaaactaaatcttgacatacagaccttactctttttacaaaaattaactcaaaatgaatcatagacctaaaggtaaaacccaaaactataaaactcctagaagataacacaggagaaaacctagatgagcttgggtttggcgatgactttttctagatacaacaccaaagacatgatccacaaaagaaagaattgataagctggcctgcattagaattaaaaacttctctgtgaaaaactgtcaagagaatgagaagacaagctacagactgggagaaaatatttgcaaaggacatatctgataaagaacatttctggactgttatccaaaatatgcaaagaacttaaaactcaaaaataagaaaacgaacaacccaattcaatgtcttgaggataggttggagatggccattaaacactcttgggtagatatcagactgggtagataccaagaccaattgttgtgtctcaattggaagctcagaggaaagtttgaggaagcaggtatataaatttagaatcattactatatggatattacttaaaacctgagggccagaatagctcaccttagacaggtgagaacagaaagaggagaaggcccagaaatgagcctgatgcaaaaggtctctggaaagaggaggggccagcaaatcgcagcaaaaaaactgccgaggccgggcgcggtggcccatgcctg

SEQ ID NO: 97369 - DNA, 1046 bp, Homo sapiens
gaaggccaaggcaggcccagtagtttgagaccaacctgggcaacatagcaataccctgtctctacaaaaaataaaaaaaggaaaggaactcagtcatatgagttgggattctccaatccatttcttcctttcattctaaatgtatgctgcttgtatcagagaatggcttattcaatgccattccaggggaacatttctgtatcttctttcttactatggattatagagttgctttcacactttggcaagcaactaagtaggaagcagtcttcataaggtgcccgtgtatgtggcctgtgtttgaagctccatggagctcatcagtgaatcagtgcgttctgtttccatagaacctgggaaagatggacaaacagtgagatgtcctattctttgactcttcttcctctggtcttataaattgcctttttttttttttctggtgagataacgcattttggttgccatagggtacaaggaataggtcacatcttcatttagttacatgatagcatatttccctggtcctcttgatacagttttataaaacactgtgtttgggatcgtaataaactcctatctgtttgaagggggttatttgcagattgtttcatcctgtctatgttgatttaacactgaggaaaggatattggaggaggtctgagggggtgctagttgtctgccagaacgcgttcctctttctaatttgagtagagtacagaggggtgcgtggctgtcctgctgtagactgtttcccggcttccttgcagccagatgaaggccacatgactaagttctcatcggtggaatatgaacaaagtgatgcaggctgattccagagataggtcttacacacctggatgcatgctcccctcacatgctctggaagagcacatgtcattaataatgcatacggggacaacacccaggggacagtggagcagcatggcagcaacttgggtccctgaatgactgtggggagcagagctacccagtaacttggctgcttaccttggggctggtacatgaaagaaaaagaaaaatgaatt

SEQ ID NO: 97370 - DNA, 1015 bp, Homo sapiens
aacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattaaaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgtcggttgttcctaatggcaaactactttagctgggaaaattcatttcaacttattttaagcttgtaaaatacactgtggtgataaaataaaagagctgggtttgacttttgagtgacttttttgtcttcctaactggttttgggccccttataaaaactgaccgttcttgaatcaccttcatggtctatgaatttcccaaaccacttgtaaattagtgcttcagtgaaaagccttgtgttgcaattaggaaatacaaaaaagggactcacgtgaccacccaggcagcaagcgcttcac

SEQ ID NO: 97371 - DNA, 2618 bp, Homo sapiens
ttctttaagcaaataaagcagcttttaactagttatatagtctttttctttctgcctggtttgatctgttttgttacagtgacttgctggatgtttgcagacacatcagaaatgtaccataaacagcgtgtaatgaaacttaatgatattggtataattacatttatgtaccaacaatttagtggagaatacattatgattatgtatatatggaaaatctagttctgcccaaatcaagaatactttgcttctctccaagtctagttttgaacttgtatgccttcctatatttcattttttctttttttatatcacccaagtagtataatactttttatatctgctgccaccatttaccccatgtatttagttgtaaactaataacccatttcctctatattttctgtttgcaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaa

SEQ ID NO: 97372 - DNA, 1991 bp, Homo sapiens
gatttgttggaaatgcctttaaaatgtccctttgtatattgatttttatatgttctttagatgagctgaaattttgagagctttttatctttttaaaacctttgataattcagcttgaaagttacttaaaaatctatttttttccactgtgaagaatagaaaatcgaaatgaaacctacaccaaaaccagaccactgcttctaaatcaataaaacagtggatgactgttaggaaaaacaaagccacgcttctttaatatctactgatctatgctaaatctgctgcacagatactacccagtgttgaaaatgtactaattatatacctgacatcttaacagatattaaactaagttctagttgagcccaactgcagatcagagaaaagaaactctgtgcttacaatcagtcatcttaaatgcaattagttttctctggtctttcttttcaaagaaagggactaaggctcctcaggctgcaggaaagattcacacagattttgaaaagggattcattatggctgaagtaatgaaatacgaagattttaaagaggaaggttctgaaaatgcagtcaaggtaaagaattgtttttatttttgtatttcacaatgtttccactgatgcgaagttagtcatgataaaaatgaatgataattatcttttaaactgagtgtagtctaaaataaagtaataagatgatcagcgtttagtgttactatcaactgacttaagagctatagatgtttacatacttttagatcattttaaaaatgtgtgaattgtcagtagttttgtggaggtttttttctataattgaaaataaaataaattaggtttaagtaattgtaaataatttcgaagaatttgttcactcatggccaatgaaaaattgtacttattacatttgaatagctgaagtataatatatatgcttataattacttcaagaatagagatagaaagttagttaaataaaagctgttctttctaaaacttcatggttttacttgtttgttgtttaaagatacttggggatttgatttgctttctcaacactagagggcaggtccaaaattgtgctttattttagctaataaggataatttggtttgcagacactaatagtgaagcagttttatacatgagtagtagatgacttgttaaatgtaaattctgttgcaaaattaattttgtttgatttattagatgttacttagagaaatctagcaatctctaatatagacagattagctggttaaactgacattgtaggaaggttctttaatttaatttaatatttgaagactactatagtaaatgttatagaatttaaagaagattcttgtgtttactatttcataagttgaaaggaatacaaaaaagtttatttcaggtttactttattttcactggtatcattggaaaggtcataccgaacagcaggactttaatagaactgttggaacaccaggaagaggagggggaaaatcttggtataattggttcaatgttgaatgagaaccattttgtttttttgaaagagtggaaggaataacagtttacaagtaaacacagttgttaattttttgatggtggcatctgtatagatataggtaggtgtgcaaaaatactgagattgaactttgtcaggaatactaattagacgaacaaaaatctcagattatttgtcaacatgctacatcatgttggcatatctatttttcataaggaagataaaaatgaggatgttttctattactagaattcagagatcagatgcttctttttttatactcttaaaatggtaagcctgtttaccaatccttagtagatctatgttgtaataaacttgatagatgaattgtaaatatttcctttaacaattgagagaaactttataatatccaataaaataatatttcctgcttgtaagactatttaccactaactggcagcttttatactataaattagaaaaggttgactctgaca

SEQ ID NO: 97373 - DNA, 1374 bp, Homo sapiens
gaatggtcatttactactatctttaacattttctgcttgaaatgaataattttagctctataccaatttctggcacaatcaacttatgtgttgggtgaatttgtttcatttgatttcagtgctttgccaaagatcattaaggctgggtttgcagcactccaactagaatactttttcactgcaggcccagatgaagtgcgtgcatggaccatcagggtaagattcatacttattcatcagctatatccagttccacactattgaattcagattgatatcactgactttgaagtttgtcatggtggcggttagctagtcattacagatgaggtttttgtccaggataactttaattatttgtgagctgctgaacagtgaaagtggagcggcattgattgaggcaggtaacaattgattctgcctattacatagtctgaatttcttcatcctgtagaatctgtctaccctcctcctgtggtcagagataagacgcaccagtattgtgcttgcttaatctgtgtgactgggtttgtctgcagtgaaattgatgttgcttttcattttgtattcgctaagtttgtttgggttgcgggtggttctttcctcctttgctttgctcggattacattttcagcaataaaagcaatatgacatcattatgctcttcatagatacacagttgggctcaaaaagctaaactcaacgtgtaataattcatgcctttttaaatttgaattcatagaagtaatgtttattttcagtgttatatgttcagtcttacttctttaaaaatgtgatatgtattttaaaaattgatgtatactgaatacaacagagagaatgactaatttattcccagaggacaatagaaactgaactgtaatggtttgcttttaaatttaaatatattgtaacatagtagttactattgaaaaatattttgaaatatatgtgatcctaaatagtatgttacagaatataaaaataataccagaacttttagaaatagtgtcttattcagtcttttattatgctttttaaatatatgctacacgataaattttagtggtgctttgattcctgttttcagtgactactgtaatttattgttacatgtattttgatttaatatggatagaaacatggaggcagttaacataatgttaaatgccttgtgtgaatgtgagatttacttttcttttatctcctctcccctttgtaaaaaaatgtttgattgacttctaaccaaggtccttttatatagattttaaaaataatgtcaaagcaaatccaagttggtaaacaaattgccaggatttatttttactatatattttaaagatgtattttaaagccttaaaactttctaactta

SEQ ID NO: 97374 - DNA, 1003 bp, Homo sapiens
cttttaaaaatttactttgtaaagtaaggaaaacaaaaaattataaaatggaagctttattcaagggtacaggtgttaatgctgaacaattttagtgtaactaaaaaaagtttttaaatatttgtataatagtttccatagataatgtgctaaagtaaaactaggttacagtaaaatactatggcgtatacctgaagcagttgctgcctgttaatgccttgaccttggaaagctatatacaaaaagatggcatcataaaaccgtgcaattcttatgaatatgtatgtgctacttgataataatgaatgtggtacagtcatgcatgcactacaagataatgttgtgcccttttttgtctacaggttgataaaaattaaagagtgggtggacaagtatgacccaggtgctttggtcattccttttagtggggccttggaactcaagttgcaagaattgagtgctgaggagagacagaagtatctggaagcgaacatgacacaaaggttaattagcattcattttccctacactttattatcaactatttccttgcagtaatttaattgcttgcgctgatagaataataaatgacagagtaattaccattataaagagggaatcttctcctttctttaccatgagacagagtgaaaagatttattttaaattaagtttttaactgtcatctgtcatctccgtacagtgttttaattataacataggtattagttatgtatatttttgagaaggaatgatcgccaaaactctttcgtcatgttcagtgggggaggggaaagggtgaatcagttgccataattttttctgagtaacagtaatatattgtttaaatatcagatttcaatcaaataattttgcttttatggccaggtcctggaaataattaattttggatgaaaatagtcataatttttctttttttaaatagcaaacaattcaaaataatatcttcaggctaatacaattaaaaccaattttagaagag

SEQ ID NO: 97375 - DNA, 1050 bp, Homo sapiens
agatgactagctatagtttggggtatggtttgtagaaagagaatagacatttttctgcaaaaggtaactggtccccatggggttcagatttgtgatcttggcctcattatcacacttttgtaaccatcagacctaatagatacaccacatatatttcagtctataatcttgaaatcaaataatatttttaattaccctaggtttatttcatagatgtaattaaaaatcattttgggacatttcccacttttgtttgatagtaaaagtcacaaaagtaaagcagacagccaaagaacctcactcacttttcatcttccctgtgttttctatgacagtgaaagtcacaaaagtgaagctggcaggcaaagagcctaactcactttacgggagagtgctacggtacctttttcttttagtgaggctatagcaggtctgatgtcagtcactttagagacctttagacctcagtgctcatttactgctaaaatgtaccagctctgcttctgcattatgaagatcatctgtcaacactttgagatattctcctttgttattaagcttgtgatgctctacactgtcaggttttttgccaattatagttaaggtacaatagtgtattcaccagatcaaagtctcacattggcggtagaggaatgatttgtaagtctttattcatttgaattgtacaatagaacacctgaggaatgcaaataatccctctgagaactctgcaggaaaggctgttaaaatgacagggtaggactattgttattctgaattgatgtgttagctaaagtaattatttcttatcttgttgtttcataacagttctagttttattagttctgttgaccatatttatgaaataaagtgtgtatgatatttttatattctccttttacatgggcttgttttatttcactttcattgaatctatttggtatgtgatctgcttttttaaaattacatatttgattttaacttgtataatgaaagtaagttactaaaccattgatgataacatttgaatatagacttttgtttgaatag

SEQ ID NO: 97376 - DNA, 1154 bp, Homo sapiens
ttgagctgtaatttgaattgatactcaccttactccaaaatctctgctttttctattggcccatactatttccaaaggaaggtcagacgtcatatgatcataatgtggggaatattagcatttctgttttgtaatctttagattagctctcagtttacttttggggttttattttttagatataattcacatacacaaaattctcccttttaaagcacacaattcagtggtttttagtatattcacattgttgtgtccctatcactaattccagaacattttcatcaccccaaaaatgaaacccatgcctattaacaagcatttcccattgcctctccaacctaatccctggtaaccactaacctactttcagtctctttggatttgcctattgaggctatttcacataaattgaatcacacaatatgtggccttttgtgtctagcatagtgttttcaacgttcacccatgttgtagtgtgtatcagtacctcatttctttttattgctgaataatattctgttgtatggatatactacttattgtctgtcttcttaattataatcatcctagtagatgtgaagtggtatctcactgtggttttgatttacattcttgtaatgactaatgatgaacatctttttattatgtttattgctatattattatatttttatgtttattgctatataatattgttgttgttattatatattctccagggagacctgtctattcaaattatttgcctatttttaaacttaatttctgtctttttatcgttgagttataagagttctttatatattctggatactggacctctgtcatatgtatgacttccaaatattttatcccattctgtggactgccttttcactttcttgatagtatcttttgttacataaactttttactttttaactcttacatttagatctttggtccattttaatttttgtatgtggatatccagttgtctaagcaccatttgttgactcttctttacccattgaattgttttggtacctttgtcaaaaatcaattaaccacaaataaactttacaacaaacaacccatccagttaaaaacaagagcggaggacttgagtagacatttctccaaagaagatatacaagtggccaacaagcatg

SEQ ID NO: 97377 - DNA, 1050 bp, Homo sapiens
atcataagttcaagagatcgagaccatcctggccaacatggtgaagccctgtgtctactaaaaatgcaaaaattagctgggcgtggtggcacgcacctgtagtcccagctactcgggaggctgaggcaggggaatcgcttgaacccaggaggtggagtttgcagtgagctgagatcgcaccactgcactccagcctggtgacagagcgagactccgtctcaaaaaaaaaaaaaataaataaaataacaaagtcaaactcaaatacgctttctactggtttacctcaaatctatttcttgtatggtatttgcaactctacatagtttttttgccccttcttagaaactgcagggtgatcactcagcagtgatttttaatgaatagcaaaacttgctttgtctatacaacggacagaataatttaaggaggaaaagaaaaaaaaatgcctttgaagtgattagtgcttagacctgccttctcagataaaactgattaatagccacatcacaggtaaatacaacagaattctgtttaggaaaatgtgacctgaacattgtggaagccattcttcactttataaataataataatagctaatacatgttgagcatttaccttgtatcagataccatgctaagcattttctgtgtacgtccttatttaatcttcatcataaccctctgaagtagctactattattacctccatttataggtgagaaaactgagactttagaaagttccatggcatggcccgtatcccccttgtctggccccagtgttctataaccatattccatgctacctcctttgcaaacaggttgcttgtgggagttctttaattatagaatttctttaatgaaattaaattaactcttgtattttatttacaaaaattctttttgtaaaattctttttgtaaaactataagctatgaagccaactacaaattttggtgggtatgattctactcacacatttcccgatccttccttttctcatgtcagaatattccattaagccagtggcactttgtataagaccgtaaaca

SEQ ID NO: 97378 - DNA, 1051 bp, Homo sapiens
tgctatgttatgctgcattagctatgtatgaattacaaccaaagaatattctactctttctaatatttattcttttatgatcattttgatatttaattgttgtaatgtgttcttagaattaaaaagtaggaaaagtttaatgttattttaagcagtgcctaccatttatactttctttggtatgtgcacatttgccagcatcctgaaaacttacattgtgtggaatgcttttcccccattttaaaaaagacaaaagtgttactgtatatacctgataagcagaaatggctctctggaaccattcttgtccttcgggtaattaagtaattatatagtgttgtgtttttttttttaatttgtattttgttcctgaaccatttggacccattatataattacactgtgtgtactttgtagtaaaaataccattggaaaattcatcagggaaagtagtctctgcatatgctcttcacaatgtataaatttctccatcctcctgtttctatgtctacggaaatctcagagtatttaatggtctgctttacccataccacttccccctacgatggatgactctgtgcttccacagaaacaccttgtgtgactgccttgtctagaataacacccccagattcccttttgttctctatcatagcatcatgtttatttccttcagagcacttatcacaagctgtatcatcttggttacttgtctcttgtttttgttttgttttttgtcttgtaagaatttaaattccatgagaataaggaccatgcatgttttgttcattttgtatttccaatgcttggcactggactcagtaaatattgttgattgatcaaatagctggctggatgaaatccattgaatgtatcccttttgttcaacactgacttttagtcttcattaataaactatttggatgatttgaagtcaatctattctggttagatacatctacagtttagagcacaggtggataggctgtgtatgccagggttagcacatactgtctataatagatcaggatatttttgtctaggaccacac

SEQ ID NO: 97379 - DNA, 1111 bp, Homo sapiens
gatgtgttcatgtaacgaaccttcacatgtagccccaaacccaaaataaaaattttgttaactctcatcatgttttaggactggaagagaaaaatgggtgataatgcttttattatttaaaagtgtttttttttcctgagtcttattttgaaaaattatacagaatagtttgcatggcatattccttgcatcatagaacttgctctgcttcaggccaaattgaaatagagacagaaaagaaagagaccaagaaagaggatatggagaatatcagccatttgtttcctttcccgtattcaaagacaaacatctcagttgcctggatctcttgaaattagtacttgtaaaagcttttaagtgttactggaatacattgttaaagccatatctggttgaaattttctgattaagcacaattaaataattgtttcagcaattacacagttcatgattatggtatgtgatgggacattatttttttaaaatctattattaagtaaaatatgtattggtggccaagtataagttttagtacaacttgctatatcttggacattttgcatatatagcttaaagaccagtggggtagactgggaagttttgtcagcttcataattttggaaaacagaaaaaaagaaaaaacaatgctgattaaacattcttagccataagaagatatgtgagtgtggcttagctaataatacctactttcttactatgtatcacttaatagactttttttgctatgaaatattcaatagttacacatttgctattttatagttatttccctgccctgttaacatcaagggttactaattgttgcattagtagttcctgacaaatagaaattatttgatactctaagccatttctgatggaagatacaaagttttgacaaacacgtgtggcacagcaagtgtcccattctaaagagcaaaataaatgcaaaccaccattatggtgaacacaaacagcctgaaagcaagttatcagtaagcaaataattgttgaactgttatgaatggaataggatgttgaaatagggcatgattggctgatgttacatatgtccttgattaccttccttgtgcttttatcctaataagtg

SEQ ID NO: 97380 - DNA, 1092 bp, Homo sapiens
gcctgggcaacaagagtgaatctccatctcaaaaatagtaataataataattcttcagtgatggggtgagggagttgatgttatagaaatagggaaatgagagaatatcacgtgttagtttgttttctgctgctgtaacagataccacagactaggtaatttataaagaagagaaatttatttggttcatggttctggagcccaggaagcctgagagtatgtcactggcatcttctgagggtcatcccatggcagaagagcagaaggcagaaacaagtgggagacagagagcaaagtgggtcaaactcattctctgtatcaggagtccactcctgaaataactaacctactcccatgattacagcattaattgcttcataaggggtgagccctcatgacctagccacctcttaaaggtcccacttcccaatcccattgcactgggggcttaggattcctaacacacgaaccttggggggcacattcaaaccacagcactatgaggtagagcaatggcagataatttgtatgcctaatgttgtatttgtagtagtcgtcattcagtcaacacttcacacttgaccttatgccagttatatttaagattcccaacaagcttgtaaagtaggtgccattattacccacattttaaggaaatgaaaagcaagtatggagagattaaggaacttggccaaagttacataaccagtcagtggtgccgacatccaattgtaagcagttcatctgcagagctcatgttcctcactaactgctaagccatagtatctcagcactggggcactggtgatgctggaaaggtagacaaggcctgagaaatgtgtcatataccagtcacatttcctattactatgaatttcatttaggtaaggttttgttgttagacagttcatgcactataaaatctgagactaaaaattcattataacctaattagaaaatgccaactgagagtggtattttttaaaaaattgtacctaaaattgtatctttaattgtatggacttctctctaaaaactattttccaatttaatagccattgtagggacagtacataaaagagtttatatatt

SEQ ID NO: 97381 - DNA, 2292 bp, Homo sapiens
acaatccccttaaaaatctgcactagagattaaggatctctgagtcatattttgttaccaaaacactgagttgggatgagctacacttttacaaccggagttgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggtatttctttatagcaatgtgagaatggactaatacaggagtttagtagttggtgaagagggtagtggagaattttgaagctcagaaatctcaggactgttgggagtgggaaatatagggcaggacctcgggaaggatttagaatggaggttcaagatagtttgtaggatttgaataacaggttttcctgggagaagggtggagaaaaggaaaggtgaacaatgtcagtgttttacagcctaatgtgtcctgcttgtgtgggataggaggaagagcattatttgtctctaccgttctttcctgtgcagcatgttccccagacacagcatctacctttggatttaatgttgtagtttaactatttgatgagttaaatagacttgaagcctagcccaaaatgttagggaccattaataatattgtttctataaagaaaacgaatcctaaaaaactggagaatatggtctatttgtaacctagggagtagaaactatcaaggagttgggtgtgttaagaagaatactactttagaatttgaaatacaagtgctatggtctttatttgctactataagtagctctttgaacttggccatttaaattacttagcctttcatgtagaagataattcattgagattgttcatataaaatgtgttctgtataaataatgtttcccaaatttacttatagctcaaaaagtattcaataatggaaaaagaacttgttttggccttgtgaatgcatcttttggatacattaccttggtttttatttctgttattggattaaggaacaaaatttattacatgtataaatataacagtgagactcccatgatatcactgccatgttctctacaaccccatcccctctttcaggttgggccctataacttcaccatttgcagcttagaggattttattgtcacccttggcttccattagagtaaatcattctttgtttacattgttacaatatgtacagtctttatgtaaaatcatgttacagtagcatgattttttaaagaaaattgtttattcttttaaaaaccttttaaaacagtttcattgtgatttcatatatctcagtctctctgagtatgaatgtatgtatgtatgtgttgggggtgaggcagtgcaagttagtaaagaattaaagatcatctctaaggttcccttccagggctagaattttatgattttaatgaagtgtaatgaattcataaagaaaagatacccatgcaaatatctaggtttgccatagtaacttttcctaattgcgtacagagcattcctgaggttgcagcccaatttaagagcaacttttctgggctgggttacagataagacctgatcttttttcctactctcattccctcttccatatctcagggccttgaaaataagccttttctgcatctcaccatgtttcttcccatcttttatcttagtgggcagctgttgctttggctagaataagagcaaagtgaattggcatatctatatttgagatcagtaacattacttaaactattatattcctttattctaaattgacctagaaagcatgtcccatcaaaaacattagaatgtgagactcaccctcaaaagcctatttaattcacaatgtagtagaaatagaacaatttgagaaatatttttgtatctgtgaccatttttacgaccagttttaaaattctgctttttaaaaatgtgttttaaaataaccgacttatgaactttgcatatactcctgtttatataaggctgggactgcacattgctgtgcaatctgtatttttaatgctttacatcaagaaaagcaaaacttggtaaaaaaaactgtcattataaatgc

SEQ ID NO: 97382 - DNA, 1883 bp, Homo sapiens
ggtcagttgatttaatattttggaggctggatcatcgataataggctcaattttgtcttgtttgtttttcttcttaggggaaaaatataatttagtctttcttcagtatatcccctcactccattttctaatagcatgtttgtcttctatatggcatcactaggtaatattgaaatggtagtaactcttgtattagtctttgatgtaattgaattgtcttgacatttttcaggctgttactaatttttgctaatattgtccattttatacattaaaaatttaatgccacaatgttttattagtaattggtttttaaatgagatattgaaaataattatttgtgtgacctagccccctttcattaaaacaatctatttttattttgaaaatttgaaaactttttaatatttagtatctaaatgtttagttattcatatatatttacctttttctcaatcatgtgtaggatataatgtgcaaagtaaaatcctgggttatagatcaaaagaaacctgttcgcttctatcatgattggaatgacaaagaggtaagttgtaaatatcatgccatctattactgcctttgctttcatttgctagggaacaaattagagttgttgttattttacacttaccattatatctaaatttttatttctgtcagtgattgcttattcctgggcttgttatttttttcttttcccccactcatgatatttcataaccactaatcttttggaaagaagaattataaaaatgaaaatgcctacttgttttaaggaatgtttactttcaaattcttcagtgatttactccatatttactaaacttttaaaagggattctttctccatctcccactttagattgaagtgttgaataaacacttatttttgacttcaaaaccaatggtctacttggttaatctttctgaaaaagactacattagaaagaaaaacaaatggtaagtttttcctcaccagatatacccagatgcatcatctctgtacacacacaaacacacacccacatatatgtacttaacggcaatgtttaattttaatatttttctccttattaaaaagtttaaaatggatgagaaagctgtgcttggtatttaccttcacagatgagtcttctaattgacttagagaacttaagaaaaactgaattaaataagcaatattgaattatatacatttacttatcaaatgtaagtttattagacattatcgtttatttccattgcaaaatgagaataaatgtagtcacaacaataaaacttcttacactaggaatttctagctgtgttgatattataagtgactttaaaatacccacctggggttgtagctgggcatgaattttaaaatccagattgaatgctttaaaaaaaaaaaaaaaaagactgtgtgtggggaaagaccagtacctgtttcaaatgctttaaaagtacatcgaggtaaaaactatgcattcatgtattgattgtcatttttggcatgtaaccaaaatgtacaagatttgttactatcactgataacttcagaaaattatatgttcatgtacctgtgggcatgtccacatttggcataccactcactttgacttgcctcactggactcttaagtattttatactattgagtcatacaaacaaatcaaaactatccaaagcaaaatatctgaattctcctaaactatattgtctgtttctccctgtacttcattaagtacttagatgcacatggtttcaattttccattaaaaattctcatttccatatgatatcaaagagtgagaaggctttaaactgaaaaataaacattcatagactggaagccaaaacaataattaatgtcagatggttaactccaataaatcat

SEQ ID NO: 97383 - DNA, 1009 bp, Homo sapiens
tgttgaaagccgaatgctagttctcattaagatacttcttttttgcctacttctttgaaaagagttgctatgttgcagcaactaaaaatttaaaacccttgagcaattgaatataattaagtacaggtgttgactctgggttataattcataacttttaagtgactttaaggattctttaatggtgcggatgtctaattatctacagtacaagtaaaataccaggcagaattttctggtgttctgtacatttagaagaattacactgtataatattgtaatgtgttgcttcttgtcagttaagtggtgtcagtgataaccagaaggcttttttgattgctactatactaaatataagctccaattttaatgtttttcatgtctttctacgtgctttctctttatctcatcttactattcaatattgtttttcactgctttaaagtatattatttttaatttaagagaactcttaaaattagaagaaaataacaatttttaaggtttctcagaactgaattgacccactttattattctctcctatgctaaatatctgtttatctcaaggtttggaattatttttacttacagccttgcttgattgctcccatgtaagtttactttgcgtgaaagtcctgtaggaatcatttataatttctttaattttagactagtccctcaaagtcagctacatatgccttttattttactaagctttttgaaaacttaatcaacttttgaatgtgtcaaagggatggtagttttattcctcttggtctagattgagttttagagctgtttcctgtaatgagagaggaggaaggaagaggagaggggagagaagcaaagcaaaagcacattcttctggctacttgtagttctgttttctattccagcattaaacaattagactagcacagactggattattttatggcctttgttatatctattttaatagacttttccctggaaaacaaatattaaagacttaagagttacttttga

SEQ ID NO: 97384 - DNA, 1842 bp, Homo sapiens
ctgttagtcaagcaataagattttagataaatgaaaataaagttcttatattttactgttttacatttatttctaggccactgtgtatttttctttatgctagtcacatgcatatttatatacagcatgtgtataagtaggcctatataagttataggcatataatacatttatgtttacattgttagtttgcttttgttactataacttatgttgtctcatattatacttttattcaggattaaaacttagctagcaaaatattatatggcattgtattaactatgtatgtgatatagttggatgcattcttataggtaaaaatttatatgaagaaatggaaatcttatttaaaaaatgaactgcactatttaaaatagaaactcatgatctttttaacgttgcagctgagttaaacaaataatctttccaccattaccaagaggtgctgtagttaaaaatacatttatacatattatttttaaaaacctagttaactttaaaatatgtaagttttcttgtcgtttagggttctgtgaagctgatcatcaagagggttgcaaatcattggtggtttctattttcagatttccacatcccggagtaatttgctttaatttcacccaatttaacctatacttcacaccatcaccattcagctttaatagctatgttctatgcataagaaaagcagataaatgtccacaattaggctgcaaatgattacaactagttagggctttatgaagacaaaacttaaaggaccatggcgccaaacaaagccacaaagacggcttgaaaatgctgtctcgagaagtcaagtctaccatggcatttgatttattacttttgtagttgattttacttatttttaatatattggcaggtgtgcctactctgggaagtattcatctttaaagaatattagttctctgttcatttattttggtttttaatttatttgcttttttgaatctcagcataaccaggttgaatctcttttcaaaaatattattaaaaggtagcaatttttaaaaaattgagaataatttgtttgaaatgtactggcatttatatgccttgttaatgcatttctgaaatcaagactttgctgaaatgtttatacgttgaataaccgtatcagacatttagtggaagtatagttttacaattttgtatagaatttcatttccagataggttttagtatgcaaaatataagcctatggaggattacttctatgaaatgttacttctatgtgcatatgtataaaaaattcagaaattgttttaatcctatatgtatgttgtattttctaagatgtatgttcttgttgatgattaatgtatattgttatttcaaggtacaaagaatttatttatggtttaaggttttaaaaagttaaattattttaatataatagcattttataaatttattttctcctatgaagtaaaacttgttagtttggttaatatatcgctgtatttaatgaagtaaataaatctcagtctcaagactggatctcatctcttttcaaaattttctgaagattttaatcaaggtgtgacatataaaaacattttctttaaatactttgtaataaatatatacataacataaatataactcaaggctttagtctggtgttccaacattagtcattttgttggatgttctctcagacattctatatagataggaatagcaatactgatggataataactttatagtttatggcacccagaattattcttataattgtaatactccccattttagaagtaatgttaatcattttatttattatataagcagtaacatgtatttattttaaaca

SEQ ID NO: 97385 - DNA, 1987 bp, Homo sapiens
aagagtttggataaattaactgttgttcagtagcaatttgaaatgtacagcttttttatgtggtttaattcagtgttttaaaaatagggctagtatattttgaaatcactagagaattagttgaattggggaaaagtcaacaactttttgtaaattaagttttttttgagatctattctttccttttaattgatattaatttcctgaggagttgatattaattttctgattaatcattttaggttgtatctgaaaaaaatttaagaaatccaaatgtatttgattttattaagctggctgactttgtcaaaagtctggaaaaactttaagaaatccagatgtacttgattttattaagctggctgactttgtcaaaagtctgaaaaaaatttaagaaatccaaatgtacttgattttattaagctagctgactttgtcaaaagtccattgctatttgcttaaggtttctagcttttgcagcagtgaataatagtgctcttaaattggatttatgctaacttttaagaaacatatttgttccaagcagtctaagaagtgcagagatgcatgtcaatattcagaattcatattttccttgaacagaaggttgtgataaaatggcacatggtatgttttcattgcctgttgaaagactttcatgcagttaaaataagcattttgatggtggttgaattaagagtttttgtcagtctcttctcatcatggatgattagactaaaacgtctgcttgtcttgacttgagatcaccacagcttcagataacatgctttgtgattgaaggtcgaaatattttgaattctaataggctgccagatgaattgcttgaaatagactgtaaaatttcaaggcttccttttccatctgctgtgaaaagaaccattgggaatggttgagcttgatgatcatagaattactggatggtgattctaaaaccctcaaagggaagttgctatggagatctagttccaaactgtgaaatgattcacctttgaaaggctgcagggtctgagaagctgaacacatcattgttcaggtggtcattggttaggaaattgctggtgcctgtgtaatcagcactcctgtggtagttaacgatctaaaaaggtttgttctgaatgatgtgggacaacagcaatgtgcataagatggcttctctcaatcatggtttgctcagtctggtgcttgtaaaaatacagcaaactaaatagcacagaaatgaattgctttattgagggaatcttttgaaaacaaaattttgaattgatgagtttagcatctaaaataaaatggttctttttgaaaataaagttttcgcagaaacatgcattgtttactttattttaattcatccccatacctcccacttttttgtggtaaagagctctttgtctctctaggtgtaagaccttaccacggtgaaatgtttagcttttaatatcctagagtactatttcaagagccttcttgcataagcacaggggcacctgagaaggagtttagaaaagcccctggtcattgagaatgagtctaggaaaatccccaaatcattagaagtagaaagtaattaatcccctatagcaaattggttcccctcaaattgttttttattatgcatatttgtgacatgtattttaaattgatattttttccaatttttgtttttattaaatcaacttttgtttttatttccagaaacctgaggccaaaataatttttgaaattcatttaacagcaaattattataaactgctattctcccatattaagatttcagaataggtaaaattcaatcttagttaatttcatatcagcctataatgttgaactttagtaatcaagtatgaaaccttatcaaagataatgtatgtatatcaagtttgtctgtatggtgtcttctccagacatcattaaggtaaaatatacatgtaacaaaaatcatatattcttagtgtacagtttgatgaag

SEQ ID NO: 97386 - DNA, 1316 bp, Homo sapiens
aatggaataaaattactcatttaaagtaagtttattatcttgtactttgtaaaaagctttaagaatgtcactgttatttaataataggtaaaaggtatatttagttttaattttaataacaggtaaaaggtatagtataaggatgttttctaaagtagccagtggtatgcctctgcaatataattggcttgctaaacctcaataatagttggcatacagaaactctacatgaattcagtgattaaaagcaggaaaactacttaaaataagacctttttgttctttttagaaacaatctaaatgagaactttatatttgcaggaacaagatttggcatttctttttcactgcttggttgctttgatgtgagcagtataatgtagtggacattagtatataagtaaatgattaaatgagtcataagatggaacatctgcctgagaaggcctttcagacagcatgagttatgttgttgaagtctctaatcagtgcatctgtccctgagacttcagttggtacaaggatagttttctattttggattagttactatatgaagacagcatatttaaaaaaaattttttcatgcatgcaactggaaaatttgtgcctgtgatattggaataaaaaaattacagcagtgattttttttttgagcatagtaataaaggatagcaataagtgtataaaatttaacttttatatgccttaaaatggttatttatggtaggattttacattacagacccataagtcttaatgtcttacctgaggaaatattcttagaaataatgttattacaacaggacataaattcagatgaaggctgaagcacagcaggattcagataggatgtttaactgaaactgcagaccatatcgtgggtcccttccgatctggaatattaccatagtttcaaagttgcagagagagagagagaaaatatgaatatgcacgtttgtatgttgtatacaagataaaaactcctaaccaagagcacattgtagaataccagaggatgatgacatagagttgtggtaaatgtatgtatgttttattctttataatcaacaagccacaggagacaaattcttgtgatcatagttaattttcactaaagggtgcaatcgaaagaagaaattggctcttctttccttcaaaaatttatacttagctgttcaattaaacttttttacaagaaaataatgagtgtaattaaaggagaatatgggggtttgagtaagaattgggcacatgttaatttacgtattgggatttttaaatctttgaaatatagaccagtcatcgggaaatatt

SEQ ID NO: 97387 - DNA, 1025 bp, Homo sapiens
ttcagaaacacgataaatacatttattctgttttagttttctcacttattatcctaggtaagaaagtccaaatgtattacaaggccatttctaattttttttggggggaggggtggatattcatttatcaaatcattattgttccattgttctagaaaggaaagaatttatgtgaaatgtttggagaattcatttggttgatagataagtttttagtactgttttataataaagccatcttttgtttttcagcaaaattcctgcctttctaaatgtggtggatattgctggccttgtgaaaggagctcacaatgggcagggcctggggaatgcttttttatctcatattagtgcctgtgatggcatctttcatctaacacgtaagtacagttgtttatttaatcattgatttcattcagatcagtgttttctttccattagtgcacaaataaaattagaaatgactaatggaagattgctttgctttaccagatgaatcttgggtttgtctgtaaatctgtgactttaatgttacttagtatcatctccgtatctgaaggcttattccatagcaagtatatgctgcattgagattatattctaattgaactttattccctgttctggattagagcaatcaagaagtgtttctatatggaactttgttcattgtaaaggcattctgaaattatcttaaattgtggaactttattgcttttctgtgtgttaaggaggcagaattgttagagaaggggattctgattatttaacaacagagaaaggcttctgggttatctattagagatgaaaggattaaagagaaactatagatcagctagtccttatggagagaggaatataaaggaaagagaaaaaataggactgtggcttagtttgggctctgttgactgactataaaagtgagccaatcacatagtaattttctgacaaaatagagtttaggttaaggcttaggtcaaggctgtactttgtgttaatagtattataatgagcaaattaataga

SEQ ID NO: 97388 - DNA, 1036 bp, Homo sapiens
ggtgtttgttgtctctggtctctgtgtttaccttcgcgcttcaccccgaagggcgacttggggtcttctgggagatgagccggtttacggcgacaacccaagtccggttgtaggcagggttgcagcggggaacacggaggcatctttgatttatagcctcagcgaagtgcaactttccggcgcctggaccttcgcccgggtgatcgcccctgctccgcgcccggtgcggcgactcctccgcgggcgcgtggggaggaggcgcgaggcggggagccaggaccccccgggagcagccgcaggggacgaggctgctcacgggtgcactttgtttcttcccccacttcctcttgccctcctccttcttgctccctcccccatcccacccactctaggaagagccgcgcttcggaacgaccccgttggccatgctggcggcgacctgcaacaagatcggcaacacgagcccgctgacgacgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccccgcaggaggcgggtggccagtcggccttcatttccaaggtgcacacgacggcagccgacgggctgtacccgcgcgtgggcatggcgcacccgtacgagtcctggtacaagtcgggcttccattcgacgctggcggccggcgaggtgaccaacggcgcggcgtcgtcgtggtgggacgtgcacagcagcccgggctcgtggctggaagtgcagaaccccgctggggggctccagagctcgctgcactcgggcgccccccaggcctcgctgcactcgcagctgggcacctacaaccc

SEQ ID NO: 97389 - DNA, 1010 bp, Homo sapiens
ttaatgttagttgtaggtaatgtaaagtttatgtgggttataaaagccatactacatatacgtttttgagaagtcaaaattatttatttgtatatcaacaacataaattaaattgggttgtaaggacgtgtagttgtattacttaatgtgaaggctctcaaaaggtgacattttaaaactctggagcgcctaaaaaatgcaaaggtccttggcagctttaattggggaggtgcctaaacctctgggaggggtcagagaaaactctggtgggtttgtttgtttttaaaaagtgatttaaaaacaactgtgaaaggaaaacgcttaaaaaaaaagaagtcttttagctcccaaggccctgtatgttggaaggcaactcaagggaataaatcgctagagtcaataccccggaaaagacatttcatgcctaaatgaaaatcttgttaaatgttattaattttgacttagagcacacagcagccccctgtgccttgtattcccttattagggattcatgtcttatcaaatatctaattaatctcctagacatcatttgttctggccaactttatctcagctggtccgcggggaaaactccaaatattctctgtgacaaagctcccttgaagatctttttaattgtctaaattaactgcaccaaatttgcatgtcaaacggtaaagggcaacctgagataaaatgtaaacgttttaaaaagcccccaaactaagcacttgatttgataactaggctttttaatgttatggaagacaactgctcctttccttttcaaagacggctgatctatgcaaatagtgaattggaaatgcctaggtccccgcgccgtcaaatggccctcgcaggttatttgaatatcagtggcgctgcttctgaaaaggttcaaggatgctctctgacttctttgtgattactcagtgcggcgtcttattctgaagaaaaaaactcaggaataattaaaggctgggatcaggcctgggaacacatttgggaca

SEQ ID NO: 97390 - DNA, 1039 bp, Homo sapiens
gaactcatttctgaatatttttctatccccctaccctcccgtatgaactcctttttggcagtaactgtctcattcttccctaagtgacagacacatcagctggagtacgtcatttaagccagtgtaggtgatttaggctggcaactttaaatagctgccatgaaatgttgtcattagtttgctatctgcagggaaaacaaaatgaaacaggaatatacaaaatgagataagagtctctcttaccttacataaaccttatgtttgagggcagggggcaaacctttaaaaaaaaattatttatttatttagagacatggttttgccatgttggccaagttggcctcctgggctcaagtgatcctcccgcctctgcctctcaaaatgctgggattacacgcatgagtcaccactcccagctgaaaatttttaaaatttattgttagttcatatttgggaaacaaaaagctcacttttcagtctgagattttgcaaaagtggaagtgtagtgtaaaaaaatataaaacatacataccaatagccagcctaaaactgcttgttagcaacccaagctagtaattaaaaattttgaaatctgggaataaaagcaagattaattaaagtacttggtggttacccataggtgtgtgtgtgtgtgtatgtgtgtgtgtgtgtgtgtgtgattagcaaccacttggcaatgtattcagtattgttatttgacaaataaggatgaggaattttgaattggaaataaggatgataaattcctcatgtacctttaaaaatacatcttttaaatgaactcttactgagagaataactactaaaagtttaattgtagttttttattataatattttgctttgattttatactaaaaactgccaaccagataacatctaaatgtatctttttcaatatgacaaagttacataagaagactccccttgcacgtaaagaaaaatgcaattattttctattctgaatctccagactgctgttttagaaaatcatatctgattatttgctcagcagaaga

SEQ ID NO: 97391 - DNA, 1028 bp, Homo sapiens
acggagtctcgctctgtcacccaggatggattgcagtggctcgatcttggctcactgcaagctccacctcctgggttcacaccattctcttgcctcagcctcccaagtagctgggactacaggcgcctgccaccacacctggctaatatttttttttagtagagatggggtttcaccgtgttagccaggatggtctcaatctcctgacctcgtgatccgcccacctcggtgttgcaaagtgctgggattacaggcgtgagccatggtgcccagcccgtagaatgtatttttctgtgatgcttaaacacatacacacagcagagtgcatagtcttataataattaaagtttctaacccacaaggggataagaatttgtgtataggtacctataaagcaaattaatgttagtaagattgtcaaaataaatataaagcaaaattctatctattaagtaattcttttccccaagcaaacaaagattttgcacatctttccatgtttgaattgcagatttatttcttcacaaagcaaacaggtaacactaaacagtcactctgggccaggtgtggtggcccacacccataatctcctcactttgggaggctgagaggggaggatagttcaagaccagcgtttgagaccaactttggcaacacagcaagaccctattgctacagaaactttttgtaaataaataaacagttactgtataggaaagctagagctggggttgctgggagtgctagctctccttcagcctgcttctcaaccacccattatgcccgccgttgaactcagctctacaccagcagtgatagtggatgaaccagccctgaaactctaatgcaggcatgccttatttgatcatgcttcactttcttgccctttgcagatgctgtgttacaaattgaaggtttctggtaagcctgtgctgagcaaatctatcagcaccagttttccaaccgtatgtgcttactttgtctctgggtcacatttttggtaattattgcaataattcaaacttgta

SEQ ID NO: 97392 - DNA, 1061 bp, Homo sapiens
ttgcggtgagctgaaattgtgccactgcactccagcctgggctacagagaaaaaaaaatagagaaagaacacctagatatctaataaaatgatattaagtgagtaattatagaatattgttacagtggaatattatcccattaaatgatatgaagatttcttaatgatatggacattgtttacaacctttggtcaaataagaaaagcaggttatgaaacagtagttacatttgtgtttctctttgtatctttaggtagacatgtagacagagagacagatacttttagaaaaaggattggaaggagatagacaaatattaacagtggttgtgtctgggtggtaggattacttgcgacttttaatttcatctttttggcttacctgtaattccattagtgaaggtacattacatttataagttttttaaattaacattgttttagaagaattaaaaactgtacatagaagtaaattatttaaaattgaattgctcaattaatgcctttaaagtttgacttaaaatttagcagtagtacttaactaaagctaatagaaactcttaaagatttctcaaaatcaaaatcaaaattctgtatgaaataggaaagcaaataatgatgttgtgttctgaatttgaatgcaatgaaaaataaactgaccaattttctaatccacttgctgattcaagctacaaaaaaagtcttttcatttaaaaaaaaatcacctattgaataatgtctcaccagtgaatagagattatttttgcaataaggcaatttcagtggatgtggttatcatgggataatcacactcctggggtacagccttgtgcctgtaatctctcaggagtgtaattatttcatgataaccacaccccctggtgttgcattatttctattatgaaattcttagtttagtatataaagtaacttactttgatcactggaaactgcaaggtgctgttagaatgttccagctgtgaggtttacagagaccagcataagatttacttctcctttgcaaagttaaattaggcaatcaaaatgcttctttgggctaa

SEQ ID NO: 97393 - DNA, 1040 bp, Homo sapiens
ccaagtgagaggcaaaaagaaatgggattcagcttagtttctaggcaaaatttatagtgaaagattttagtctttgtattaaattaccaaacatagtttggagtctttttccctggagatcttttaaaaatgtaatttagcttaaattctatcaaggaataggaatttgaacattggttagattcttacttttttagtaaccaaaatcacattcattatttctcaggttcgaaatgtgaggtgcattaaatgtcacaaatggggtcatgtcaacacagatcgagaatgtcctttgtttggtctttctggaatcaatgcaagttcggttcccactgatggctcaggtaggcactagacatgatttgtttcgggagaggacaaacaaggaaagataaaacaacatttttctttactctttctgggtattgttttatttgggtttgtgtgtggggcttgtttgtttgtttttgactaagaccattcccaaaatatgattaatgggaaactctgatcatatatgttgaattaaaatgctgtgtaataggattaagtttaatttttccagccaaaggccctatgaactaagttttaaagtaaaatacattaaacatagtttatcaggctagtagcctaaaaatggaaggaaaaaatgcttatttctcatactcatatcctgaattataaaaatagactgtactgaaagcctcagcagccatctctttttagtacagaggtaaaaacaaagctgagtatgttaaaattgttttttacttaaagttacttactgtcctacatattactgtctacttcagaaaaattgatctaatttggtttagattattttggttctttttctaaagagatattaaactgagaagttttaacttaaatttattagtgctttgttagtatattattgaaacaggcacaataatccaaccctaacctgtaatagatcataatagaaataatctgtttaatcctgtaaccttaagcaagtcctttcacttttatgaacttcagctccttattttaaaata

SEQ ID NO: 97394 - DNA, 1022 bp, Homo sapiens
ggcattacctccagcaacagtcgataacaggattatttttggaaaaaattcagatagactctatgatgaagtacaagaggtggtttattttcctgctgtagttcatgataacctgggagaacgtcttaaggtaggtgaaataaatgttttgttagcaatatgccttttaaaaatatcataaagttatttctatacatagcaatttggaagaaactgtagaagttaaaattgaggagtttacatttgaaaaataaatgagtcagaaataaactgtgatcttttatttcagtgattcggaggacgttgaaataacaataataaaattatccattgtttgaataaatatttgaatgctttccatatgcaagcatgttagatagggcaagagatttaaagtcagctgtcaagactctgttccaggagcttagagtctagtatagcaataagatgtgtatgcattataccccattataaaataggatggtttaaatgctaaatttaagtaacagtagcatgctgtggcagcggaagagaatgaacatttaattcagcttggagttagctggaatttgatggacaaaaaggattctgattctgaattggcttaggttctacttgatgtagaataggaaagtcatcccagactttaggaatgacagttttatgacacatcaaaaaaggtttattaggccctatgttaacactatcaatatacattttatgcagtcacttggtagtatacacattaattaaaggatcctttaaaaacttattttaaaaacccatttaatgtggaacttaaaatgagagcttcaaattatgctattgttgctaattcatactttttagattttattttattgatattctaatattaaaacatattaaatattagacttttttctgtatcctatgccatatttttttcttttgctaagaccacttattcatctgtgataccacttccactttatttcttcatatttaaatatagcctgtcctgtaaaccagtggttctcatt

SEQ ID NO: 97395 - DNA, 1005 bp, Homo sapiens
gaagtaggaaattataattcattggaagtacctaacatactttaatcacaccttaactaattctcacaataacctcatgggctatcgtgctcattttacaaatgagatatctgaggttcagagataaagtaacttgacagtgaattaccaacttcgaatttgataggtttgtttgactccagaaactttatttccatgattccaaactgacttcagaaggaaaagttttaaagttagatgtcatttcatctgttaacttggaagaaattttactttgaatctaaaaaatctcatgagcatgaaattatttaaaaaaaataatggaaatttattttaatatgagaactttatatttttgttttagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaaggtatggacaactttttgtgatttaacttgtttttgcaattaataaaatacacccttacctatagatattgcatttaattgcttccaagattaataatctagtgtaatgaagggttgaactgcaagggaaatttaaaaatttgaaagaacagtgaaaaagtgccataaagagctttcttgaaaaagataaaaaggtagcattacctctgggaatatgaatttcatataacctgtatatactttctttgctgcagctcttggccatttcatagtactttttcactttaataatcccttacaatttcttcccctttaaactttgggctgcactccaaaatcttatgtgtaagtgtggaggtgaggaaatgggagtggggttagagacaggtgtttgtgagttggtggttgaaaaagctgtgttgatacaatagtaaaacacaaa

SEQ ID NO: 97396 - DNA, 1064 bp, Homo sapiens
aaaaaaaaaaaactaaacatgcaactaccatacaacttagcaactgtactcctgtgcatttatcccagagaaataaaaacttacatacatttacacaagaacctgtacgcaagtatagcagctttttccatgatgaccaaaaactaggaacaattcagatatcctttaccttgtgaataagtaagcaagttatcatacattcataccatggaatattactcaccaataaaaataataaactattgatatatacaataacatagatgaatctttagcgaattgtgctcagtaaaaccaaaagcttacatattattccatttatataacattcttgaaattacagttatagaaatggagaacagaatagctgttacctgaggttaatgaaggatttggggtgggagataagtaggtgtggctataaaagggcaacatgagggatccttgtggtgatggaagtattctttatcttgactatagcaataccaatattctggttgtgatattatactacagtttggcaagatgttaccattgggggaaactgggtaaagggtacacagtatctctcagtattatttttttataactgcatgtgaatctataattatcttaaaatcagtttaattttaaaagtaattcatttatctttttgaatatgtaatagatgcccatggcacaaaatttagaagtctatatttatgtttacatagtgattaggaatcatgatatacagatacatgctttatgttaaatatgacttttcttctcctttctcctcttcttctttgaaaatagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggtaattttatcatataaataatattaggatgacaaactacattttgtgtagat

SEQ ID NO: 97397 - DNA, 1024 bp, Homo sapiens
acaatggctttgagactttgcatagtttatatttaaaataacatacctttcctgtgacagtggaatgaatctaattgtagttgatacaaagtttgtttatagtcagtctcttaatttatgtcaagactaatatctcacatattatcagtagagaaagcagttcatatttgcaaggcatccgtatatgcatatgtatttgatgattttaaaaattatttctctaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagaggtgaagccacaaaatactataaaccagcaaggggtcaggggatggagtagagtcattagtatgttaataattttgtcaggataaatttttgttatacaactaggacaataatttttaatatattttctgttcaggctttaatctgcaatatccacaaatgtgtaactgttctctttttatgggaaggaaatgtgaatagtttcttgtatgcgttatccctactccttcttcgtacaaatagatttaacatagtcaagaaaagaaagtagatagattttcttactcacatttcagatatgatattagataattcataacagtaaaaatgttaaatgatgtagttgtgcaggatttacttatgcacttgtatctagaaaatacatgtgaaacttaaaatatcaatagttccagttttatttaattattattattactattttgagacagagtctcgctctgtcacccaggttggagtgcaatggcatgatctcagctcactgcaacctctgcctcccaagttcaagagattctcatgcctcagcctccctagtagctgggattacatgcgtgcgccaccacacccagctaattttttgtatttttagtagagacagggtttcactgtgttagccaggat

SEQ ID NO: 97398 - DNA, 1096 bp, Homo sapiens
ctgtaagaatcatagaccttttttctccctttattgaataaggatgaagtcatagaggaaatgtcttcttttggttgattttttcctgaacattattgttctattgtattaatctgataatattggttttaaatgtaaaagatcaaaattgataaaaatatttcagcctcagttttcagcaaccttccacatacacagttcatatgagattttctattgtcctgttgtcttttaggttttttacttataaactactcttataattgtttttgtcttttctactaaaaataatttggtattcatgcattaactcaatctagagcaatgattttcccaaagaatttcatttcattctttctgtctctaaagaacaagaagggaaccaaaccacaatcagaagccagcatgaacaaaccttatttgtagagatgggttgaatttggttagatttatgtgtatatgtatatgtgtttatctttatatttttaattgtttaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaa

SEQ ID NO: 97399 - DNA, 1050 bp, Homo sapiens
gtaatcccaactactcaggagactgaagcaggagaatcgcttgaacccgggaggcagaggttgcagtgagctgagatcatgccacttcactccagcctgggcaacagagttagactctgtctcaaaaaaaaaaaaaataaaaaataaaaagaaatagctgcttttaccaaattctaggttcagagcatagaatgaataaatgattctaagcagaataagctattggagcactcaggcctcagagtaatgtgaatgattcatctcttcccctcacacctgcaattatttagctcaagatccaaattcaggtgacctagctaccacacttctggaaagcagcaactaagtttttcccggatgcctgaataaaacctttgccaaaaatttaaagaaatggccccaaaacaaaaccagaaaaaaccattacagcgaacaggccaatgatgagaagtaaacacagcaacacatgtcgggtcagttgctggtctccactctgtagatactgttcttcttcctgggctaatatgcagctctgggagttacagcgactcacacaatgattgtctataaaagagtaagcacaacaatttgtaatcagagctttttatctaaatgcattttaaatttgtaatgacttcctaagagaaacaacagaaaagcacattcagctaagaatcagtatattattttagatgaaattggaagaaagctccttcatgttgctttagaagaattctagctgaaatgtttttatctcaaaaaacataagtagaatacaatagttcccttttacactattcaacaatgttttatatatataattatctaacataagttatataatttggtctttaaaaattatacataatttgcctgggtgcggtggctcatgcctgtaatcccagcactttgggatgccgaggcaggcagattacttgagattaggagttcaagaccagcctggccaacacggtgaaacctcatccctactaaaaatacacaaattaactgggtgtggtggcgggcacccgtaattccagctacttggaa

SEQ ID NO: 97400 - DNA, 1050 bp, Homo sapiens
ctatgcacaattattccctattagcacttctttgctcttaattgaggatctatattcttgatgtttgtaacttctatagatattctatgtagagttcttttgagggataagaataaggaatcttctggccgggtgtggtagctcacgcctgtaatcccagcactttgggaggccgaggcaggcagatcacgaggtcaggagatcgagaccatcctggctaacacagtgaaactccgtctctactaaaaatacaaaaaattagctgggcatggtggtgggcgcctgtagtcccagctactcaggaggctgaggcaggagaatggcgtgaacctgggaggcacagcttgcagtgagccaagatagcgccactgcactccagcctgggtgacagagcaagactccgtctcaaaaaaaagaaaaaaaaaaaaaagaataaggaatcttctgtcccttaatcccatcctcatagtccagaggcacttacttttctcaaacgaaggaatcacaggctcactggtgcttgtgtttgctattggctctattgatgggcagtgtaattcaccatttcccatggagcaggagcagcaacctatatcaatcaaatagtatgtgagagtagagcccaaccacaacagaaatggacaattttaagaaatgccaaagaaaacaaaacaaaatccactcacacacacttcccatgtagcctcaatagttttcacatggtatctatccaaaagtattcaaatgttctcactcatatacaaaataaaaaaaacttaatctcatagaagcactgaatgtggccaggcatggtagcttacacctgttgcttcaggaggctgaggtggcaggatcacttaaggctaggattttgttttgttttgttctgtttttttgttttttgaggtggagtctcactctgttgcccaggctggagtgcagtggcgcaatctcggctcactgcaacctccgcctcctgggttcaagcgattgtcccgcctcagcttccgagtagctgggattacaggcacctgccaccaggcccagcta

SEQ ID NO: 97401 - DNA, 1147 bp, Homo sapiens
ggtagatggaaatgggccacagaatgacccaggaggaaaagtctctcattttgtcagctgtttaggcatctgcatacccacccttgatgtggaggttctgaactaattctgtccctcataatccatacttacaatcccacatgcccactgcttccgcagtaatccctgcctagagggaaggtgcttatatttcccctagaggtaagttttagcagtgggacattagcaatgaaagtagattcagcccagtgggattctaaataagttttaaattttggagctttcaggtacagagagaaaggtagtatttgttgctttacccaattttgtaagctataaatagctcaaaaagaaaaaggggtttttcgtggttttcccatccactgcagtgttggaccataatcatggtggacatgatggagttgcccaggttgcgcatcaacgctggcacgctagctcagttcatcgataagcctgtctgcttcgtagggaggctggaaaagattcatcccactggaaaaatgtttgttcttttagatggagaaggaaaaaatggaaccatcaaactgatggaaccccttgatgaagaaatctctggaattatggaagtggttggaagagtaaccgctaaggccaccatcatgtgtaaacttatgtccagtttaaagaggtaaccatccttttgatcttggactttacaatgaagctgtgaaaattatccatgagtttcctcagttttatcctttagggattgtgcatcataattgatcttgatggattttcatatgattgcaaatgagctatattaaagactattaaaggaagcccctcttgtttgagggagagatttctgtgctttctcatatttaatttgctctttttaaggtattccagcctagagtttttgatggaactgatatattgacaggtctcacctaagtccttttataaagaattgctactccaatttatggtcagattatatgcaagaacaaagcagttgtctgagtttaggtttctattttattaataaaaactaaaatggtaaagaaaagaaaagaaaagaaaaagcggtttttgtttgtctgttttttctactgtggaaaacaaaacaaaaggacataagccctgcctggctctgacaatg

SEQ ID NO: 97402 - DNA, 1083 bp, Homo sapiens
ccatcctggttaacacggtgaaaccccatctctactaaaaatacaaaaaaaaatagccaggcatggtggcaggtgcctgtagtcccagctactcgggaggctgaggcaggagaatggcgtgaacccaggaggcggagcctgcagtgagccgagattgcaccactgcactccagcctgggtgacagagcgagactccctcttaagaaaaaaaaaaaaaaaaaacatgaagagatgatcctaaattatccaggtgggcccacccatatgattccttaaaaacagagactctttcccagctatggccagaggaagagatgactgtgaaagaagggtcagagaggtgcgacactgctggctttgaaggtggaagaagagggccaggagctaagaaacatgggtggacactagcagccagaaaagcctcccctagagtctccaggaagggatgtaccctgtggcctgagggcaccttggttgtagccctgagggacctatggcagacttctgacctacagaacaataaaatagcaaatctgtgttgttttaagccaccaagtttgtggtaatttattatggcggtgatagaaaaccaatacaccacacatgggcaggacttccctgccatgatgctgaagaaaggcaggtttcacactggtggcggaccctgcgcattttttggttgtagggctgcttggcctcctcctaacacttcctcttgtgcatgcgcctcccaagccccacttggcaccccaacaacactccccaggccagacactactgatgttttctttcagccagcttaggagtgggggaaggccatgggccccatgtgctggctacagctctttaataaattatactgttggttggtccagagccttcttctggattcttgattattgtaattgtccttctgagtttggaatctgtctggatttgttatctttccattattttaattatttatttggttcattttttgcagccaattttgttcttttttttttccccctcaatccctgggagctcagaacatgcagccaattttggatgtgtgaggttttcttttcccactcttgtcaa

SEQ ID NO: 97403 - DNA, 1034 bp, Homo sapiens
ttctaccaatgccatcttgttcttgtcctctcataatgaataggcatctcaccagaactctcgcccacttcatcctggctcttgcctatacataatgctaagagatatttgcagaatccttttgaaagctcataggctgtagaagttgggactcgcaggtaaatagagctatggtcgattttctgctcccaagaaggaccaacaaaacccaatttatataaataatagtttcctgtattttatagccctctgaggaagggacttccagtcactgggaacagactctagctctctgatttcttcagggttcctgatttcctaactgatgtttgttttcctgttcttcagattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgtta

SEQ ID NO: 97404 - DNA, 1049 bp, Homo sapiens
ggtggcggaggcggtggaagttttggagggggcggacctccaggtctgggaggattgttccaggctggaatgccgaagctgagatccacggccaacagggataatggtaaggagagtttccctgtctctgagtgactgaagacaaggcagagtttggcagtttggaggctggtcatagcctctaaggctcttcgcccttattaaaatattgtacattgttttaaatattaccactgttttataagagactcaatttaggctttattattattattaaccaggatcagacagctacacagaactatgaaattttcacccagtgtctttgggggtaacctgtacatttttttttttttacttttctaaagggttagctggagtgggaagaaaagggaggagcaaatagaacttgctggccctggaaatctgcctggtgacctgacagattcagctttctttgtgaggtagcccagctgtctagtagagtaaatacttgtgagccgcttttcaaacacgatggagcacatcttgtggaatatgattacaaatctcactaaatctgaaaaagtgttttgcatgacagatatttggtatttcagtgccagtggttctcaggagtctctgcagggagccatggacatgagtccttcaggattgtctatgaacctgatggtagaaaaaaactgaacttgctcatgaatgcctagataaaaaactttgcagagggcatgaggctctctcccagctactacagaaactcaagaaattttaccataaaactgcttttgtaatgttgatcatgttataataattttcatttttagaccttttataagatgtcccctgggaaagaatgaaactctcacatttacatgaatatggaatcactgaatcctcagggttagcctactattttatcactgaatggtccaaatctagagagaaactcagtcacatgagaggttctatcttgccagaccaccatttaaatttgaatttaaatttatttaaaactcaccaaaaggatttaaggcagctgataaatgtat

SEQ ID NO: 97405 - DNA, 1009 bp, Homo sapiens
aggatcagagttaggtggactactggtttgggaggaaaaaggaaaagtgaaagacctagataaggcctttgaatgttgttctgttaccgggcaaagtgctgcgagtgagaatgcactgctttcaaaaaggaactatggccgggcgcagtggctcgcacctgtaattccagcacttttagaggctgaggcgggtggatcacttgaggccaggagttcaagaccagccttgacaacattgtaaaaccccatctctactaaaaatacaaaaattagccaggtgtggtggcacatgcctgtagtcccagctactcgggaggctgaggcacaagaatcacttgaaccaaggaggtggaagttacggtgagctgagattgtgccactgcactccagcctgggcaacagagcaagactctgtctcaaaaaaaaaaaaggaactaaggtatttaactcttgacacagtctgacttgtaagtcaaaatgcccacaaaacgaatgtggttataatatattccctctaatccctcagccctccaagccctccaatagccatctgaatcatggtccctggtatgaggccagaggagctgacctctaggacagaggcctgtggttctcctcactgcaagagggagcctagggctctgttgaaggaggctggacagtctagacctattcctgaatccactagtggaaaccttgaagaattgtattcttcaatgtccacttctcttatttaatggaaatagtgttagtccttctctcttccatgatgtttaataatgtgctttccttgatggaaggaagatacagtccagtgcaggcccttgtccacacactcaactggacacctatactgctgtcacaagctctttgcaagcagcagtgtttatccacagttttgtatctgtttgcatgtgaaacttccctgggctgtatgtcaaaatgttgaccatggttatgtgtgataactcagccctgtcctacagtttaattactgaaaaaataatct

SEQ ID NO: 97406 - DNA, 1042 bp, Homo sapiens
ccaaagtgctgggattacaggcatacaagttattttaaataatttaatggcataactagtatatgtagtagagaatggagaggtggtaaatgaaaaggctactgaaagattctaactaagcaaagtaagacagcttggtagagagaaagatgaaagactggggaaagaataggacaggacagtgagaaaggaagatgagaaactgggaaaaggttttgaggttgatctgtgtggaaatcatactcttacaattcacttggactacagtgctatgtgttaactttatcaagctttgttcttctgtactggaatatcatcatgtcaaaactcttccttttatcagtctaaggtcattaaatgacttacctgaaagtcatttttcactaagtcaggttttctattgctctttgaaaagtttattcatgggctatttgctcatagcgcttcagctactctaatatctaaccttttaagggttacacatactctgggtggactgaaatattcagagaactccctgtggtgaaaattagttcctgggatcgagcagcaacttcagatctgatcaaattctaaatctggcctgtaggctggaagttccccagcctacctaaaatatgagatgaagtgatactgaattcctggaccctttaagtgttatgaccttttgaagccttcttaacattttatgaacacacatcatttactttggaagtttctggctgtttaaattatgatatatttctgctttaaggtttgactcattttgtccaaattgttaaacatgtgcttgttgttgaagaaagcatttctcctggacttccataaatacctctgtctgtcctgaaaattaaaactgtaaaaaaatactagaataaggaatgccttaatcagtatgcttttctgagaaatttgaaatgcactttatacacatctcccttcaccattcacttgtaatatggaagtttgcatgggtgtacacacataggctgatttaaatcagctcatggtttctctttctcgtggttaaatagggggaaag

SEQ ID NO: 97407 - DNA, 1037 bp, Homo sapiens
gttcttttgttggttggacttttatttttacttttttattgccactaataatgggtgttcagattttgagagtttactccttttctgggaagaaccacttgttctttgaccattgtaggggagccctcattctatccagtttctccaagagcaaaagaaattattttgagaagtaaaaggtaacttctgtaactctgtaagttacctctacaagtctgagcatttttacactagattaagcaaacctctttaacagcctctagtggataaggaagggaatgagccacaagtcttttttttttaatgctttttgttatggaaacattttaaatatatatgaaaagtagacagaactgtgtaacaaactgctgtgtactcctcacccagcttcaagaatggctatttcatgatcaattttgtttcatttgtacccctacccactttccctccttttctatattactttggaaacaagcccaggcatcatatttcatccacaaatatttcagtatatatctctaaaagttagggattctttgtaaaatacaatataaccacagtaacattatcacacctaacaattatcaatatcttaatatcattaaatatctgaacaatatccaaatttccaattgcctcatttttgttttttagtttatttgactcaggatccaagtaacatctacacgttgccttttgtttgtttgtttgtttgacacagagtcttgctctgtcgcccaggctggaatgcagtggcgtaatctcggctcactgtaacctccgccttccgggttcaagcaattctcctgccttagcctcctgagtagctgggattacaggtgcgcaccaccccaccacgcccagctaatttttgtatttttggtagggacagggtttcaccatgttggtcagattggtctcgaactcctgatattgtgatccgcctgcctctgcctcccaaagtgctgggattacaggcgcgagcccctgcgctggcccacatgttgcttttgattgctgtacctcttgagtctcag

SEQ ID NO: 97408 - DNA, 1066 bp, Homo sapiens
tctgaaaatgagttttagataaatgacataaatggagactcaaatgattagcacctacttttttcaaatatcaaagagtaaattatttattcttttttgtttaaaattttaaaaaataacccataactcagcattataaaagtcttcattcttacattgcattgaattatccctctgtaaacaaaaggagccactttaccagctgtgttcccatgtttgccttcttacttatcaatcttgccctccctgcccaacctacccttgtttcctcttttaccaagtagcacgaactggggagaagttctgctcacttaataatcgtaatagtagctaatgttgttgagtgtttagtatgtaccaggcacttcatctcaaagcatctgcctgtctaatttagaaatatcaaatatctcctaagtgcaggatgaagaactgtgcaaagtgaggaacatcctgtcacaggtcttcacttgggaagagccaggtggaaaggagatcagttgtccttctagcccaggacaactggaaattacagcccaccaagtagactgctagagttgctttgaatgacctgtgctcaaaagaggtttttatcatcaagtttgcaatcataaaaaaattctaaactagattctaccttttctaaaatatttgcataatggctaatgaaaatggtaaaaatgagagaagcttgagtattcattaggtcagcctaaattacaccttgatttctgggaactttggtcttgtgaacactaaaataaggtgactcagggtcacaactgctgttttctgtaccttagactttagaagtttacacgtctgcatgtgcataacataaaccaaggcattcctgcttttgcctttgaggcaggaagagctatggtaagatgtgcctagaggtcctaccctctcctcccagcatgggatagaaacatttcttacagtggtaaaaattctcatagactgcacaaaattagccacagctaataaaataaaggtagtccttggtttatgaacatttggtttataaacacacagaaacggtcactgccttccacccagt

SEQ ID NO: 97409 - DNA, 1045 bp, Homo sapiens
ttaaaataaccctgctgaagtggcaagatgacctttgtcatttcccacctagcataccaattcgattccttttcaaagccttattagttaccgttaaaatccacaaaggaaattgtgtgactaagaactgtggaaatgaaaggaaacctcaaaggcctttattgaacctctgcctttccagaccacaccctttccacctctgcatcaggtcacattgcagtttgtctactttctgatatctttattcacttctttccattcatggactggccaagaaaatacaatacgatatttaaactacacagagagatgctgagggcctcctaataatttactatggctgggtgagacctttgggaaatgctaatggagaacatcaccaccacagggtgcgcgttccaaccaaccgcacttccttcttgctctgatgctgccatggactcaacttttcaccactccctgtgtccacaaggtgatcagaacaatgacatttcactccctggaagtcaatccattgctacttgaagaccacaccagcacttgagtcatgactgatagaaattaccatttgctccgatgcctatagctcagtattaagcagacagcaggtagatgaacatgtacgaggggtctgtgctcacaggctttgtaacatcatcattctttctgggctgtctctcttttccagatgcctatgatttggtatttctcctggccagagagtagcactggaaacattgaacacaaagtattctaacccttattgctcaatgtgtttttccagagcagcccaaaaggttatgctgggtttcatgagctgcagaggatgactgactggtgccacctagaaagacaaacagcagaaactgcagagcttggactgagctcagacaaaaatctctgctgcttgtacccagcttgaatattatggccaacacttgaagaatagaaagcatcacttaaaacattttaattatccccacatgtaacatgggccctaaatgttctgaactgaaaacctcactatgtagttgaaggtcaatga

SEQ ID NO: 97410 - DNA, 1041 bp, Homo sapiens
gaggattgcttgagccaggagttcgagaccagcctgggcaacgtaggaagaccccatctctacaaaaaattaaaaattagccaggtttggtggcattcacctgtggttccagctaatcaggaggctgaggcagggggatcacttgagcccagcaggtcaaggtcaaggctgcagtgagccatgatcacaccactgcactccagcctgggtaacagaggaagactgtctcaaaaaaaaaaaagaaagagaaagaaagagagaaggagggagggaaggaaggaaggaagggaggaaggaagggagggaaaaagagagaaagaaagagaaaggaagaaagaaaggaaagaaagagaaaggaaagaaagaaggaaagaagaaaagaaaaagaaaagaaaatcataagacctttttttggacactggatgttttcaaagttttttctctttgtttttcttgtttggcattttcccttaattcagatttatttattaagtatcttccatgtggatcttatattcaagttaaaagatgtggacaaaaaacaataaatctaaaaaatactaggtgatgtatattaggaatttagaagggatacatgctgtggagaaagaagtctagcggggctaggaggagcagagcacagtggtggaggatgggtgtaggtgagctggtaagggcagctgtcatggagaaaatggtgagataattcaccatgtagccacatggggaaagcctgaggacgcagaagcggaacatgcctggagtattcaaggagtaacatggagccagtaatttggaggtgagatcctggagggccatgttggtcatggtaggactctggctttccccccagagtctgggagtgaggggaggattttgatccaaaaagagacaatgatctgactttaaatttaacagctccctttggccactgtattgagaatagactgtgggagcacaagagtggaagagaaggaccagttaggaggctattgaaatactccagtgagacatgctggtgccatggacaagggttagcag

SEQ ID NO: 97411 - DNA, 1042 bp, Homo sapiens
caagattattcttcctgaggccaatgagggacagtttaattacgcagtggcctgctgctttcagacctgtatgtggaaaaagaaaacgtctcaaatccaagttaagagaaggaagttcctacattattggactgctgtgcagctctaggacaggttagccagagaggctgctgaactctttctgggtgtttttgggaaacatactagacggcatctttgactgtgttattgtgttaactgagacagggaggataaggaggagaggagagcaagatcaggaacttcctgtttcatgtcttcattctagcccaaagtgttgtaaaatgtgtctgtatgataaacaacgaaggggtgaggggctcgtggactcaacttgtttatatcctagtaatgccaaataactagaacagtgatgaaagagaaaaatcatggttgattctgtcctccaattgccacatttttttcatattttaccaccaagttgtacaagaaaatggagacaaagctgacagagaataagagaagattctaagctggacatatcagccctagtggtttcagaaaccccgtgctagctctgacagagccagcccacattgttatcaggtttggagggatggagggaagattggatttatcactggttggagccctttgcacaaatgcctgtaggagacacgcacttgggaactgcagtaggaaggcctcttgtacctggtactgcccttgagccccaggaagaggcttacaacttagcagtggctggacatccctcgaaggagctcttctttcagttttgttttgctttgttagttggctatacagccttgctgtttcagaagttttatattctgcaaatctgctgctcacagtagaaagggactttttatctttttattttgttagaatactttccagatgggcctgatgtctttttttttttttttttttttttttttgagatggagttttgctcttgtcgcctaggttgaagtgcagtggcaccgtctcggctcactgcaacccctgccttctgagttca

SEQ ID NO: 97412 - DNA, 1046 bp, Homo sapiens
gcatgagccactgcacctggcccaaaatatttttaagagagaaaatttaagaggctacaagtggtatgggttagagtttaaacaacagcaaaagaagcatgctcagagtagagccccattcctccacttgaatgacagacatgaagtgggacggtgtctgcatgcagtatctacaaatgagcctctctgagcagagtccattgtagaaagacacattgtctaaaccagggttctgaaaccttttttggttatgacctacagtaagaaatacatttttcattgagacccagtgtatacaggatagataaacagaaacaaaaacaaaagttttataaaacaatttccatgtttaccaaatgcaacacatttccttttctattaagaagaaaaagccggttgcaacccactaaagtgatttgatggccaaagaataggtagcaatttgcattttgaaaaatacttatttaaatagaaatttgtcagacatgtagaaaccagtcacattgtagctctggcagatttctgcaggagatccagtgacacatttcatggtcctagaaatggttttccttactctttgaatctttcacggttgatgaggtggtgttggtgatgaaggccaaggaagagagtggagaagatggtgatggaggagttaggaggccaagtcttaattctgctcaggcagaaaacagttgagtgtctgtgatgcattgtccagacacgaatgagacacagaccctggtctatggcggcttatagtcgaggtgtttgcttcgtagtaaaacaggagcaaaaaaccagaatgatgcaggtaacctgaggccccttcattctgagttctctgaaaggagaaaccatattatagggatgtatgcagcgttataccctcggtctgcctctcctctgtctcctctgtaataagtattcaataaatctgtattgaaagacagtgttacctgagaatacttgtacttgcaactagactggtaatcaatttctatagtggtattgttaatataatattattaatgttaataaaacat

SEQ ID NO: 97413 - DNA, 1781 bp, Homo sapiens
tataataaagcatcatagacattctctccagaataaaaaactcacttatggcatggctgcttaatattccacaatttaactgttcatattgtgtcaagttttcttctactacaaccattcttcctggaacatctgtgtgtgtgtgtgtgtgtgtgtgtgtgtgtgtgtgtgtgtgtgtatttgaacctgccaacttacagaagcttttttatttctgtctgtcagagtctctaaaggagtattactttccaaaagctgtagtaattcacagtctcactgacactatttgaaaatatctgtttccccatatctttgccagcataattcattttagaagtataaactttatgatctcttttttcctgttttgtttcaagttttctttagggagcacttgtcactgtctctacattaaaaaaattcacttatttgatttattcttacctgtcttttgcttaattttgtaatttcttaatcataatacatatgatttgtcttctagaactgaaaaagaaaagttcatggctggacttacagagcttaattgttctgtattgaaataaaacaaaacacttgatttctgtttatagtaaagtaaatgtagacctttcaattccaattttcctcttctaaaagtgcattatttaagaaattgtctcaggaaatataaatgttttaatgggaaaaacagaaacttacaaaatacaaagatgggaaattttaaaggagctttaagactgcaaagctgagtttctctcttgaatccaaaaatctgaagacaaaggttctttgagagcattagttataaattgtgctgaattacataaagaggaaaaagtgaatcatagcagataggaatttaaacctggactgttgttgaaagtccttgcgctcattgctcctgcttatttttctgggaggtgagtttagattctgcttctcatgtccttgccgttgctgagttcattataaaattatttatataaagctccagcagtacattggttaatcagaaacagctgcacaactggattcatttataggaacggaataactaaatcaatcagcaaaatttcttgtatttgggtaggttgggccaacattgtgcagcccagaataataatgctttgtaactaacctgacacagatgtcaaaaagattgcatttgggcaacagaagttggaactgaaaattaagaaaccctgtgaatgcttgatgtctgccataataaaagtgttactctttttttttttttttaatattagtgttttcaaagttaggaagattcacaaaaggaagtcctgttttaaaaagaatgtatcagagttttaccctctatgggctgggtcccttgaatgagggtgaattgtccagatcagtgtcccctgaaagataagtgcgtacattctgccaaacgtccaggatagaaacaagccaagggccccatgctgggaagaacgccacagaccaggcaggcaaatggatgtccctgactagcgggagctgcgctgaatcagggagaagacagaagttcccaagcaagactgaggctgaagttccgacacagcatggtcaaaggagttcctcgagatgatgtgtccttatgcagaacccagaggtccatgggggctgaatgagtttatggaatgaagccctgttgtatagctctaagcaggcagtgttgcggagacttcagtacaatgcgacaggaggtctgatgagaaaaggaaaatctctagaccctgagtccccatatgggacccaatcctaagggaccctga

SEQ ID NO: 97414 - DNA, 1908 bp, Homo sapiens
cctatcaggaaagatggtagagcactctgagcaggtcggagaaagcagcatgggacaaggaactcaccctggagtgggggtgtgggagagggccaggcaggaacttcaaggacaggcaaagcaatctgcacagaatcctatcaatactgcagggccacagaagtgatacgagtaagagaaagggaccaattgaggaacagaaagaaagaaaatctaaaaaactgacgataccaagcattggtgaaaatgtggagcaactggaactctcattcatatgttgctggataagaatgtgaaattgtacagccactgatgttggctgtatgacccggcaattccaaacctaagtatctgccccaaagcaacaaacacacatgcccacacacaaatgtgtatgcatatatttataccaacattttcttttttttttttttatagtttaatgtattttaatagcaaacttacaggaacagcacagaagacagacaacattaaaaacatgtacttgcatgtaggacaactcagttagaaaagtatagtgaatggatggaatctactgtatgataaaaatgctacaaacaccatttagttgccatcaataagaaatttacttgttttaaaaaaatccaaatgctggcattgtccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaaatatctaacgttcagaactaccaataacaggaagaagagaaattttttttttttttttgagaatgaaatgtttcccatcatagtggattcttaagcacgttctccacgtatgcggcgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtcctgagcaatttctcgcaccagacgctggaagggaagtttgcgaatcagaagttcagtggacttctgataacgtctaatttcacggagcgccacagtaccaggcctgtaacgatgaggtttcttcacccctccagtagagggcgcactcttgcgagcggcttttgtagccagttgcttcctgggtgctttaccaccggtcgatttgcgggcagtctgctttgtacgagccatggtacagagacctccttacttaccccccttctccttcggctggagctcggcgagcgagaggcggcgctggcgttggagagcgacggcggcgcggcggcggctgcgaacctataccaacattttctactagtaaaaaaaaaaatcagaagcaacccaaatggctaccacaagtaaaatgacccatgtggaaatgtattgtctgaaactctacatcacgggctcttgtccctgtggcgtctgtggatgcaaaatattaagtttggtgcatttttctggggaacaaggagctttttgagtctcaaagagtatggtggtcagttttatgtgtcaatttgatgaggctctattgcctaattattcaactaaacattagtctcagagtggctatggagctcttttgtagatgaggttaatacctatagttagttgactttaagtaagtaaaggagattactcttgatggtgtgagtgagactcatctaaccagctgaaggctctaagagcaaaaactgacgtttcctgatagaggaattctgcttcaa

SEQ ID NO: 97415 - DNA, 1050 bp, Homo sapiens
cctctatcaggaaacgtcagtttttgctcttagagccttcagctggttagatgagtctcactcacaccatcaagagtaatctcctttacttacttaaagtcaactaactataggtattaacctcatctacaaaagagctccatagccactctgagactaatgtttagttgaataattaggcaatagagcctcatcaaattgacacataaaactgaccaccatactctttgagactcaaaaagctccttgttccccagaaaaatgcaccaaacttaatattttgcatccacagacgccacagggacaagagcccgtgatgtagagtttcagacaatacatttccacatgggtcattttacttgtggtagccatttgggttgcttctgatttttttttttactagtagaaaatgttggtataggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaa

SEQ ID NO: 97416 - DNA, 1032 bp, Homo sapiens
gtaatgtgaattcagtattttggtgaatctttttctaacacaagtgcatgtacgtgtaatgtttttgtgacatgcaataaccatttctatactgtatggtgacttcagttttccagtcgttgaggtccttcctgtcctagtttttaatggctatatgatgttatttgctaccttttgttatttgacatgtgtctgtagatctctaatttctcttggttgattattaatataaatccgtctttttcctggaaagctctaaggcaccaaggccaggggttgtgagttgtgtagtgtgggttgcccagtctgcaagagggaagagcttgggtccgtcctgtggttccccgctaattctaggagtgtcctgcacatgtggtcacttgattttcttttctccatgcactattgatttaacccagaatcattgtttcctatgttgtcctcatctaacttatgaaagagcatcctcctttgttatgtttttattttccttctgcttcagtattgtgtctttcacctttagaataggattctaagaaaaagagaggaaaatttagcaatgatgtgtcatagaaaacttagtgttgtttacataattcttgacatgtggtaactgctgcttgtgaactgcaccctcccaaacacacatatacacacacagcctgggcaacatagtgagacaccatcactacacaaaatttttcaaaatattagccaggcatggtggcatgcacctgaatttgattgagaattacctgtgaagtccatttctcctaagtttcctaatggctgtatgatgctatttgctaccttttgttattggacatctttttcctgagcagctgaaatcacctttgcaaaaactatcatagcaagggaaatctgacattcccagctactcaggaggctgaggattgctttagccacgagtttgagcctgcagtgagctgtgattgcaccactgcactccagcctgggtgacagagcaagaccctgtcataaaaaaatgaaaaaaaacaaaacacatacacg

SEQ ID NO: 97417 - DNA, 1063 bp, Homo sapiens
cctcctcctcttgcccttggacatcagaactccaggctctctggcttttggactccaggacttagactgatgttccctctgggttcttgggccttcagccttggactgagaattataccatgggcttttttggttctgaagccttcagatttggactgagccatgctactggaatcccagcttgcagacaacctgttgtgggacttctcagcctcatagatatatttatgatttctcatatatattatttcttttcatcttgtaaattgtaatccataatatagtttacccaacaactagaaactgtgatacacacacatatcttattggttgtgtgtttctggagaaccctgacaaatacagttgggttatggtgatttggaggccatcaactaagcctggcccgtagctgcacagtttctagttcttgggcaaactatactgtggattaaagtttacaatgtgaaaagaaatcaatttctcttctacttacttcttcagaattttagaaatggtgatgatgcgtaatacatttctggtttcatttataggacttgaacctcaaacatgattggaataagggctggtggtgggtggaaggcacaaattttaattgggaagacagaaagatggttttttgctaagactgaaattcttgacaacactgagcagagttacaggatggcctagatggagccaggggtggctgggagagccagtgaacagatgaactgacccagcctggagttgctttggaatctcaaagtctggattcaaatcccagttcttctagtttgagcaaagaacttaacctccctgaaattcaattttctcatttggaaaatagggacattacaggatttccctgaaatttaattttctcatttgtaaaatagggacattctaggattttatgaaggggatgatgatgaagtaaacccatacaggcaagacaatttccgtagtgcctaggccctattgtttggacttgtttcctttcagacccttatcaagcccaggtgccatatgagactggtaaaccttctctgacttctcaggtcta

SEQ ID NO: 97418 - DNA, 1071 bp, Homo sapiens
cagatagatataaacatgagcagcaccattttaagagggccctggatattcctacttttggaggtccaattccgctttatatcaaatatacttaaaatgcaattataccccacattaaataaacattttatgtaactttaaagaaatgggttttttttttggctatttgacatattttgtggacattgaattaaaaacattaattttgatttttttgttgtattctcctgagatcatacagcaattaaacgatgaagcgtgagctagaattctggtctcctggcttataatcaaattgttccaagagaaaagatgaaaattattgtttttccaccaagaaagaactgctggagtctagtccactttaaaacctaattcaagctggagtgccttttgctaaaattaacactccagaatgctcaaaactctgaaaataatattgaatgtttcctttctttattcttttcttagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtgagccatttgcagtgcgggttgcagtggtctccgttcactaccagtaccaatcctgatgccttttgggtacctcattgcacaatacggttgtcttctgtaatttggaggggaatggtttcatatgtcaaatgatctcaaagactgaaatgaattaatttaacaattaaatagcttgatttcaaggtacatttaactaagtgtagccaatgtgcttgtataaaaatatatttatagatgatgcttccagtctgcaaaagttgacaggtaaagacaaattcatttttcagtttttaaatttttctttggttcaaaaagcaaaagtataaatgctctactaaaactatctataaagccaaaaacagagctgcatcctaattattctttcccacttgagaaaaacaggcctatattttatcttagtct

SEQ ID NO: 97419 - DNA, 1049 bp, Homo sapiens
agtcttctcatccgtgtgtttcccctttcctgactttgcccctctttttttttttcaggtgcatacattcagagggccacactggtgtgaatactgtgccaactttatgtggggtctcattgctcagggagtgaaatgtgcaggtaagagctcttgtcttgtctctggattgagtcagttgtgaagttataagaggtgaggtagaaggagacttgttgttatgcatatccagtaggctggatcctggtttggtcttatgcacatgcagtaggccagattctcaggcagccactttggaaatttgatattttatctgctcttaaccttctggcacttgatggacagcacactagggatctggcattagtccactgaaaagagagaagtcagcttgttcaaaaagtctgataaaaggagataaaagtaaggcagttatatttaatacttgcctttgatgttgcagtaactaaatttataaaaatgatttttttaaagcaatgtacagggacctatgattgttgccttggaaactgaattttaaagataacttgttaagctggattgtccttactaaatttttgtgaaatcaaattgaagctttaaaaatctgtgaattcatcttcaaagatggttaccaaattctgaaaaaccacttagtcactaatattttctgtgtgatgttttgaaatcaaatacatcaaatactttttgtaaaatatgaccatgaatatttagatacaaatttagaaaccaaaagatttacacatacagaaatagccaacacaaggatgtatttgagatactttgtgaaataaagtacttatgtatatcacgtgaaatccatttgtatagagcaactatactgaatactggccatttatccaaactactttaaattctttttttttttttctgagacagagtctcactctgtctcccaggctggagtgcagtagcgcgatctcggctcactgcaagctccgcctcccaggttcaggccattctcctgcctcagcctcccgagtagctgggactacaggtgcccgcca

SEQ ID NO: 97420 - DNA, 1050 bp, Homo sapiens
gatcatagccagtgttatgtattctcttttcacggcataataatataaatcaaagtactttaaactgaagtggtaaaattagggtatgatttttttattttttatttttttttgagacagagtcttgctctgtagcccaggctggagtgcagtggcacgatctcggctcactgcaagctccgcctcctgggttcatgccattctcctgcctcagcctcccgagtagctgggactacaggtgcccgccaccacacctggctattcttttgtatttttagtagagatggggtttcaccgttgttagccaagatagtctcgatctcttgacctcgtgagccaccgcgcccggccaaattagggtttgatttctaaattccatatcatatggaccaaaaagtttaagaccatcttggtgagacaaacattggtcacctaaaagagtgcattctagttaccctaaacataaaaatgagggaagaaaaaactttcctgaccagctgcctgcctacctacattcctttcgttttgattttgttcatctgttctctcccctcatcacccaacactgtgctggagaactgactcatcacagtcccaaatgagaagctgcagctgaaatgtcattgccaccttcccaagcaaaattttatttcccgtaatgttcatatcatctccaacgtggcttacatttgcagcaagctttgcaggcatgctccttggctatttgcattcatgcttatttctaaagggaatgttttgacttgaaaggaacaatgaagattaatggtgaatttttctttatcttcctatatcatggatttctttttcagtttctgttactggctttcaaactggagatatgaatgctgtaaacatgatgagaagcagggtgtttgtttccttttataagccaggattttagtctgaataatggcaggcccaactgagaatgacttcagtttttatctaagtcattgcccaggagacacatgacacttggcctgtgccatatgggcccctcaatagcccaccctttcccaccctgtcctt

SEQ ID NO: 97421 - DNA, 1073 bp, Homo sapiens
tctgtcactcagctatggaatgtaagtggtttttattgcacaaccatttacttatttattttcctattgtacctacataatataaccttaggggactggtatttcaaagtgttgatttttactaatatttgaatacgaactcattcatctcagtaatgaagcttactttctaagtagaagtgttttaggtgatggcatttaacatttttgaaccttgagcatgattcagtttggaggcaaaactatcaggggaaaagaaatcaaaaagaaattgtcttctgaaacttaaaagaagcctaaacattaaaattatatattttataatactctaaatactcatattttgaaatggaaaatgtctttgaattaatggttatatttattgtttcatcattattatacaatctgtaccttgtagcatataataatcaaaggattgctttgagaactttgatatttccacatccagattcttgggtttcagattgatggttctgtgtaaggggccactatttcagctcagcacagaacatcaacaccagaaattgtgtttgtgttctagcattaatatggttgtttatgattctaagcaagttctgtgcaacctttgcattcattttgtaattttagatatacttctccctcaaaaacatagcggtgattgggaatgtatggatcataaaggaaaccataaaagaatttaagctctgttaataaggccaatattgaattgtggtaaatgtatttttatgagaataatttattttttctgcacatatttaaaatattgttttgtataccaattaacataaaccatttttataatattcatatgggagcagaactaaattactgtattgccctggtgactgtcctaatagtcatattgttatagtatgatcatattttaccagcttttccctgtagttattgctcacagttaaagttacatcatttatttgtggtatggtcaatgtatgtctagtaggcttttatggtatttctctcaattttgaacagttttcttactcttaaaattaggtcaccaattttctgtcatttgtcattctctt

SEQ ID NO: 97422 - DNA, 1080 bp, Homo sapiens
tttctcacctgggtggatatagtgtagtgtttatgagcccagcccccccacctactagctgtgcaactttgggaagtaaactgtaggcctcagccctctcaactataaaattaagataatttatgcctcatagggtttatctgtggattcagtgggattctatgtataaagtgcttagttgggtgtctggaatatatgtactcaataactaataagtgataaccgtaattaatagattctatatatgagtagatggctatctactagatattgtaagcatgagtgatacacatttgtctagaatgtcagactattgattatattggttctgaattttagagttatcaatttttgttatttacaagttcttcaccaaaattaatgcagaagtgcagttactgccatgttgaaggcataatagtgaccaaacccttagccatttgagagtagccaacgctgttttcatcctaagctgttgttttctatctccttactgccctaggtagctgctcagattgcagttaatccagaatttcttgactaaatagaacattactcaggaaatacagtacaatctgcagagtctacagtagaccttacctctgaatgacaaaatgtttacttttacctagctataaattttctgggtaactatcatgaatatttttatgcttgaattttagtaactatagctgtagaaccaggaatgatctataaaataggatgttgatcaaaaatactcaagaaaaagatgctactttggttacatgtgtgattgttttaacttagtaacttgatatcaaatattgttgaagaaaaaattttactgttcaacttgtgtttggagctgtttttttctggttcctactgagaattggttaaacttcactttaggctgtacatgtctaaagagtcggttggccgttatatttttagtcatcatgtgacaaaataggtccaatctgaaaagcaatttaggctaggcaaggagactttttccattgcatttcttcttgcagtgggagcattttatgtctcatattaattatctaagtatataaactcatgaaattgaaactc

SEQ ID NO: 97423 - DNA, 1036 bp, Homo sapiens
tgaaaaacttttatatttaactttggtgtagaaatttcacctgtctaattttttaggctttataatgaaaatatacttgggagaaatgtgtctttaacattagaggaaaatggagaacaagaaagtgtaattatatggatagttcacttaagtgtaaatcaaaatttgattgttactaaaggatggataaattatgctttagaagggccaacatggatagtacgttggattctagattaaattgttattaaagtctaatttgaactacagaaacagacatcgtctggctattattttaaaaaatattttatttcctttccatactttatttccacattaagatgttcctaactcctattcatttggaatataacctataccagaacaattttgttatataacaagtttatagtcccatttaacgctttacttaaacagcgtttattttagtattttagttcatccctgttctgttgtacttttaacaatgaaattaaatatatcctttgtgacttgtttagtttttaattagtctcactcggggttaccttcaggagaccattacactggcagctcttgttgccttgttgccttttgacatctgctttcattaaagtcagtgcattttcttgcctgtgtcttcctgcaaggacactgatgttaatcatgccaaattggatccatttctgaggtctgctgcaggaagcaaaatactgaaattatcataaaagtaaaccattattcttcagttgttagagcacatcatcagaacataaaattgaaaacagaatttctatagtccaatagcttatgacttttgtgccgtatgtatttcaaacatttcttgcacagacctaaccagcagacagaataatgactctttaaaaacgaaagaataagtccttggcctgtggccagaagtagcgaaagtgtgtttctgtgccatcctgccctgcatggctcaggtttctggagtcagctctactttaagtgattgctggcatcatattctggttagccctaaatggagctttcc

SEQ ID NO: 97424 - DNA, 1041 bp, Homo sapiens
gtcaggagatcgagaccatcctggttaacatggtgaaaccccgtctctactaaaaaaatacaaaaaaattaggcaggcatggtggcgggtgcctgtagctcccagctactcgggaggctgaggcaggagaatggcgtgaacctgggaggcggagcttgcagtgagctgagattgcaccactgcaccccagcctgggcgacagagcgagactacgtctaaaaaaaaaaaaaaaaaaaaagaagttagactttctggattgattctctatcttaattattttctctccttttttttatctttttgtctttttgttctttaaaattttctcaacttttttaaaaaaactttcatttatgctatattcctttttctacttatttttctatatattctatattccttttttttacaggattctaatgttttttggttaaattctattcaagaataggaacaggaaacatcttattttgggttttttgagcatattttcattcccatgcatgattttgtttcctctaacttgctttgattctgtttgtttatcatagtctttgtctttcatgaggggagttttcctcagatgtcaggtggcccttggctgactgctcatattgaagcatatgggaccctaaaaggctggctagtagttctgagagcttggaggaagcctgacaattataggatgatggtctctactcttaagtctttttttgttgagttgatcagatttccaagagtagaatctttcagtctcctatcaggaaaggtacaagccttccgatagcctcatggtgaagagaaatggaggtatcagtttctttagtatttaaattttgggtatttaaaactttcacttagttttcaagatgatacctctgcttgtattccctcagttcactatctccctgttttatcctgcctagaaaacagaacttaagtcttctgccatggtggtgaagggataacaatagggacaggattagggagggcaggaggaatatctaactgctttttaaacggacttcgagttaatccttc

SEQ ID NO: 97425 - DNA, 1048 bp, Homo sapiens
tagatgtggatttagagtcagtataggtgttttgggtgttcttaattaattggtccaaagtcactttcctcttttatcagaaatgtttcaatgtcttgattttaatcacattcatttctctcctctgctcactgaaactgctgatgaaccttcaactctctgtgaacagttttttgtgagttgagctgaggagaaaatggaaactttccatgtataattaatacttatagtagaatctgaagggattgagatttcagaaacctactttgctatgaatagcataatttttcggatggcccattcagtttttagattaagggtaataattacttctgttgtcttgcatgaagagatatgtttggatttacagagggaagggcagttattaacttgtctcaatggattatctttttggttctgtacccctgtttttctgaacttgcttatttatcttttttaacttaataatttttaagtgcaattacagtattgttaactctatgcacattgttgtacaacagctctccagaactttttcctcttgtgtgactgaaaatctgtacccattgaacaactccccatttcccttcctcctaccccatagcagccaccattctactttttgtttgcatgattttgactgctctagatatccgtataagtggatcctttttatgattggcttattttgcttaacataatgtcctcacggttcatccgtgttgtagcatatgaaaggatttccttcattttaaaagctgaataatactccattgtgtgtgtgtgtgtgtgtgtgtgtgtatatatatatatatacacacacacacatatatatactcctatatataaccacatatgtatacacagtagtcctctcttatctgcagtgtatacattcaagaccccagtggatacctgaaactgtggatagtactaaaccctttgtgtgtgtgtgtgtgtgtgtgcgcgcgtgtgtgtgtgtatatactatgtttttccagctgataatgagctactaagtgactaacaggtgggtagcttatacaaa

SEQ ID NO: 97426 - DNA, 1038 bp, Homo sapiens
tagctaattggtagtttaagatcatgttgagccagattctgtgagtttagcttcagtgcctatgaggaggttgatgatcagtgatagaatggacaacgagatagtcaaaaaggactcatctgtgttctgtaaatgtagttgttatttaatttattgtggctttgagtttagaatactgataaaattctattaagcaagggatttctgtgagagggtaatacaatctttacagttctgaagattttgtgtgaagaaactattgctgctatcttagaaaatgataaaatgcactgaagtaaaaaatgtaattttgctaatgattgaaaacacccaacaattcctaattgaatctcaaaacattaggttgacttataaagtgagcttggccaaagagttcctgagtaaagccagagaatcatagtagatactgataaaggggcttttgcagttttaaaatatgaaaattggttgaaagcatttttcatgttaaagaagaaggatcaaaaggaactggggaaggattatgctgctagtaggcgttgacgtgtaatgtactgtgtgttcttttgatctgatagctcatgataggttcagttggttaccatggtttcattccatttcctgcaaaccttcttgttgtgctatttggaataagtgaaaaataatgttctgtagaacatttttcaaaactgtttttctcctcttagtttagattatgaatcattttatgggaaaattttaagatataagagtaagtgataacacatgatgacagtaacatttagttctgcagtattagaaaattaatattgatgaaggggatagcacaatttatttaaaatataatatattatcagtgctaaaaagctttttaaaaacattgatataataattccagtttatgtgaggtacccttgctcaggtgttctttaataaaacaaaccatagaaagtaattgatgtgacacagtaggaaatggctagtttaacataaggcatcccttacttgaaaaaattgatgtgttcctgaaaatgtgtt

SEQ ID NO: 97427 - DNA, 1078 bp, Homo sapiens
ttttttccagcagtagttcccagagcctatgagtattgttaataacaaactcatttgatcatgagacccccttttcatggactttctcagtggaacacactttgagaaatgttccattcaacaattgatccctcatttcctcttgctctggacctcatgctcaccaagcagccttctgattaatgtcttcccgtgttgtctgtctacagagtgagaaaacttaaaatatataggctgagtgttcagagcctttgagttattatttctcattttcaattaacaaattaagattaaatgctgggactaccaggaggaaaagacggaagaaaatctacaaggtttcttctgtttggtaaattcagataaacatgcactccccagtcctcattttttccccccttttaaaaagacacccgtttttgatcaatgaacctaaaatgactgcttgctaaagtgttaacttgatagagaaaaaaatgttaagggttaattgcctcaccgattctttttcttcctgttttctcatttttttcctggaccaaaaaagactgccttctattcaaacagtgttatgaaacatctactgaaggcaaccaagcactgtttctatgtattataaaattgcatcttttttttcttactctgtttgcaagcatggcttttgcatgttctcatatcttacttttttaaaactgtttcttcagttatatagcatagcaattcacctgtttcaagtgtacagttcagtggtttttggtacattcacaaaattatgacataatcaattttagaacatttaatgcccctgaaaagaacctctacatctatttgccctcactttctgtttctcagctctcccagccctaggcaaccactaatctacttttgtctctattgatgtaaacaacctagacatttcatataaatgacattatatatgttcgtgactgacatttttcccttagcataatgttttcaaggtttatccatgttgtggcatgtataagtactttgttcctttttactaatgaataatattagaaaaatattccagtagttgatggacatttgagttgtt

SEQ ID NO: 97428 - DNA, 1061 bp, Homo sapiens
ctggcttaccaagtaaaagggtagaatatgatgaaaaacaagtattttgcgaagaagaaatggtgccggaatgtagaacagcatggagcatttcgtgtatggcagtctgctgagggactgggagtatgggaaattttagcacttagtgtgccaggagagcctagaatttcatgcttaagaatttgggctttatctgtaggaaatgggagtcattgaaggcttttagtagaagacaatagggttacatttatgatttagaaagatcattgctggaggaattagaatgctgagtggaaagggtggtaggaactatgttttaccagaattatttggataattaatttagtaagcagtttttctttgactatggagaactgatatttaaaagggcttctgtatccttacagattttaaagggttcactttgaagagaacttgttaactccaaatttggcaactccagagacatttctgttaatctgactcattttagcttctctaaattgggagaagaacaaagtgacatgtgcaagagtcttgataatccccaaaccctgtatctggatatttcagggcatatttggacatattccagagaatgccttatacctacaatacttggcactttcctgttgattttatgctgacaataacgtaagaactatttggaaaaattttagtaattgagaacaaatgataaacactgaaaaaacatgatgtttgggaaaattatattttcttttaaaaatatgtcacatttcataaattcagaaacataaaacttttatcaatctgaaaaataaaatttattatacagaatagtatgtatagtatcatactacttatataaaatttcgtacctatgggtacttaaatagaaaggtgtctaaaagaatgatcaccaaaatgtttggtgtttatctcttagtgactaacttaaacatgattgttacttctttgtattttttgagttacctgattttttttttacagtgcacatgtatcattttacaaacagaaaaaaaaaaaaaaaaccaaaagagctatttttattttgagaa

SEQ ID NO: 97429 - DNA, 1566 bp, Homo sapiens
tccgttgtctttgttcatccctttatttgttcattcatatatacattcatctatttggaaaagacttaaaagcagagacttctgaagacagaggtcaaatatatgaaatttcttttggtagtcacaaatagaggatagaaagttgatgttaatgtttaggactaacatgtctaattccttctccaatcacttatacctgtgtgagcgagcagggcctgctctgattcctgtccacaagatttgatattaatctttctattaaatagaatgaatacaattcagtattatttcatactgaatgctgaaataattgaatacttggagaatagagcttgtcacaggagttcatggaaatttgctttttatggtaaattataaagtgtaaattccacttcaattacttaattatactgtttttttcaggtttaaattgtggtatacaggaaaaaaattctggtatggcaattcaaatacctattcaatttaccattaattgaattagaagactgatttggggcaaatcacagaatttcttgaagttggtttcttcatctttctactcctaacatattataattctagaattcttcaccaccttatttccaaatagtctggtcatctgattatctatggtaaacagccttgatgtaaatggtccagaataaggaaggaagaaggtgaggtaaaatgagaaacagaagcctctctttctttccttttggttgccatttcccctgcatttctccaggatcacttggaagttataaaactttaatttgaactcagtttttcctaactacaaaattcaagtactttcaccacattaccacattgcctgtcatcttatatctgtcacacagttttcaccagctgataccagcaaatacttgaaggctaaggatttagtttggagaaaagtagcacccagaccttcatatctctttctcattcctgccttcttgcactctcccattctactcatggctttacatttataatcacttcccatccactttggcccagtaaatcttgatggaaatgtttcaaattaatatctctggggtaacttacagtctttcttttgttactgaaaattgccataaaatcattacttggaaaagaaaaaatagtgagtaaaaaggggctgtaatggtcatagatagaggaattttactcacaatatacattgagtaatttatgtgcccaaatatgattgacattttccttgttttaaacttgatgtatggctaggaagtgttaagcaaagtctgaaatagaagttgcaccgatatatgtattattcttatctgatactcccatttcaactggtgattctcccagttcacatcaatttgtttttaacatacacgtaatccattaaggggtagccagtttgtctattttatacccatcagtgttatttatgcatttactgtgtcaactaggggctctaaaattaggaataagtccttgaacttgattcctcataggcacctcaatctcagtatatctcaaactgaactcaacacttttctcccaaatgtgctgtgatatctatatttcctt

SEQ ID NO: 97430 - DNA, 1048 bp, Homo sapiens
aagtacctactagggaaaagcttttttgctgttcctatgaacagtcggagttggcatcttgtcattcaggactcactttaaatgtcatctcagagagagctttgctaaccacccagcttaataagtacctcagcttaataagtacctcactagtcttcccttttgttacccactcctattttcattatagtacttactcttactttctattttctttttaaagcttctttattgtctgtctgtcactattagaatgtaagttccaaaagaattttggtcttatacagtaatgtgtccctgcaggtagaacaatgcctgtcacatatttgctgttcagtgagtgtattttgaatgctgtctatcttcctgtgaaaattcctgggcatttatcttgctgggacttttcttagctatagccaacacacatgccctgataagctgtggtgagggaagagatgatgggacaacagaagggtaagagtatatggaaatgctaactgaatggagagtctggagcaagaaggagaggaatagcaggggaggatgggggagaaagctgcaattgagtgtgtcacaattgtggctatatgttttggggtgttgtattttactcttgaataaagtgaaatttttttcagctcgttaaattctagaaactaaagatagtttagtccaactacatacatagcattttataaataagaaataggtctggagagatgaagtgaccagtccaaatggcacaggtaacctgctggtagaactgggactccatactctgttatttgaattctttttttaatatatgctttactttgtcacatgcacaaaatgttgagttatgttctgcacatttgcatttttacaaatatgcctgtttttttgctttcccaataggtggaaaacagaccaaagtattatggaagagagtaagtatggattattagaaaacgttttatagattggcatatgtaagacagacagggtaaatggatgcttttaaatgaaagcaagatgaagtattcaagtttggtggagttgcatttat

SEQ ID NO: 97431 - DNA, 1047 bp, Homo sapiens
ggtttataagatttaaaatatttaagataacagagaacacactttctaagagattaaaaggtaaagtccttttcatgtagtccaggtatcttcaaactggaatacttaatcatacttaatcataatggattaagctggttttcagttgttggacatttaggttgagtacagtattttagtctttaaaagtaatattgtgatattcttctgtattaatatttttctaacatccttaattaattgtttacaatgaatttctaaaaatagaactgctgggtctaaaggtatgcagaaggaactggcatgacctgttacactctcatgtttttttctattaatcagcaggaaatttattatgttcctttttagacagtctccgcctccaagtttgagccccaggaggctttcccagtcccagagtcatcccatctgcctccaaatgccagaaaaagaaccaactacactattgctcttccttcccatcatcattttttctcagcatttaagaccagccctgcactgtttggcaatagttgcttgaactgccactaggatcctgtttctggtcagaccatggcccaggtcacagcagtcaccgcagttgaaggtcaagattgcagttttttaaaagttcattttcttttactgaaggatttagtgtaccagggaggctgaggtcagagacacttccagcatccaccttaggctgtgccagaatctgtcctacctgataaacgcagaagctttttgtgtgaccttagatcaccagtttcagttattccttcttcaaggccattttatttcaggaatgtctctgcctcttcttgccagtgggacttggcttgagctatgagtgtcttctgtgacagaactctttaattttgaatctcaggaattaaagattggggtaatgtttcttccttttcaggaagatttagcgtcctggaaaattggtcctcctgccttcagcaactaattctgcatatcaagagattgaggcactttttcctaagccattcaactttcccctcccagtgtcccctcctc

SEQ ID NO: 97432 - DNA, 1084 bp, Homo sapiens
tgatcaggtgaggtttttggtaccaaatgagttataaagagttattaaattactttgacgttcaggtcagaccaggctttgctgccaaatgcgttataaaaatacttccacttttgaaggcatttggattttataattgagaaaatacggacctttgttggtattatacttgttagtttttcatatccctacactgctggaacttcttcaagacaaccagtccattacatgttcattttaggccttgttgcatgcaagtgtcagcaagaaacgttacagccccagatctttcatattctggttctgctctcaggaagaaaaacaagtacctatcaatttgaaacacagtttctcatttataaagagtttttgccccttggcaacttattctgttgtgtatgccataaaagcatagttaattaaaagatgccaagcattttactatactttaggatagttaacgtgctttagaattatccaactccgctcatttgtggttgccacagtattacttccatgtctgactttgctttcttccttacagctgtgagctgccttattccacatttggctctacagtttataatctaaggcaaacctctctgtgttccttagaatccactttttttttccttagtgactgagtggttttcccagagatatccagtttaaaagaaatgcatttggaaatgatcaaaataagatgaaaaatgttgtggtcttttcccatctcagttacctgtgatgtgagtattagtaataggagccttatctctcttttcccaatagtttcatgtaagcgttagtttatcttactttctgagcaactgtccttttgataaagcttgaaaacatggatgtaaggaagactttgaagggttgctattttaatgcctgctggcaaaatgatatattgactctcattggaaaatcctgtgaatccgcattgcagaataatgcacattctaataaacacactactttaaatactcccaggccagggaatatgatcgattcctgttccaagggcaagaatccaagtaggtcagtgctacaaaactatgttggagtatggggaaagcat

SEQ ID NO: 97433 - DNA, 1333 bp, Homo sapiens
tgtccaattgacgtgccctgggtcagactcacaattagtaagtgctggtagagacaggtttccagacttccagggcccacacttctcaccgctgtcctgcactgccaaagctggcagcacaaagtggggtgggtccacatcgtcagtcctgaaactcacatcaacctggctgaaaatgtgtaacttctcttcctcctgagcacccagaagtgaagtgcccaggcatccttcatcttttgcttgcttttgctgctgcttcttcatcactttgtcttctcttgttttgcttgtgcatagaaaatatcccagaacttactttcagtcattagcttccctggccttgaagtatattttgtcacctcctgcctaggtttctgcccttcctgaaaaaaccgtgttttgtgaatgggcttccagcagcctgagttggtctactgatatcatcaggaagatttacagtgctctgtggcatctaaaacactgaataactgtgcttattatgtatgttttctgtttcatgatctggcaaaatgttgtcatgatagttctgcatatcatatgttgaagcatgggttatagtaggaaggaggcatgcagattgcacagtagcccattcaactgtggaagataccagagagcataatcattgttatccagcattctctttctaactcttagacttttactgtgatgacccagtgtggaagaatttgtggttgaacaactgaagagttcaaggcaaaaatagtgttagggtgatcctgggtcactagtaaagctatgaaagctttaattttctttttatatttgatataaaatgaggatagaacactagaaaaagagaatatcagtgattatattaggaacttttcaggatctccctcatttaaaatttggagaatatgtttattagttcactttttctgtggatgcagatattatgcatactaaggggttatattttctatttctgatcttccttatgcatagctgagtcagaatttgttaaacattctctctgataaggttatgtagtataattccttacgtgataacgcttagccttggcactgaatcaacctgactttatggccaccctccctccctcctaatagagtgagtgaggaggacagttccaagatctcactttactttctttgctccaacttccattgtctgaatgctgcatagctcaaactacgactactgctctgccacccacttcaccttctttttttcttcccaatcctagatcactcatttattaatcatccccaacaaagtgattcatagactaaatattacaggaagtgtaaattccaagattttagaa

SEQ ID NO: 97434 - DNA, 1518 bp, Homo sapiens
accctgtctctactaaaaatacaaaaaattagctgggcgtggtggtgggcgcctgtagtcccagctactcgggaggctgaggcaggaggatcgcttgaacccaggaggcagaggttgcactgagcccagatcgcgccattgcactccagcctgggcaacagagtgagactccgtctcaaaacaagcaaacaaacaaaaaatcataaggaaaagatatttattgaaaatatgtggatcgttgtaaatgtcttcatctttgttgtcttcatgttgagtagactgaagaagaggaggggttggttggtcttactgtcttaagggtaacagaagcacaagaaaatctgtttataagtagaaccacgtggttcaaacccatgttgtttaagggtcggctgtatttctaaagtctaaagagaatcatggacattgtgactctggggtgttttctttcgtattagtcttgtgtttgttttcgtctttacatactatgtatcttaactcttaatctgtaaacttttggttattaggcatacacatatggtggatctatggatgtgtctattcattagttccactatattttagaattcttggtaacttttttggtttatattttatgaaaaacaaagggcccccttttcttttgcaaggtgtattctatagctgtgttcgctatattataaaattaggagagtaattctaacttctctgctgagtaggtgctttttaaatttctttggtatatcagattctcaagcttcattacataatatatctctgtggcataactcctgaagataatatagggatccagtgtgacggtttggctataaatatttcacatgatttagaataatctaatctcaaatccacaattgcagtttattatagttatggatgtttggaccctggaaaattaaccttttaatttaaattaaagtaacagtttgattattgggaatattgtattgaacatttataatgatttgcttttggaattatactgatgaatagagtgaaaacattttccagagagtccacaagatggcacttgccaacttgtttcctctgtttttccttaacttatggaaatgcagcaaaatttaagaaggaacatctaaatatttatgcccttaaaatgctaaagtttagatttctagaagctttagtcaagactccttgaaattgatgagcttcaatttaacattttaaacagtgttcatttccggtataggagccaaaatcctttgttgaagatccgtaaaacacactgggatctgtagaatacaaagggctgcctgcattcactatgtttgcctttacttttaaagtaataatatgatttatgaggcttgtagtctatatgtctcatttctagacatcttaaaatatggacatttattagaacaatgggtattagtaattgctctaaagtaactgttattttttatttaaaaacaagatgatgtagttggaatatattatgtaatttttaattatgaatgaaatttaataagt

SEQ ID NO: 97435 - DNA, 1297 bp, Homo sapiens
taaattatttggcataattagataacaaattccacttcattaaactattgttcattttcatttcagtggtacaaagggattgtacataaattagcttggtttgttcatgttttaccctcacagtagggaacataatcaaactgaataggaattcagtatgaaaatggctaatttaaccttttcgaggtctgaaaataaaaacaacataatctttcattaatttgtctgctacaggaaccttcctattagtttttagatggttgtgagaagagcagatataaacagcagtttaaacattaacatttttaaatggattaaaaaaccttttatttctgttatttattaatgcctcttgtttttctaggaagaatttgaggcaatttacaaaaagattcagtgcaagaagattgaaacaataatcatgggaatttgtttttctctgtcttgtgtcattaggttcttcctctcctttgggttgtttccctctgattgtagctgtgatttgccattccatatggtaaagcctttttctttcttttttttttttttagttttggtaccctctcaagcactgtcatgtgtttttttggtgctcctcccattaccaaggacttattgaaagagaagtctctgtatgctccccttccactttctacatgtctgttttcatctcttcccagccacggtgccacagataataattagtttttaggtgtttgtgaatgtcattcatctctagtgaaaaaggagagattgacaactgttaaagaaaaacttattctaacgcttgttaaagcagcaaagaagattgtatttaagataatcatgataggttgtccagactattgtgataggggagagagattggactcaattccgaatataacatgaacaagcaggaatttataaccatgaagcaggttgtgggggtggtggatggacagttactaagaggagacatcaagggtgggggaattattgctaaactgacataacaggattcttactgagggcatgtcagtgtgatcatataacaagggtagggggttgaggaattccattagctagcaagtgattggagccaggtgtggtggctcatgcctgtaatcgcagcagtttgggaggctgaagctgaaggattgcttgaggccaggaattcaagagcagcctgagcaatgtagtgagactctcatctttacaaaaaataaaaaaatagctggcatggtggcacacacttgtagttccagctatttggggaggctgagcctggaggattgcttgagcccaggtgttagag

SEQ ID NO: 97436 - DNA, 1029 bp, Homo sapiens
atgttataataatagttttaaaggaatgacattagtataataagttataggtttttcataagattgttttaacctaggaatttactatcttgagagcagccatgacaaagagtaccttgctggggctggtgagggtgtagcgtttctccaagtccctctgataaagatgaggtcctttgctatgggcaattgatgttttctcagtcttatagaaagcatcaattacagcatctttagaagactttatttatctgaaatatgtaaactaaatgaaatcacagaactttctgtgcaaactcaattcaaggcaagtccttgagcctggccttgtaaccaaattaccagccattagttattcttacatagaaaataatttctatgaactttgattttttttaattaatataatcctactatccttaaaaataggataggacaaaactaaggaaacagggtacagtatgaccatatttacattgaaaagtcatattgaatagaaaaaaaagcctgacaaaataaagttataaatatacattcctaatttggctgcttatttttaaaagaatagatactttgtgaatacactaaaaaccactacattgtacactttgaaagggtgagttttatggtatgggaatttatgtcagtaaagctgagatatattaatttaaaaaaccacctgagctttaaaaacaaagattagatagaagaaaagaatggttttatatccaagaacctttaagagctttttacatttttagatttttttttacttttcttcctcaaagaacaaaaaataaaattaaaaattgataggtaaaaatgttcctacctgttttaaatttagaaaagtaagcacttcttggaaagagccaatacccacagttgagagaatgtgggagaagggaagatgagtcaggccagcatgtcaccagctgctcagtggcctggcatagagccacctcattgttttttatccagcagcgctgaaagtgtttcctttctctttccactctgactctgaccttt

SEQ ID NO: 97437 - DNA, 1073 bp, Homo sapiens
gggcctgggcgcccggggagggggcgcggcgcgtggggtcggggcgggccggggccgcagagttggggcgcccggggcgccggcttgctccctcgcgcctctcccattgtttcctctcccggcagggccgatgggcgtgtgctcccctggccaattctcggctgggaggctcagaggtcctgggtgttttgcaaacgcacaaagattctctaagatgccaacttgggagtgaagttaactggttgttttcaaacctgcctttcccgtcggtaaataaatccttggaaagtttatttattttgaacgaggtatctgtgagtccccagcctccttggaattgccaaatgcatgtgttgcttcctgttggactattggggaattttttttttggactcagtatattccgttggaaataagtatgatttgtgaactgaatatgggttaaaattgaaaatgtttgcactaacgaatgagagcagacagaataaagttggttaccagaagataactgtaatctcaggagactgagtattcattaagaatgaaatgttatttttgtggtgtaattactgcagcactgttgcttttggtggttaagacttcaagctgtttttttctcagtctgcaatgacaatgggttgggaaaaaggactgaaaagatacattctttccttttacaaaacgactatggtacatacgtacctgactttaagaaaactcaatatgtgaacattagacgttcaaagtattcagcttttttgaagaagcaaagtacaatgatatgtaattgatagctacgagaacagcctaagtaagttattcacaatatcaagtttccagttcagttttaattatgtcatttgatcaaacacgttagaggtgttacatacctcaaatgctttttgaggtaaatacttcccagtgaattaagctgctagaatcaaagtgttacttttatttaactatcttattttataaattaaacttagacccagagaggttgtttcccaaagtcacatggctcttttgtggcaaaactgagcctagaattcacttcaccaggcttcagtctg

SEQ ID NO: 97438 - DNA, 2969 bp, Homo sapiens
taagaattcattttgtttatgcatgtggttatacatttttatcttgtaataagaatgacatgtaggccaaccagactgagtttgttaaatgtgatacttaatgtttgattgtatctgtaagagactatcttccaaactctccctcattttctttctttaacactatttagcaaatatttcttcagctctattccataaggcagtgggcacccagatgtttccatatgcatggttgtgccttcttttgacctattgcaggtaaaattgcctacttcatgacctatatcaattgctgtaataccaacttgtctaatcagttttgtaagatactttctaactttttactctgtgtattgcctcagcatactggtgcattcttaccgattttaggaaaatgaataatttttcttttttccacccagctgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaac

SEQ ID NO: 97439 - DNA, 1060 bp, Homo sapiens
gcacatgcaaatgtatgtttattgcagcactattcacaatagcaaacacttggaaccaacccaaatgtccaacaatgatagactggattaagaaaatgtggcacatatacatcatggaatactatgcagccataaaaaatgatgagttcatgtcctttgtagggacatggatgaagctggaaaccatcattctcagcaaactattgcaaggacaaaaaaccaaacactgcatgttctcactcataggtaggaattgaacaataagaacacatggacataggaaggggaacatcacacaccggggcctgttgtggggtggggggaggggggagggatagcattgggagatatacctaatgttggatgacgagttaatgggtgcagcacaccaacatggcatatgtatacgtatgtaactaacctgcacgttgtgcacatgtaccctaaaacttaaagtataatttttaaaaagtgataaaaataaaaaaattttaaaaatcacatataaatacttaaaaaaaaaaaagaatagtggtgaaacaaaacaaatagagctttttagtattccctccagttaaactgtcattgccagtattttgttttctatatacatgtaatgattatgtaatgattatattggctattttaataactgaattataaatattttataacattcattactgcttgatcagaaaagtaggggggtgaaggagaggggcactagttgagaaacgacctgttgggtgctatgttcactattttggtgataggttcaatagaagcccaaaccccaggattgcacaatatacccatgtaacatacctgcatatgtaccatctgaatctataattttttttaagtattcattctgttttatataatttttaaaggattactacttctggtggttggtggtggtggtggtgttgttttattgtaccttgaggtcaagtatctaggggtatggttttgatttatagcatgttatagagaagatggggttccatctcattaatgtattttaaaacctgcttttcaaaaatgcatggatttgagg

SEQ ID NO: 97440 - DNA, 1026 bp, Homo sapiens
ctgtaaggttattatagaatgcagtagagaggtataattttttagaatctagagagtttgagttttcctgtttctagcttttttcctaagcgttactatagatcaacaaaatggattagctaataatttaaaatatactgtaagtacttgatgatattttgttcatcttctcaggataacactttgtcttagattgacagggtgaaacactacttttttcccagcctccgttcattaatgatgatatttttctttttaaaatcagctgactgcctttaacaatatatgatatccctttaaggtatcagatcctattgttctttcttagataatgtcagcattgtgtaacgtttttattgttgtaaacctttatattgagatatctagttagtttataaaaatgttaaaacgggaacagtagttaaattatctgcttgtaaatttcctgctaaatgttttcccaaagaatgagattcttttgttttcagcattttaaaggttaattgtgccttttcctttttgtaatgtccttcttttttgataagatgcacagtgttggaaccagctgttactcttgaataaatggccaattttgtccatagtatacaaatttgtaacaaacaacagagttgggaatgcattaggcaacatttataatatataacccacagttttagtctttatgatttagtgatatttcaggatattagtaaatgtgaagattgtttcaaccatatgtatccacttcattttaatttgccagtgtcagtaattcaaaagaaagaaacattttgtattggatgcaaacagttcctcaggtgctcacgataaaacttaatggccaccatctttacttgtagtcattataagcagtttcatcagaatgggcaatattttttaatttaaaagattccgtagatttagctactctcaattgccatatatatttagaacgctgatttttgtcagttttgagcatataaatcttgcttatttgatatctagtaattttgacaggatggtgaa

SEQ ID NO: 97441 - DNA, 1064 bp, Homo sapiens
ggttcaaactaatgtgaaggtagcaagggtatgagaggcttgaagcatcactagtgtttggtgttaaaggatagagtatgttggaagagcagtgagagttgaaaatcattatgttcaccatcaccagattgtaaaagattgtatattcttgagtaaaaataaatatccagcccatttcctgttacaggatttaatgagagaaacttgtagacatcagtctcaaaatcaagctgacaggatgggtaatatacattgggtaatatacattggattattcataacatggtttcatcaatagtgtcatttatactgaactataattagcagtattgacaccagttggagaaggtgtttcctaaatgacagcttatcttttcaagccaaactgttttaaattttaccttttgtactttgattactatctacccattcttgcctcaaatacaatattctaaatcatttaatcttttaattaacggtttagagttattatgagcatcaatttttgttctgtacttaaatacagtgatgtagttcattgttattggggtgtgaggaactgtttgacccaatagacttgcctttagattgcttaacttttattatttaatttttatgtttctgtcacttatcacttaaggaggcccaagtctgctaaattatttcatttattttttttgagacggagtctcactctgtcaccaaggctggagtacagtggcacaatctcacctcactgcagcctctgcttcctgggttcaagcagttctcctgcctcagcctccagagtagtgagtagctgggattagaagtaccctccaccacgcccaactaatttttgtattttttgtagagacagggtttcaccatgttggccaggctggtcttgaactcctgacctcaagtgatacaactgcctcggcctcccaaagtgctgggatcacaggcgtgagccaccgtgtcagcctgctaaattattttacattcagctttctgcttaagaaacaaggtagaaaatgtcatgcctcagcttttatgtacacctgtttgctatattttctaat

SEQ ID NO: 97442 - DNA, 1326 bp, Homo sapiens
gaaatcatggttttctatcatgaatttaaataggaagttattaaacgttttgagaaatttataattagttttccagggatttaataatataataaaatctgttaaaatatacttggaaaaatatttctatatatcatttgtattgtattttaaattttttcatatttgtatgtaaatgaaaatattatacataaagaatacatttgctgtgacattgcattagtgagaattgtgttatagcatagctcataacataagtatattcaagaaggaagttaaaccacagggtgattttcatattgccccaacatactgatgtattcaacaagacttagaaaatacagttgctctccccctttgacaccctttactgcctatgttaattcactcactagatacaaatataacaggctttcatctctgtttataataggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcaggtatggtgcatatatgtgaattttgttttatttcttttttaataattgtgaacatagattttttttttcctagttgggcctccaaacattttaggacatgatattgggtgtgtatggaatctatagtaaatcatagttttgtaaacctgtttgtttggatgctgagatgaaataatataaaactttcaacactgatacagtgaagaaatttaaaatgtgtttacctgtgtacaaaagtagctaaactatccggtttgaactttataaagttgtgatataaagtgcagagaattttaaaatttaaaaatatcactgttatttcacttttcttgtctatttttttggtttatagcacaactataagtttcttcagtagcagtttttatttttaaattatttcattctttgaattataaattttgttctgttttgttttatttaaagtgaatatattgctcgtgaaaggtgccagattgacagctttggaaactgaaggactctaattatccacagaccaggtacaatatggccagtggcagtacagatcatttcatactgccctgccaatgtgcctcagatacatttcttaaaacctcatggagtataaagttttaaggcagcaccgaatctgtttcctttgtttttcttccttccttttgtttttgttgtgttttttaacgtaaata

SEQ ID NO: 97443 - DNA, 1052 bp, Homo sapiens
aaaaatacaaaaatgagccggtcgtggtggcatgcacctgtaatcccagctcctcaggaggctaaggcaggagaattgcttgaaccgtgaaggtgaaggttgcagtgagctaagatcatgccactgccctccagcctgggcgacaggcgagactccctcttgaaaaaaaaaaaaaaaaaaagaaatttaataggattgtacactaaacagagttaacttgctatgtgtaacttatatctcaagaaaaaacttttctttttacaaattgactttattttaaaaatcacacccagaatatacggtgattcacaagagagagaaaatgtccactaacatttgttcacgcataattactgcctcagttgaaattccggtgatcttttcatatatgcttcagtttttatgggatctggatcacatatgatagacagtaagaagataggcctagatgaaaaggaagaaattacaagttttgaaatagttataaaaatttctgaattgttcttagttgaagtgaatggaaatacttgtactggtattatttgggggtcttttttaaaagctcttctctcactcacccctttctgctgtactcagggaaggaagaaaggaaaagattgccaagaatatgtgttcttaacacttaacaccccagacagttatgtatttctaagaagtttgggaagcactgggtaggctgcaacatggttctcacatctctatctctcttttgtctctcagttgcactcgctctcactctcttattagcctccatcccctcaaagatgcacctctataagaatcttaggaaagtgtaatatacataactctgactccaattcctgtaataatatgtatttggggcccaagaactacatctcagttattaagaacagtatcagcaataatagtctcaggtctgttggatccctgaagtccctttcattgctgagatactgtggtctgattatctgtgcaaattatttcatatttacagatcataacaaaaccaccttaaagatcacatatgaccattttcactaaagaaacca

SEQ ID NO: 97444 - DNA, 1511 bp, Homo sapiens
cctactgctgtgtccagtttccattggctggaatgggacctcacattctgtatttgtcctgattggctagcaacttagaagttttaaaagaggcaaaggcagaggagaacaaaggaaggaggaagtaacttgtggaatgctaagaaaggtaaaaacaccttcaaataaggaagaggaacaggctatgacctaatgcttacttggaccagtatacgcatgccagggcaaatatgtaggtaaattgtgggagctaagaacataaagtacattgatttctttattacggctagcagatatttgaatgttagcacaggtctttgaataaattttgcttctaagagaagttactatttattcctaattagatggggaggagagtctttgaagaggaacctctactttactttttacatctcatatataaaatatgtctgggatcaaaccaatgcttaagatgacccttagggatattttgaaaattcagaaacataggaactatcctgattctttggacctccgtgctaagaaaatagaggcctcagtagtattcttaaaagaaataaggaaactgacatctgaaaaattcttttacgagtcagatagttttacatgttatatttatttttcaattcaactctgcaaggaagttattattcccagttttataggtaaagaaattgagactcaaagatcaatgatttgttcaaagtcacagatagtttgaggtagagttaggttctgaacctaaagtgtattctcagctttataagaccatagtacattgcatgttctaatcagtgaaagcactaggatattacataagtggtactttttataattcataaagaagtagtctgtcagaaaagagggagaaaacatgccagatcctggcttagcagttgcagtaacaggtttggcactctaaatccttatgattgttttttgaatcattaagccacaaagtttcagactctctgtcttgagttttccctgtgttttctggtagcaccaaggataaagtatgcagcatggtgctgtggaaatattttgcacttgaaattaaagagatctgggtttatatccaggatttgaactagcttaacagctctgcatccttgagcaaatgatatctggtttcctaaagtgtaaaatggggatactatacaattaaaaactcattaaaaaactacagataatacaacaacacaggtgaatctcaactgcattgtgctaagagaaagaagccagattcaaaaggctatacaatgtatgtttccaagtatgtgatcttctggaagagacaaaactcttgggatcagaaaacagatcagtcgtttccagggccagggagtagaaggagagtatgacaggaaagggcatgaggattttattgtggtaaaactgctgtgtatcctgattgtagggtaggttgcatgagtgtatttgtttgttaaaattcaatagaggccaggcacgatggctcacacctgtaatcccagaactttaggagc

SEQ ID NO: 97445 - DNA, 2897 bp, Homo sapiens
gactagttgtcactaaattttggtttcagggttttgtttgtcgttaagcccgtaaatcatattactcttctaataaaacaattttcttttgtaatatttgtaatcaaaaagcagctcttctgaataagaaaatgttaatcatctgggaattttaagatttagtaaagtatttaaatagtatcctccagaatcttttttttttttttttttaagatgtgtgacaaactgagaaatatctttgcacacagtgggtagccagtaggttttctgcagggggtttctactgaaagctgacagagggcatcttggcaaatgttcagaaacctacattaacttggttgggccctgcatggaacctcatgttcagcagaattcttctgacctgcctctgcatgccgagctaatcagcaaatacctaatgagcccactccaaagaaacagaccctctctcaacctacttgattttcatatgttctctgggggtggggtgacaagatttcatgaggactgatgatgctgcaaagaccacaataatgataattaacttgctgaatttagaagattatgctgttaattagttgcaaaataaagataagtaatagagcagcagatggtaggataacacccaggagaaggagggttattactctgatgagcttttgtggcacatatgaaatatggatctgactttttcataaattgtttctagagaacattatcttttttctttgaactgtgatggagtactttgttcctactactaagttctgacagatgtgataaaatttattttcaagggtgcaacatagaacttgaatgacaattatttctaggagatcacctcttaaagcgaatgtgtcagattggtcagcacaacaaattattcatcctttaattaattgaaacaatctatatctctctaagaaaaagagttttcagtatagtagttgaactttacatcactgaaaattaaacattaaaatactggtctgtttcatagaaacataatgaagacatttttgtttatcaaacaaagtctacctttactttaaattaaaattatgcctaagttttcttgtacatgttggataatatagaccttataaagtcctccttttttttttttcctcttttttttgagtcagggtcttgctctgttacccaggccagagctcactgcagcctcaaacttctgggctcaagcaaacctcctgcctcagcctcctgagtagttgggactacaggcatgcaccaccacacctggctaatttttaagttttttgtagaaatggagttttaccatattgcccaggctggtgtggaactcctgggctcaaggagtcctgccttggcctcccaaagtgctgagattacaggcataagccatcacaccccaccttaaatctttaatttttatgagtgctcaatctttacttcttagagtacttaatccttatttacatatattaaatttgtctattgagagagatttttgatcttagtaatggactgaccaatatcagatgcttaacttaattgattactaatagatttagaaaatttaacattagactagagctccagtttggcaaagcttttgtttagaatatgtttggtgaactgggagtcaacaaatagagtttctggttttatctctgctaactttgattctgggaagtaacttcagttttttggagtttctgtatctgtaagatggtgattggactaattgactttcattatctctgctagctccaaaattctattgtaaaataaatgttcattacatttgttttcattgattttttttttaaaccaaagtatttggccttcttcaaatgctcctaacaaatatgtatggctggattgtagatatccttacattaattgtaaaatttatatgaatgatatttagtgactgcttttttgacctaagtctaatttttttagcgtgtgtgcatttttgttgtagttttagaaaaattaatggacagtttagaacagtgttaattaacccttaaaatctttttcttctgttgtatacccactggcatacttttcaagtcagacccattgtaatcaatgtaacagcatggagcaaacattagagcttcctcactggatgagtactgtataccctagggcagtcaaggaaggataatgaatgaatactgatgctgcttttaagtgctttataaggtagtaacttgccctactaaagattattcaagagagtgatgtttatgtacttcaggctcccctatgtgcagttactgtatttcattaattctgagagttaagctcttcactgtaaaactttaaatgctcttcaattctatgataatttctacctaaggacttaaaaatcttttccaaacacataatttactaagcctcacatttctacttctagttatatttgtgcacattttaaaactagaaatgaaagccccaatttatcactatagactgggtactagtcattgtattttgatgtctaacattctatttataaaatatataaatatgcagactggcgacctcccaagactctctccctttgttctgacccacacttttccaactcaggtctttctactttaaatacttcttgatcgtttttctaagtattcctatctggttctagccagctactactttagtcccgcatttaatttcagttttaatccatccacttccacattatcccatcaattagggtcctaatttcctatgttttagctactaatatagttgtttctgattgtttagaaaaggaactaggaatcttatcttgattctaaaaaattcagtttttcttatggtcttgagcatgtctctgttaggaatgcttacttgttccccggtgctgtaaagaaatagcacttgaacataaa

SEQ ID NO: 97446 - DNA, 1956 bp, Homo sapiens
ctcctgacctaaggtgatccacctgcctcggcttcccaaagtgctgtgattacaggcgtgagctactgcactcagcctggaattctttatttacactggatataaggtttttgttagagagagaggtacgtatatttctactgtctattttcttttagtgtgtagcttgcctttatttttcttaatggtatgtttatactcccattgacttacttttgtctttaatatttgttttctcctacttaattaagcttaatttgcttatcttttttgggtttcttaaagtagaagcttagattatctatttaaatcttttttctaatatagacatttaaagctataaaatttcctctgtgcacaaattttgatatgctatacttttattgtcattacttttttaatttctcctgtgatttcttctttgacctgtgagttatttagaagtgcactgtataatttccaaatatttcaaggcttttctatttatctttttcatattgatttatattttaattacattgtggtttgggaacttaccatctttggtatatttgattttcctttatttccattttctaatagatcatagctatttatttcagctcatttgtgaaacagtagatattgctatgctggtacagtaacctgaactggtaacttaaaatgtcagtgtactggataagggaattctggttacttgaatttttttgttgcatagaaattatttcacacttcaatattctttttatattaacaacatcatttaacagctatttctatcaattgttacatggcaaacatttcttgggttctaagaaattcaatagacatgatcttaaattttgagatttttcttgcaaatgtgttcagtagccatcaggagagtcaaaaaagaatgttcttctaagaagaccattatggttttcttttccagcatgtgtagcaattaggattgtattttatcaatgagctattttgttttgggttttgatttcatatttttttggggggggggcagattttaatgcccttgatggtgacttgtacacataatgattattcagggactacttttaaaaaataatataagatttattaagattacaagtttaaaaacctagtgctttcctaagttctcaaggcaatttacatgtacagttatgtaatgattgcttttaaagagcttaaaatataatcttaaacacgctaagctatatacatgtaaagctatgtactcaataattctctcaattgtctttcttaagtacttaaataattcttaaatttaactaaacttagtgatacatagttttcttaaatattcattaattatttagaagcttacttaagattatctcagcacttacaactaaaatcacaggcccattatctcagcacttaacaactaaaatcacaggcccaagtcaatctcttaattaaacattttcacttaaagtccaagggtaacgtgttattccgcttggcaagttagattagattatacttgtagaacgtaaaataccaaataggtatagtttatttgaaatttaagtttgaaattaaaatgtcagtggtattggtttacttttttaagcttcagtgggcttaagaagactcaccatataaacaattctgtcatcccaactgaagaacattgaagatgggttcgtatcccagtgcacagagctttcttaatgaccagataaatggtcacagaacttgattctttcatgccttaaagatagaactccaagtccacattctccaaataagtggttcccagctcacattccctagattcatgttacacattaagtgatttttctgactcttcacctgtttgcgcaccgccccccccaccctgccaccaccttaaaacttgtaatttcttcttttactgcttttgttggattttactttgttgttttcagatctttgaaagtattttaaacatca

SEQ ID NO: 97447 - DNA, 1459 bp, Homo sapiens
ccaccatgcctggctaatttttgtatttttagtagagacgggttttcaccatgttggtcagactggtctcgaactcctgacctcgtgatcccccctccccagcctcccaaagtgttgggattacaggcgtgagccaccacacccggcctgaaaaatttttactgctattctccattagtgcagacaatcagtcagaaatttgcacaggacaccctgttttagcaataaaacttacatattatctgaatgaacagcagttggttgaagagtataaaaattaggtggttattgattgttagagaagaccctaaaaacccaaggaggaaatttttcacatcatagtatgttcaggtcagagctttggaaatactaagatgaatcttcttcacttgatagcagaagagcttcaccaggggcattttttgcacttcctattttagtatactgattgatgaaaaattcaatttaatttaccatgcagtgggaactgaatagagcagatatagatattaaaaggagatcctgttattgtgtactgcatctaaaagtatttttacatattcattggacttttttctataaattaattcaaaaggaacaaatccagttttaagaaatacctttatttacaagagtaggccatatttttagaaactgttaaactttacacttaacctgaataactgtttcttttaggtcatcaggaaattaaattaaaaagaataaaagtttctctctttccgatcagtccactccatctattctgatgtttgtaaccatagattagttatagaatttcatataaatagccactttatactcttatgtccagctcagcatgtctcagatttatccatgttgttgagtgatcacagtttgcttctttttattgctgagtggtattccattgtgtgaatataccacaatttctttgtccattctcctgctcatggacactttaatggtttctagtgtttagctattgtgaataaagctaccatacacagtctttttttttttttttttttttttttattgatcattcttgggtgtttctcacagaggggaatttggcagggtcataggacaatagtggagggaaggtcagcacataaacaagtgaacaaaggtctctggttttcctatgcagaggaccctgcggccttccgcagtgtttgtgtccctgggtacttgagattagggagtggtgatgactcttaacgagcatgctgccttcatgcatctgtttaacaaagcacatcttgcaccgcccttaatccatttaaccctgagtggacacagcacaagtttcagagagcacatgattgggggtaaggtcatagatcaacagcatcccaaggcagaggaatttttcttagtacagaactaagtgaagtctcccatgtctactttctacacagatacagcaacaatctgatttctctatcttttccccacc

SEQ ID NO: 97448 - DNA, 1925 bp, Homo sapiens
cctccaatccattttctgtaagatgacttttaatacattaaatatgtcacctgcttaaaatctttcaatggtctaccattgtatttaaaataattcacactccttggcataagccctctttgatctgggcctgtctacgcatctatccttacctcatgcctctctattgtgttcatcaaatattcaaagctttttcctacctcaggacatgacatatatggtattgcttccttctccctacaatgaaatgctctcctcctcatccttttatcatcagttcgaatgctgtttttgcaaagaagctcacctattcttactatgctgtctaaattaactgactcttccttaccttcagctaatctttcatcctttgttacattgcacgtattattctgtaacacttaacatttactacaatctgaaattttcttacttgttttacttgtttattgtctcttccttgagagctagtccttgggagcataagttctcaacttactgaataaatgaagttacaatactactactttatccttcttcctatgtagcttaataagattttgatgataagtggcagcatacaggccaattcataaaacaccatagacccaatttttacactgactatttaaggagttctgggtaaaatcttttaaaactttttgttctataatttgtaaaaccagaggaaataccatctttaaggtcttggctgacaaattctgttttcctgacttgaaagagttcactccggtaattatttattttacattcaagatatcagtattacgtggccttttgatatgaagaaattattgatatagaagaggtagctaactggaattaacaattatttgtattgctctaaaagttcttatttctgttacttaattgtatcagccataacacagtctcactggacctgtttcctcttcatacagtataatgagggagggggactaaacagtcccttctggattttaagttctgtgattctctgagaatggattatatttttattttttattaaaattctcttggtatcatagccaagttgcccagtctaacttatttctggattgataggagaacaagttgtactggaaaaaaaaaaaacgagtctttttaaaattaaaatattaattgaacattgcatttgaatctttacagctcttctaaaatgttcttttaattaatttgagatattaatttgcttttagcagttattattctgtagatgcttttagaagtgtgttacattctgttcactaaggtacatgatttgtatttttaaatgccacccttttttatctcattgttaaataggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtgtaagtgattcaggccaatcattgaacatatacatgaattaagtttgttttgtaatgatttttcctaagacatttgattattcaaactaagatcttagttttgtatgtgtgtgcatgcttcgaattttggaaaaagtacttgcgtagtcttctttaatataaatattaactaacagagtgggagataaatacaactaaaaacaaatatagaatgtgaatttaagatagtcttattttcatgctatttcacacaaaatataaaattactgcatcaccagattccatttctttcagttcttactggtagctcccaagagctctctgatgacagtttttctcattttacaaattggagattgtcctaagtaaatccataacttttctcttcttttcaatactgctacacaggttatgcattta

SEQ ID NO: 97449 - DNA, 2934 bp, Homo sapiens
tttatcgaaaacaatatacgtaggaaaaatgtaggggaacttccaacatatcctaactaagttccataagtaacttagagatatgttacttatacagaagagtgagataatgcttttttttttttggagtattttacattagacattaagagctagaaccaaaggaaccaaacaagcaaaatagtaacaacctcgaaagttcactctcctaggcatgaagctctttgtttctctgaaactttctgccttagcacaatctctgtctgtgtgtaactctttaactcaaatatgttttgaaattggtttctagaaattactttcctgtctgatcacatttaatgcagtagaaaaatagagcacattcaaacacagtacttgaccttttttttcactaacatgttgagatgaataggttaacattactatgcaaataaaatgcatgatgtgtgtggtatatttttggtgatcagtagccatatgcaatgtgcatgttaaatgattgtgcctatgttgacttttctgaagtctgatggttccagtaatcattgataaaagtgacttatgcttatgtattttatttttttaagattttcccctccctttaatgtaagttaagagccttctgatgaacttagatagacaaaccctttgggtgtgaacagaagagtcacatttagatttgacctactaatttagtcatgatggacttaagctaatacatgtactttacttactgtaatgtgatttttgagatcttttgggaggtgggaattaagggataggctagaaactagtaaaattatgatataatagagtccttttagtaattctgatattactaacagtgcctgaaacaggcctgcattatgtctagttttgtattacaagtgggtcattttagtgtgaaatatatttgtacatagtaaaaatactagtcctctaggtatacatgtggggggcaaaggtaaaataggaagtaatgccctctgtggggacataatggttaacaaatatgtaaattttaatcttacaaaaggaattaggagtattttctcttaaaccaagagtcttccttagtagagtacttttacttcacttaggctagatccctgctatagcctgtaaaattggtgctctaaaatatattaaatgtgaatagaatttgaatgtgctaccaactctaatcaatatgaatagacacccttgaaaatagtaacactaaataggcagaatttataagtttcttgcttttcattcagtgtaaatcttacctggcattttttgtagcctatacatggacactgagtacctatgttaatgtacatagtaggagtacatattcgagtaaagttgaaatgtttcatgttgtaagaaaatagagtagactctttctttactccttaggaattaagctagaacattctggaggcatgtgactcacacatattccttgtacctagcttgtaaaatgcattaaattagaaaattagtttcagtagatagtggtaaaaagagggtttgttgttttagggctgttttaactttttttttctttcttacaatatttttatctacctattaaagattgttttatcttagtttgctttcataatagagtatgaacagctagtggaagaaccaagttaaagcagatatacatgctcttatcctagttttccccaaatttcatttatttaaataattgtagtttttaataatgtaaatttaaaaaattctttatactgtgttagataataatagtttatctcttgagtagaggatgtttatgccattctactcagaaagaagcagtggactaaggagcaaaaaggacttctttcctactttcatatttcatagttcttaaagttggaggaaatacgaagtacaacaaaaatttaaccaaattttgtttgttttaaaggaagaggtctttccaaagagagaattaacaactgactgaaccagtcctgctaatttgttaacttagtagctatattttagagtcttaacatatttaaatatgcatgattacttcttgacatttatttcagatcagaccccaacaccaacaagattcttgaaaaactgtgaagaagtgggtttgtttaatgagttggcgagtccatttgagaatgaattcaagaaagcttcagaagatgacattaaaaaagtatgttgtaaccatgaaatttaaaaagagtacttctgacagaaaagtaatcatagtttatacttcctgctttttaaatttagacacactgtttttgaacttataaccttttccttattatttgaattatagatgcctctagatttatcccctcttgcaacacctatcataagaagcaaaattgaggagccttctgttgtagaaacaactcaccaggatagtcctttacctcacccagagtctactaccagtgatgagaaggttagaaatttttagaaatacaaagtaagggggaggaacagtacccaaataaagtttactatttaatctccataaaatgttaatgtattaaattcagtgtcagcttgcaatagttttatatgtgaaagcctgtcaatactcagatatttcagggtaagaagactgcagcttttattgtacatagaaaaattataggggagaacagtcatgttacataaaacttatttttaaaagatatataaatttataaatttaacttaatttttctgtgttttgctattttatatttagctacttttatacagtaacagcttaattaagaatctattcaaaaaattatttgaacagtggttttttagacttttacaggattaagggactagttactcattctcagcagtggatctttgttagcggcaattaggacgatgatgatactagcttgaatacccagataatctgggaccacctgggctacagttgtgtgttgagtaacatta

SEQ ID NO: 97450 - DNA, 1065 bp, Homo sapiens
aattttgtccaggcgtaatacttttataagaaaattctcttttaaaaagtggtaagtaaccttaagtctaggtaaatattaatactacagtactttcttgaaaagtcattgaaccatggagtatagtttctactatgataagacaaattaatggtggtctatttttagtatccataagaaatttatataaagtttctttgcctccaattttatttttaaatgctctcaaatgagttatgtgacctagcaatatatcagtattgcttattcttgagtaataggtttctctgtgattgtttgcaatctagtgtgctatctactaacaataacggattcttttatagtttaaaaactgctatttcactgttaatggtggttttacatgttgtggaaattaatttcctaatcattttacttatttgatcaaattgaaaatcttaactatattttaaaactttttgccacagcgttttaccaacgaggatcatttggctgtccataaacataaacatgagatgacactgaaatttggtccagcacgtaatgacagtgtcattgtggctggttagtatatgcttttattaatagcttgtatacatatttcacctggaatgtgcacaatttttgtgtattctctgtaaataatatagtctggtgatattccaatgacttcattatagtaaatgttggcaacatgtattttacccattacattttcatgtttccttctgactattcatttcatttttttgtgtggttttcaaatttatattccaatgtcgattttgtggaagttcattagaactctgggaacattcataccatctacaaattttacatttaactaataattgaactaacatggtatttagtcagcatttcttttagctgtcttgtacaactgacttacaaggctgtgtgaagatagaaaatgatcaagcttctcccattggagaaagaacagtgagcagacttgttcattagagttgtttatatttcttttcagactaaacatttgtattagtaaaatattctcagtaaggaggctctaaattcagtcaatgc

SEQ ID NO: 97451 - DNA, 1673 bp, Homo sapiens
cataaccctttgtatatgtctacttagtttcttaaaatacattttggaactagaataactggatttaaatgtttacacgtttctaagtttcttcgtgtattttgccaaattgttttttaaaagctaaatcaattttttatactcactcataattgaattctcactaatagtgatgcttttaaacattaaacatttgatcctgagtattattttaggggggcctgtgttcgtaccctaagatacttaaaataatctctttgcaagtattactgatcaaaatataacctggctactcatccatttgttaaatcttgctgagaacagaaatggtatggtctgtttttagatttatataatatttcctaggaactacttagtaagaattggttttagaagcatcattttgatggtgactgctttttcacaagattgctttttcacacagtctttttaagtttcttgttattttttgtcaccagtaagcaatgacattattctgaatttgagtttcagctttaacacaatggtcttagttaaatttaaggtttcaaatagatttttacaatttaaaatctattttggtgacaatacaacttcagagagagtcctatagaaatgattacaaagagtttttaatactagacttgtgctattaaatcttttcttgtatgcctcagttactcttaggttttccacatgcctgttaatttcacttgttttaaagtgatgctccttggaatttagtaaaagagacactgagataatttggtgaaagattcatttatctttgttagtcttccatatacttggtagtatctttgcttttggtgccccgtcattgaaaaatgtttctttggtagaatgtttacacattataagctgttttataaaggagataaagattcattttatatttagtctaaagtgacaatggagatgtatgtgtgggagtgtgtgcgtgtgtgtgcatgagagagacagtgaatatatcagtgtaacttcctgctgttgttcaatagtccttaaactagtgaaaaaagtagtgaaatgagctattggcccaatggcttgaaaacttatttgtgtctatctaatatgtttaaaaggaataataatatatcatggatatgagtgtatgtattaactatagaatgactgattttttaggaagttaattctggtgagagtggtcaagccttagtaacacagatttcccagatatcagaacttaaattattatagaagcaactgatctaccttcttcccatctgacaggttaccctttctttttaaccttttaagagagattgctacctgctaggcacctatcaaaaaaaaaaatctttttttttttcactttttccattgtttattgagctatatactcaaggtcttagtcttgtttaacaaaatacttgtgtttctttgtatatctacagtattttctttggggttgtgctttgaaatgcctggaagaatacagtttatgaattcagtatgttggtgttgctagtaatatagatatttttacaaaacttattcttggaatataatttgactgggaagacatttcatatagattctgtaaaaaaatttagcttgcagctattttataaataaataaagaatgcatttctttcatattaaacttctggtgactgccttttcacaag

SEQ ID NO: 97452 - DNA, 1917 bp, Homo sapiens
ggtgtaaatttaagaagggatttaagagtttgtttttagacatgttgatgttttggtagcatatttaggtagaaatgtttaagccaatagatacaaatattccactagaatataggactggagatggagattttgccacattattttcataacagtacagtaggatccttggaagactgcatagtatttgctcatttaattttcttgaataaatgaaatgtgttcatttcaccataagtacttttacactgttgagcaggaaaaagtttgcctgacagagcagtgttcctaacctttttcctatagtgcaaaatctgcatgttacatgtattttatctactctcataataagaaagatagaattaaaatgtcagaaaagtgttttattttgtattaaaatagaaaagttaataagcttaatgaaaaatcttgagatttatattttaaattattctttattttaaaatatgtactctaaagtgtcttctgtttgattataggcaatacaaggacctgtggaatatgagtgatgacaaaccctttctatgtactgcgcctggatgtggccaggtaatatataaattactttaaattattttgtatatttccacttattaaaacattgatgatataatatgttatcactaaaagtattttcttacagtattctgtaaaattttagagttaggatgaaaaaaaacccaggaaacttttggcaagaaattctgctttttcttcaatagtgcaactgagctttagaaagtataatccaatacggagggggggagcattatatcttgtaatggaaaggtggaaatcctacacaaaagtccaagatataaaagtataatttgactgttattggttgaaaattattgataaactgcctaattagaaatcagatcgatattatatgagaattattttgcttactgaacttttatgaaattaactggtatttacttcttagagtatcactaatgtattaatgttgttaagcctaacgtctttaatattgggcatgtggcagcagtttcagaaagtaatattttagtttttttttaacaacccactaaattattaatctattcctattatacttatcttaaaataactatagacaggaagaattaaagaataaatgtaatgtatagcaaagttacaaagtacttaaatatacggaccataaatgtaagtaagcattattctttctcatttattttctttagttgatattttaaattgaaatataattgacttacaataaactgtatatacttaaaatgtaccatttgataagttttaacacacgtatactcaaaaccatcagcacaatcaggatagtaaacatacaatcacccaaaagtttcctcatgcctatttataattcctcttatcccacctaccttcatcaattactggtctgccttctgttactgtagatttgtttgcattttccagaattttgtataaatggaatcatatagtatgtatgttttttcactccacataattcaatatttctccatgttatgttaccaatagttaattccttttcattgagatataatatttcattatctcacaatttatctgttcatctgatggatattggtttacttctattttttagttgttaataaagctgatgtgaatacttgtgtacaagtctttttatggacacatgctttcatttctcttggaggaatacatgggagtataatgatgggattatctgatagatatatgtttgactttttaggaaattaccaggctgcttttttcatgtgtttgttggccatttgtatcccttacattttgtgaagtatctttttaaatcttttgctcattttaaaaaattgggttgtctttttattattgagttgtaggagttctttatatatcctggataccagt

SEQ ID NO: 97453 - DNA, 2014 bp, Homo sapiens
atagcatttaagcctcccagaattgttatcgtttctgtctcagggtgcttgaactgttaatatttataactctcttagctaggtattagaaaatggtaataagggaatggagtttttatttgttggctaagaaatgggctgctgtgtaggtaagaaacttgttttgtagaggagggggatagtatagtggagagtagaaaagattaaggagaagggtaccaagggctaactccctctgaaagtttttctagagctatcagattgatccctccactacctctctactctcataatattttaactcttattcctaccaaattaattgaaaattgtacttccatattcctctttcctctagactgaaagtttctcaaatgcaaggagagttttcttcatctttgtgtctgtgtatagttgatgtttaaatattccttgtactaaactgagctaggcgctgttgtaggtgttaacccaaagataagttccttgccctcatggagctcatattctacttgtaatgacagaagcatggctattacagatttccttggatttttctagtgttctttttcctctcctcgcagacagcatggtaaagttgaatgtgagtgaagaaatggaaccctctcagataaaaattttgcatgggacaagggaagaaactttctctcttcttatttcctataccagatccacctttactccaggactctgaactttggctagttacacatttccccacaagaattaccaaatttttctgagcatgacattcttgaaacttcatttatgaacaaaattatgaaaaatgcaattttcctctatgcaccattagcttatttggataaccacatagttactcttatttaccactggatgaggtttcagtgaccataaggtgaagccattggtggagttttaaaaatgggtcatcaatctgagtagtttcagtatactgtacttgtccttaagctgatacaattggagctgtttatatagatcaactacattgtgggacaaataaattttgatgaattaggctgagaagctgaatatcagtaagtacattttttaaaattaaaagctttctgaagagaaatatggaattactaggttgcatcattctcatcagtgttcaaagtaaggatttttttactcttttaatggctgcccttcaatcacagccctaagggctgaattaaatgtttcttccacttttaatccctttggtggagttagatatgttaatacctatgtttaggatatttgtgtaggtgtgttgatatttcaagagcagtactctattataaaaattgttaatagtgactagttttggggtgacagtagtgttacagagagtaatttgagcactttattttctactgtttcaagaagtgtttcagaactatttttaacagtgtgaaaccactttgtttttcagtattcttgccatgagaaaaagaatgtgataagttattcaacttatgaaattcaagttacatgtgaattctgccaggtatgtgtgcaatatttggtatttttagccattttttacattttgggttgtaaaaatctttatagcttgtttctattaggtaagtatttgtggtgtttttttccatacaaaacaagtcacttacttagtatgtagtttagctgatactcctattttgtttttaaataatcaaattaaaagcatctaagtacacttagctatgacagacataaacatgttttaaggttttgatttcctctaaaatgagttctatcagtcccatgggatgttctgtgaaaaagtattcaaatagcaaatagctttggcaaaaatgccatactctgggtgctcccctagtcattttacattagcatattaaagactgtgaagagtcctgccaaaaaaaaaaaaaaaaaacaaagaaagaaagaaaagtatattttagcatttcccggatttgtttggccacacctttttttctttagtgtctactgacatccccgttgaaatgttttgggg

SEQ ID NO: 97454 - DNA, 1012 bp, Homo sapiens
aaagcagaacaccaattcttaaagctatgctttgcctttaatagaaatatttgtaagacagggaaagccagaagcttgagggttaatggtgtcttgattaatggaggttttaaggcactcttattttaaattatccatttgttttgttccatggaagcttctacaacctagggcaactcattctaataagatttgggatggggataggtatggatttcttgtgaaaagtgggagaatgagggctctgggaaagtaggcagatcatctttgggaaagcaaacaaagggaagatgaagatacagaagctgattttcttaaaacttgtcttgctcaagtatcccttggaaagccttagtgtgtacctttagtaatacataccccactttgtctgtatcccatactgcctccttgaaagactgtccacctcctgcctacctcctgtcctcccacagggacagaagctaacttctctccaccacccaggattgcccttgcatctgttacacacttttgaggccatgcccaagagaggattaattcctttctcatactgatgcctactttttgggccctgtttcttgtcacagtatttggctcttaccaggaaatttgccattagcagtgtttgcacatttcagcagagattctacccacaggttagtgatatccaaatatagccatttgctgcataacaacattttgagtcagcagaccacatataagatgtggtagccatcatgatatagtataacacattactcacatttgtagtgatgttggtgtaaacaaacctactgtgctaccagttgtataaaagtatagcatttgtctttcattaagacaaggaaaaaatagcacaattacgtacagtatgtaatatttgataaacaatgatgttactggtttatgtatttaaatatactttttaatcattattttggagtgtacttttacttttttttaaaaaaaagtttattttaaaacaacctcaggcaggtccttcaggaggtat

SEQ ID NO: 97455 - DNA, 1031 bp, Homo sapiens
cctctctcatgtctgctgtgagtgggggaaaaaatactgctgctttccttgttaacattgggcttaatatttttctctcagctgatgaatttgagttacctaaattgatgaactaaacattatatatcaaataaacttacagatagcatcagaatcatgggttaaagattaatataaaacttttttttttttttgagacggagtcttgctctgtcgcgcaggctggagtacagtggtaggttctcagctcactgaaccctccacctcccaggctcaagcagttctcatgcctcagccttttgagcagctggaactatagtctccgccaccacgccccgctgatttttttgtatttttagtagagacggggtttctccatgatgaccaggctggtcttgaactcctgacctcaagcagtctgcctaccttggcctcccaaagtgctgggattacagggttgagctatcatgcctggccaaaactcttatctaaaagtcaaactgagtatgtagttcagtttctggccttaaaaataaagaagatagtaagattaggtatttattaggcattagaaaaatgtacatttaaagtcaaagtaaaatgcagtaaaatttatgaacttaataaatactattttagtgtcatgcactattctgtgtattttacatatgttacttttatatattttgatagccctgaaatgtatttttttttttactgtagaggatcatagtgtaatcatacaatttaaaattttcctggccaggggcagtggctcacacctacaatcccagcactttgggaggctaatacaggaggatcattgccttgattaatggaggctttaagtcactcttattttaaattatccatttaaaatatccacttgggttcctgtagagatgacctcagtttccagtgttccccccagacgtttgcttcttgccgtaggatcaggaagctttaaggcactcttattttaaattatccatttaaaatatccattttaagttatccattttaaaattatc

SEQ ID NO: 97456 - DNA, 1897 bp, Homo sapiens
caccgtgttagctaggatggtctcgatcttctgaccttgtgatccgcccacctcggcctcccaaagtgctgggattacaggcatgagccactgcacccagcctgcttttatttattaaacgtgtcggaacaatttttttatatatcaacttgttttgccatactaacaaataattgtgttcattatttttgttttcttctagtttgtgcatatatattgcagtttttacagaattatatcaaataagttttattttacttttatagcattgtatttttccatgttgtataacctttatgatatttgattgttacttgatagttgaaaaataagtattaaatttgttctaaatgcctgacaggaaaataatagttttcagtttatgcctattttgacattgaattgaacatctctgtgcattttttcttttatgaattgtttctataggatactaatctcaaatgaattactagtcaaaggatataaatgtttctacagttgccagatttttgcctccccaaagacttgagcgagtttacactgtcagcagagcatgaatgcgttagctttgccatacttttgtgaacttgggagttatgattaatgaagcgtgattacctaattgggaattatttctgggaataagttgtattatttagcagttttaaaattatttagttggccatatcatactatagttatttatctaccagtgatctatgtgatgtgacaaatattgtgtatttcatattttctgacattttactgtctttgtttcttttaaagtttaccaaaacttttgacagactggtaacaataattcttagatttcatgcagttttatgtggtttgtacactgagtattttaatgctagtttaagagttaatttctgggctgggcatggtggctcatgcctgtaatcccaccattttgggaggcctaggcaggtggatcacctgaggtcaggagttcgagaccagcctggccaatgtgagaaaacaccatctctactaaaaatacaaaaattagctgggcatgatggcgggtgcctgtaatctcagctactcgggagactgaggcaggagaattgctcgaacctgggaggcagaggttgcagtgagccaagatcacgccagtgcactctatcctgggcaacagagcgagacggtgtctcaaaaaaaaaaaaaaagagttactttctgaactatacatttcatagttctgtcttatgaatgtgtcattatgatttattaagatttataatgacaaattcatttccatgtaggaaacacttggaataaagaaagtgtatatgagtatatgatagccaaattgactgagttttgtccctggcacatagttaagtgtgtaatcaatattttaggatagttattagaagccagattatcaggggtctaccacttactgtgttatcttgagtaaattatataacctctctgcctcagtttccttctctttaaggagaataatttaactcatagtcttgctgtgagcattcatgtgatatatatacaatacttaatacagtgtcaagaacttaatgagtactcagtttgtgttgtgggaattattattgaagttcattcagaaataatctagcctagccctccaggcatgcttgtgctgtagcttgaaagcagtacagcaaccatctacttggtagctttggcaacaaagttatttttccctaagaatttataatttgtggaggaacatgccaccttagaattttcgtaaattcatttgagagaatgtctcatatttttttgttccatatgtaccccttctcagacattttctgtatcaaattccttcagtatagcatatccttattttaagatgataaaattatgatactgtgattttcataaaatc

SEQ ID NO: 97457 - DNA, 1026 bp, Homo sapiens
cgagactccgtctcaaataaataaatagtagaaatggttgtcagcattttaacaaatagtggggttggggtggtctttattggtattcaggatctgaaagctctatgactatggtagaaaaatatgccatacatcaaacatctatctgtaagtagcattaactcttcaaaaaataatgtacattttttctacccaaatttttgtattttggaaaacttcggttttaatgatacatacgttcttgtctggtaaattgttagatcgtgttagatcaggtaaacaatctcaccaatgtgtgctttttctactaattttgtctaaaggctcttccttccaatatgaaatatacctataagtaggcatttctttctcttttttattcttactaaaatgtcattggagaatataaagtagttgaagtctcccttatgaaaaccagattttcatcagaacctctcgttaaaaattcagtgaatagcaataattaatattcaactgatttttataaaagtcaatgcatatagcacctgttgggttattttgtataattaaaatgtaccctaaaaaaaatcccaccttagccaggtgtggtagctcacgcctgtaatcccagcactttgggaggctgaggcaggcggatcagctgaggtcaggagttcaagaccagcctggccaacatggtgaaaccacgttggtaggcgcctgcaatcccagctactggggaggctgaggcaggagaatcgctagcacctaggagcaggaggctgcagtgagagccgatcgtgccactgcactctagcctgggcaacagaatgagactgcatctcaaaacaaaacaaaaaccaaaaaattcacttagtattgttataatctggagtttaatttagtatttctgtgtttatctcatactcacacctgttcctcaaggctaagaacttgtctaaaatgctgcatgttctctttatgtaagttttaatgttgaagtagtaggatagtattcacctatttctatttgaaggaaaaccc

SEQ ID NO: 97458 - DNA, 1031 bp, Homo sapiens
cctcccctcacaccgccaaagccctgcctagcccttcaccgccgcctgcacccgcgccctcctccagccgacagccaatcacagtcttccacagctccgggtttacagaagtaacgctccttgggccctctggtcccgccccctccagaactgcttcccgcccttcgggctccttgtccaatcatgagcgcccgagtgctctttgatgcccgtcccctctacccgccctgccgaagacccgccttcttctccttaagcctgacggaatcacctgactcggaggcgctccctcagaaggaaggcaagaaggggcgtgtgggtgaaggggaggggcgccagaaggaaggtggggatgccgggagcggggcgagcgggcgggggttgtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaaggtgagtaacgatgggcagaggtcagcagggctggagactgtagggatacggagaaagaaggcgctaacatggcgacgtcgctcagcacagtccccaccccccgtttcccatcacctcgggtgctcctgacgtgctccttagcccttggggcgattgtggctgtgctgccacctcggcggcccgcgcggtgtgggctttgggaacctgactggctgggccggaccgttaggtaaccagcgttcgttgttccggcccctccctctcgcgcgctttcctaaggcagaggaaaaaggaataacggctccctcttagacccctccctccgaattatcttcaccctacttgggtcagttcagaggtcctcggggcgcgcgtcgagtcagccgtgtgcgcagggagacctctcccacccacagtccttgggttgggcggggagagggcccactctggtctccccacccagtattcaagcgattgaggaccgtgtattggtg

SEQ ID NO: 97459 - DNA, 3018 bp, Homo sapiens
tattcttaaactgatgtagaattgcttaagttccttttttagaaatttttttttatgattaatggtcatatagaaatagctttgaaatggtcagggctattaactgctgggctattttgaatgataaatgtttattgtgacgctcctaatatacttgttggtccacttaaaattgccaaagaacgtgtggtatttattgcttttttctgacttgacttacggcactacaataatggaaatgtcaaaagcagttcttactctctttgtaactgttattagaaattttattcaaggtagcaagcgttacaatttcattagcatgaaactttattaaaattgcttatgtattaaaaatgaccaaacagcaaagagtcaattcagaagtttctgattcatttttactgcttgcttttttagaattcatggtaccagaaaagtcattgaagtcttacctgtattctttcttaatattgaaatctttatttttttttcattaatagatccgagctggatccagagttgcatacagaccaatttctgcatcagtgttatctcgaccagaggctagtaggactggagaggtaatagtagcaataattgaaattaggtaacactaccaaataagggtagggttttgattagagtgaaggaaaaaaactttattaataagagtttgagggcaagtctttcccacccttttatccaaaaaactagatgagccaaatagccaaaaatagccaaaaaactagatgagacgaatagagaaatttctctatccaaaacttggccaagtatttatattcaagtctattgatttaagttgcctatatttaaaattataatagctacagttattgaaaaatgtactctattggactggatgcggtggctcacacctgtgttcctagcactgtgggaggccaaggagggaggattgcttgaccccaggagttcaagatcagcctgggccacatagtaagatcctgtttctacaaaacatttaaaaattagcccagcctggtggtcacctgtagtgttagctactcaggaggctgaggtggggagctggcttgagcccaggagttcaaggctatagtgagctatgatcacaccacactgtactgcactccagcctgggtgacagaccaggtgagaccttgtctcttttaagaaaaaacaaaacaaaaaaccctactttatttaaaagcatatttatatatgttgtttcttaattttcaacacccttttaagatgtagatattgttatccctgttacacaagagtgagattattctaagctcttgatttgtctctttacactcagctacaaaataaaaaagtagttatcattttgacaatatggtatttaattaaaatagctacctgtggttactgatacgacctttacctttattttctgttttccagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttggggtgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacag

SEQ ID NO: 97460 - DNA, 1095 bp, Homo sapiens
gcagccaactcatatcaaaagttaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgccgcagcccgtgccgccgccgcctcctgggaaggtaagtggagggcacagggagcccggcctggccagggcggagcggcgcccagtagggacccattcattgtgccggcgcctcactgggcacggggcccaagctgacggcgtgcacgggagcctgcggggcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctggtgcgtagcccaggcagggtcggggggattgaggggtgggcgttttggcctagagcgtccacgttgttgaatggggcaaccttcgggcggggcacaccgccctctcgggaacggctttctccttacctattaacccattgccgttttcttcctaatcttagggcatctcagccctctccttgccactagggcgaggcagagcagccgaggcctagctgtcaggcctcactcggtgtaggtcaaactctctggtccctagaccaggagtggccctttcccccaccttctctcagcctctctgttggattggggtcgacgcgaaggttggagtactgcagaggatgtagggggccgttgaggcctagttcacctcagcagcgctttccagtgcctgtctgtaggtcaaactcgttgctgcagagggagggactttgcctttccgtgtgggggcggaggaaggtggtgggggaacgagcccaaagtctttcttcctgcctctg

SEQ ID NO: 97461 - DNA, 1115 bp, Homo sapiens
tctcaagtccagggattcctatacttctcgccagctggttataaactgggagttcccatgactcgctcctcaggttcaacactttcatagaatgactcagagaactcaggaaaacactttacttcctattaccagttattataatggatacaactcaggaagagtgaaatggaagagatgcatagggcaaggtcagggggaggagggtgggaagtcggaccttccatgccccctccaggcacacagctctcccagtaccttgatgtgcttgccaacctgaaaactctctgaaccccatatatatatatttttaagtaaaggtatcattatattgtcactattgattaaatcactgacggttgatgataaactcaatcttcagcccctcttccctccccagacgtcaggtggtgggctgaaagttccaatcttctaatcatgcctaggtctttctagtgatcagccctcatcctgaagtctcctaggggcctgagccaccagtcatcactttggagagcatacaaaagacacttatcacttaagagagtccaagaattttaggagcatacaaaagacactcatcactttggcgagtccaagcattttaggagctgtgagccagtaactagagacaaagaccaaatatctgtttcccattgtaccacagaactcaagatttatttgtggcatctgtgtctcacacatttttttttttattctaagggactgggcaggactttttaaagtccgaggcctttttgggggtgttccttcctggctctgctcatcacctaggtatttggaaagggtgtcaccttcttttcactgacttagtgccatgtaccgtgcctcctccatctctacatgcaggcagtgggtttccttcaacagcagaagtccttggtggtccacagagggctgggacagtatcactgcttgctgtacagtggtattggggactagaacttctaccatacatgctttgccatcaacacaaattaaggttttcacatcacatagtcctgggaagtcctgtgtgcttctgcttctactgtatgcctggcccctgctaggtcccacagcatctcatctaggtgtgggatgaccctatactg

SEQ ID NO: 97462 - DNA, 1052 bp, Homo sapiens
agctctactgttttagaagggatcaattatattactgttatttcaaaaccaaaccaaaccaaccccccaaaaccttttgcctctaagtacgtgtaactctggcactgaaaatgtagacatcagcctgaaatgtttggattatggtttctgattatacagtcagactccaaattgttgccagtacatggagggacagctccaggcaccgtctcctgtcctgcaggaacacatctagaagcacacctagcccaaagggttccagaatgggcacattttccatttctgctgagaggcagtggttcataaatatggtgagaagcacagaatgaaaaggttaaaccagtacattttggctggatgaggtttaattaggagatgatttgcgaggaccattatgtgtgtgctaaatttactgaccttttcccctcctgtatagaatgaagctctgtgctctgtgctcattatctttaaatgttttcttttctctgtatcatcacctcattcattttatttggtcattttaaaatgcactaatttggagcagtaggcttcattgattcttgggaatagaacattcagtaggcacagctctgtaggccttgggaaaacattttatggtcatatggggctctttggcatgaagatgggcccctggtcatgttggcaaggatactgacaaataccctcccacttctctgtaggtagcaggcatgtctaaaggccctacaaacaagttttaaaaccaagtttaagtagtgacttgccaattcttgtctatttagggacaatgatctattttgctgattaagaagagtgcttttccttctattctgtttgtcagcctttggaccaattgctgctctgtggcaacagtcccaagggcaggcaggaaggaagattttaaggcgacgctgggcattctagaagcacctaactctgctttgtctgagcatctgaccgcagggttctccaaaatgcagaaggccttcttgccttagagccccttaggtccacccagatggcaaaaaaaaaaaaaaaaaaaaaagcagagg

SEQ ID NO: 97463 - DNA, 1051 bp, Homo sapiens
ctacaaaaaattagctgggtgtggtggcagatgcctgtaatccccactgcttgggaggctgaggcaggagaatcacttgaacccaggaggcagaggttgcagtaagcctagattgcgccactgcactccagcctggacaacaaggtgagactccatctcaaaaaaaaaagctatgctgccatctgtaagactgttccacctcatatttgatgaccagacatttttaaagtatcttataaatcccgttttgtagacaatgaaattgagctgggaaatgggtgatgtgtacgtgcttggaaagataatccatggagagacagtacaatccagcatcccatgggtctcatctctgcacttagcactaattcgcttttcaggagaacataaaccaccttagtgtcctgcatggcactgtgatgaaataacgggaatgtgatttttgagccgctcaataatggaggagatggaaatcttcccacctcatcttgcttattgctgattgtacacacaacacttgcccatcaagatcatttttgaaagatgattacttcagtgtgcccaggcctgcaggacataagtacgtgggcagtgatggtaagagctataattattcttaatgggaaaatatgcaggtaatgacttggatgatcatgtgtctgtaatgtataagttccaaagcccaatgaagtaattaagcaatctgcaaacatgcagggggaaaaagcctgaagtgaaaaagaaccagaaaagaagagctctttcatctatctatctatctatctatctatctatctatctatctatcatctatctatctatcatctatctatttatccatctaccgacctacctgtcagtcttgcttgcctgcttgtacaggcaaatatttctaaatctcagagtactgagtattcattggaggccagttattccaagttatcatttcaaagggtagtatttattctttatgaaatgtgaatttgcatgtagttatatctttattgaatgcattcacatatataaaactccatctattgctcaagagcaacag

SEQ ID NO: 97464 - DNA, 1069 bp, Homo sapiens
ttgcctgaaatgtttatcttatatacagtatatcttcccttaaaattgagaaatcctatcgtggaaaaacattttaagctgtcagttaatttgtaaattattttgagtactgcaaggtgatgatgttagaactttgtaacacaggctattggggcctcctgactttcaccccttgagactttccattgtttaaaagaacccaattccctatgttaaatctcttacaggttgaaaaactgagagcagtttctgtttgttgtattaaattctgacctttacactaggccagtccacttataacagcagggacatgaactcttagaatttacctgaaaagagatagaaatgtgttgaaaccccagaagcattgtatagggtagttagtgatacttggtcttgaaattttctaaaaaaggtgatgagagaattagtttcaaatgattaagcagtatcatttaataaaatgcctgcagggccgctcagaaagactatgttctggagataataatgcgtcagttattcttgagtacaggagggcaagaatggaacccaggaggccccaggttcgaggaaagtagtctgagggcaccccagactggtgggccatagtgagagttgggtaagtttgatagttcttgcgtagcatcactgaacacgttaccttggctggctacatcaatggtgaaagttggttatgaaagtgtttgcatcacattgcaacagtggggatttgccaacgctggtttgactggcactaagcaggaccttgaactcattcagagtaaagtgacccacatgttagctggccccaagggcaacctccatgattacctcctcttgtcactcctttaaattcatcataaggaatcttatttgcacgaaagcatttgtgaacaatgcagattttactgagggtttcataggaaagagtgaagacaggatttacattgcacaaatgagtacatatgttcctagacttatgatgcttcaccttataatggtacacattcaattgaaagtgtactttgaattttgatcttttcccaggttggcgatatgaggtacagta

SEQ ID NO: 97465 - DNA, 1034 bp, Homo sapiens
tatttgagttttctagatattgccaagtcgctatccacaatgtgtgaactactttgtatccctaccaggagtgtatttctgttttgccacatcctgcacaatgtatttctattttgccacatcctgcactttaaaattttttgtcagttaatgtggttctctaaggtttttaatatcagaagagtcctaaatggctttttaaggtccttttcaggtctaagaatcgattcccaacacacagaattgtatttcactatgacacgtctattctaccctaattaaattgctatttcattagtgcttgactttaattgtagcctggtactgcgcccatctcaggcttttgaatgttgatatttctgaaatttctggtgaaggaataaaacaaaattttattattctcagatctttaatgccagatacatagaaagaatttacaacatggcagaaatgccatgtgtaattcttgccatttgggtaaaaaatagtgtatggcatctaatctctgcaagacagaatgtgtcttttgtggggccactagtcttctgctaaggggctttgggaaaattaaggaagccagccccaccctggcttactttctgggagtataatgggctctgtagtcttctctgccagtcctgattccagtcatcctacctgcctctccatggcaaagagggaaattcaaaggtcacatagacttgaaacaagccccaaacctggtaacctaacacacaaacagaaccatttctggattcattcttctcagggtagagagaagtgctcttaagaaatgacatcttggctgggcgcggtggctcacgcctgtaataccagcactttgggaggccgaggcgggcgaatcacgaggtcaggagatcgagaccatcttggccaacatggtgaaaccccatctctactaaaatacaaaaaattagctgggcatggtggcacatgcctgtaatcccagctacttgggaggctgaggcaggggaatcgcttgaacctaggaggcagaggttgcagtcagctga

SEQ ID NO: 97466 - DNA, 1066 bp, Homo sapiens
agaagcaaatagaaacaacctggtttggctgaattagtgaattaatatctagttatatgtgcttattttaatagaaagttgcagtcatatgaagaataaagaagtaacataccacacaaaaacaaagccaaaataaccagaagagctcccagcagggttatgttgtagaatcctcatcccgtgtgtctctttccaagtgccacagtggttgtaacctgccgggagggcttttcctcccttaagcttctttggtaaacaaaagagttgaaataaaagctgctgaatgaaaataaataaaggtttatggctagagaaacctgtctgtgtagatgaattaatcttatagagagtcccccaaaaagagaaaacagtgggcacattattgccaagtaaacctggctttttaacacctttccaggtaagctcagccaagaaacaggaagatttgtccagtgtcaggacagggctttcgaatttagaaggcttcttgctttacaaaatggaggcaaggtggccattgggccagagacattggaaggtggtggctcacggagattcactctaggtcaagtcccttataaaattatagggactccctttccccatttcaaactcacagaatgactgtaaaacttgtgtttatttcaggtgggtaactcctcccacatgagtggtctgcctaccctcaggaatattttttgtctgtggtacctcagcctatcattgtttgaatggctcttcagaatctatgtgcttcctctcattcttagtgcctcctatgaccatctacactgaacaagatttatacaatcatgtacctaagccccgcaacaaaagagtacccattcttccttttgttatcagagcaggagtgctaggtgtgctgtgtggcggtatcacaacctctactcagttctactacaaactgtctcaagaactagatttatacaatcatgtacctaagccccgcaacaaaagagtacccattcttccttttgttatcagagcaggagtgctaggtgtgctgtgtggtggtatcacaacctctactcagttctactacaaa

SEQ ID NO: 97467 - DNA, 1071 bp, Homo sapiens
attaggaagtcaacacaaataaattacacatgcatgtaggataggctggtatgggcagcaaagaaataaatgatcatcaaataatcatagtgtgtgaacaggactttgtattttatgttgagctcactggtatcagatttttatgctctacactcaggacctctcctatgcttggagcttcagctaaagtcaaggcaaagattgcattttgaggaggagattgtgtgtgtgtgtgtgtgtgtgtgtgtgtttgtgtgtgtatcggggagaaagtaggaggaaggcagaagaaatagcaatttagtttgaaagaaatggagaagaaaacaagtataaaaatattaccaaaaccagtaacaaaggtgatcaagaactgactgtgtctgtaattattttctaggtttttttccattagcattatttttgtctaatgttattaaattatttttatattatatgaatatgccaattaagggatatggacatttcaagactaggcacaaaggcatttttcatctggtaagtgatgagttttgcttctttagaacgtgtggccagggtagaaattcttagtgtttttaaagcaactatttgaaatagctcattcacgcggccattagtcttttcaaaatttatttttaaggtagctgtggaaaataaagaggaaaaacactgggcaacattcaaaataacattctcagacaatcctaccacctgaaatgaatgatttatggtacatttggcattctctactaccttttacattatacttacaatataaactgtagctctttcatcttttaagctgtcagactaatttcaatatgcacattgaaaaatgtgctgaggtgtttaagaggtagtcaattctttattataaattaatttttcctttataatttgaaatcagaattttaaacattcagaggttctaaaccagtaactcttagtttaagcaaggtaccttttaagagccctgaaaaacctagttatgtgttaaactctatcttagaaatcttgaaaagcataggatattgtttttaaaagtggacatgtggagtatatgtttta

SEQ ID NO: 97468 - DNA, 1048 bp, Homo sapiens
taagggagagaaagctttattggtcctcttacttatttgaatgtgaaagagagttgtttggatatttttttgataatctaggaatccctggcatgagtgccccactttgcagacaatgagtttccacctgggcctggacactcggatttctagagattcattttagcatccatttaaacggcttccataaaaccaactttcatttgtgctcaagtgcttgatactaatgttgacagagaaacatcccaccagggaactgaagtgagtgaaagacaggacatgtagctttacacacacacacacacacacacacacacacacacacacacacacacacacacacacacacagctttcctgtttggtttgccctctttgtcctgcctctagcctgacttgcctggtctaggccctcacttgcctggaatgattataggctctcacacttgccgggtgcagacctgatagggccaatgtctcttgcagctgcagagcccagtcaaaagatcactgagcttcagtgctggcctagaaataagctgggaaagctctctcctcaggaccttataagaaagaagaaaagaaaagaagagaagagaaggggaaggggaaggggggaaggaaggaaggaaggatggaaggaaggaaggaaacgaaaagaaaagaaaagacaaaaataccagattcagtttacaaacggaccccatgtcagacaggcccacagcttatgaaattgcccttcccttgctccactctgatcttgatttccctcttatttccccttcatctttttgttgcttggtttgctttggctgtgggttgtaagaggttagggacacacactgaacaacctttttaaacttcccaatgattgtccaagagggtcacatccccaaagtaaaaaaccaggataacaaaatgtcagaaagactagaagttcccacaaacatcctggactgcaatgctagcaccttttggctgaaaactccacaggcatagggttggtcccacagaaacctgttagggaatattttcttgaaattgtggca

SEQ ID NO: 97469 - DNA, 1055 bp, Homo sapiens
ctaattcacttggaactttatagatggcttttctctttcccatcacagagcaaataacaatgctgaggaggttgagataggactgcactctgctcctctctgtgtactatttaattctaggcatgttttcagctggggatttatagcagaacaagacagtgcgtgaaatatctttcctttatttttaaatgattagtaagtaagaatgtacctctaagacaaagggggtatataaagtccaactgcttttgccagctgtgccaatttgcctaatcctagaaatctgttattatctcatttttaatctcaaatatgaagtttagttttaggaggatctttgcctaacagaaggaacaattgagatgaaaatctctgattcctatgaaatacactgctcttggaaaactttgcatggatttctgatatacacagagatttctatgaagtatgaccacacacacacacacacacacacttcagatcccaagacttcaagagacctcagagatagagctacctagcccaacaccttccttggaaaaagtcaagagccaaaaaggccaaatgacttgccaaatatcatacttcctgcccaagattgcaggcaacggcagtaaaaggaatcacaatgacagccattattaatttagttcgtactaagtgctttgcattcattaatttaggtctcagaataaccctatgtagctggtgctatttatcctaattttagaaatgagaaagggaaaccttggagatactaaatattgtccaaaatctaacagccaatggttttgaaaaccagtaaagatagttttcagagctataaggcaactctaaagtctatgtgcatagccaccctaccaggctatatattataccagaatctagtagatgctatcttattttaccataccaagacggcacctatactcagaagaaaatggaaataaaagtaagacattatgttttaaacttttatagctctttgtggttactgagttctaactaatattcaccctattatagagaaaaaaatgagcctcataatatgatct

SEQ ID NO: 97470 - DNA, 1027 bp, Homo sapiens
gatttttgtagtgtggggaattttgcaaatcttaaattgtttgaactattgagtagggaaagggccagataacttgttcttcacaatttaggcaaactccaattggttcctctgtctttttttgatccattgtccacattgctcttggagctttctaaaacacacatctttaaaaatattctgcgactcacttgtatattgcaattccgtaggcaacttgcaaggaagcccttcagaatcaaaaatcaccttttcagcctatttcccagtactctcctttatactccggccatagataagtatttcatacatctgagagatgccatgcactctcatatgatctattctttttaaactctcacttcttcaagacccagcattatctgtaatcttttgagtgacatcatcctcaacttttctaagcagttacttgcttttttgttgattgcactttatatactttatgtaacttgtagtctcctgacctcttgttatttgttctgtctacctccctcatttgacctaacactgaagataggccatgttccttaatttttactttctcacttttgctgtcctcaaacagaataacaggaaataaaaacaaaacctgtgcctgttacaggtatgttgagtggattcatataactgatagatctgactttctcagcatcaatggttggtgtgctgcttctcttgaaactcttacaaatccaggaattggagctagaaagtgagaaggactagctcaagacataagaatagggaaactgagcacattgagggtgggggggattcatgtgttttgtactctcaatgcctgacataggaaaagctctcatcatgaatgaattgaactggagatgacctcacaacacaggtgttcagggggattacagtacaggagctcatccctcattcacatgaatccatgatttggataaggtttctaacttgtacataaaatattttgtgttcgtttaatgagttcccattgttgaagatcccaatacccctcactccctgc

SEQ ID NO: 97471 - DNA, 2484 bp, Homo sapiens
ttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccattgcttagaccctttaatgactcttgagtgttcttgggatgaggtccaaatttactaataaggcctgcaaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttca

SEQ ID NO: 97472 - DNA, 4235 bp, Homo sapiens
ctaagacttccatattaacacatgtgcatataacacataatttctttgcaaaacaattttatttatttagcaaaactgacctttattatacaaggaacttaattagaactttttactaaggctggccttccctccagagtttttgaatcagtaacatttgtagtatatcgtaagaaatcatctatgagagtggaaaaatatgctttttttctcaactgatatggtttggccatatttctactagcaaaaatactaattgctgttttttacataaacaaagaaataccttaaagctagatttttatctttaatgtagaaattgggtggcccaaaggttgtctgctccagtcattccctcctccatcctgttctttaaaccttaaagaattaaaggcagtttattcaatacaattgttatattatttttaagggatttgaattcaataatacttagagagtttaaaaggagtaaattttcatgtagggactagtacccttaacttctgctatggagatgggattaaaagacccttctctttctctccctaacatgctaggtatgtagtacattctgacccagaggttaaatacagaggacttgtcttgcagagggatgaggagagactagtcatgcctttggaaaagatagaaacctgacttcccagtttttggataatagagatgtatatcagtgtaggaacgcaccatccacccacacccacacacacccacccacccacccacaaagtacacatttacatattactcacagggttgcctggacacaagggaaacagtttcttcaggaaatgtaatctggacattaatacatttgcattgtttgctggactattgtattatagcacataattctgttgggactatgatttttggacttcaactttcagatgtgtctttagtaacttattttgtatgaaaatatgggacattagaaaaagtatatttatgggtttttttcctctgaattactttttttttcttctatcatactaactgtaaagagagttatgtacttattgtaaaagattttaaggataatgttagacaattgtatggtttctttgtgtgtgtgtgtgtgtgtgtgtgtgtgtgtgtgtgtgtgtgtttatcttttttgcttgccttatttagcagttttaacgttcaggtattcctaaagttttgaatctttatcttttcagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttct

SEQ ID NO: 97473 - DNA, 1515 bp, Homo sapiens
tatcagttttacctttttttaaaaaagcattctttttatggtatgtgataatcattagagtactaggtttctacattgttgatattctaatgcagtgattttttggctagcatgtttacaaaatgttactgttaatattgtgtttttattgcccagttgtgtttgtctaggtctcatgcagttattttagtagaatatagtttttgtccaattggaaataacttcctaataataaaactcatggcatctaatcaatactatcaaaaatagcaagtgaaatttatataaggtaaaatttaacttgataatatgattttagtccttctctttcttttatgcaaaatactgttaccattaggttgcgctgaacaagggaaaattcttagtatttttgttatgctccaggaaattaaactatttgataatgtaaattttgttgtattccatgtatttaccagatccattaaataatctttttatacctttgtttatatttacttatgtgcagccttctcaagatatgtagtatgtttttgcatgtttgttttagacacagagatcttttggccgtctcactcccttttctaaaacactttcacttaatagtttagttttagatcattgcttaataattaaactcttggccaggcacggtggctcacgcctgtaatcccagcactttgggaggccaaggcgggcggatcacaaggtcagttcgagaccagcctggccgatattgtgagacctcgtctctactgaaaaatacaaaaatgatccaggtgtggtggcgtgcacctgtagtcccagctacatgggaggctgaggcaggagaatcacctgaatccgggaggcggaggttgcagtgagctgagattgtgccactgcactccagcgtgggtgacagagtgagactctgtctcaaaaaaaaaaaaaaaaaacccttaacttgtctaattgatttgctcagaaatggtaaataattaaatggtattctgtatgttgatgaatactagctattatgagtggttataatttaattgaattttatttactgagttattgggttgagttggggtgaaatttatacctttgtttcttaaatatgagttagccattttccttaaggcaggaaaatctcgtaaaaagtgccttgtttaaaacttgtgagttaaagacatattgtcaattttaatttaacacagttcctttgggtaagtttgtagcttacatagatagagggtactgatgtgttagcaaggcaaaaatatatgaagttgttttgctagactattatttaattttcttaagaaattattttttcaagaactagagtaaaaacctaaacatgatattctttacatgtttttgcatgtgtgtagtttataggtggggcagtgatattcattatataattacactgttttatgagtttcagttttctagctgagttgagactttgcccaaacaactggaagccaattgttactatttggtaaaacaaaataataataatat

SEQ ID NO: 97474 - DNA, 1028 bp, Homo sapiens
atcaaagtgaatttgaatacagatagctatgacagaggcctgtattcttccaacactgaatcaatgcattcatcttctccaagtctgcagcatcaccttcaaacaaaatgtcaatttttttcttttgcttaagtcgtgctctgagctgcatgctgtcacatgcaaaccatctgccttgccattgcagccttttggaactgaaaattaaaggatttcatactgaagatgcctagaggaaaaattgaagtcttttccatgactagccctgcttatagaagctaaagtgaatatctgtaagctaatagttgggacaaaaaaaaaagacaggaagaaacagtcaacacagtgaaaatcttgataatgagtcccatactttctgtcttctgctaaggtcaagatagatagttagcaaacaacacccagctatacctatccttctcatctaatctaggaggagcaataccccagacgtctcattttctgtctgaaattcctggaaagaagtcttactggctcaaacccaaccccaataaggtaatgttattacatgaagacaaaactggaggcagggtttgataactccataatgctaaaaactgaagcaacaattccatttggttaagatagtttctagaataataactttcatacttctctttggattcatcaaagtggctatgagcatctttttctttggctttccagaagattgaaacttttctcaagacatctaactcaacactgtgacacacagttatcaattccaagctggcttcctttagtaaacaactagaagtatatctgatgaacagatgaagctgcatttgttttgaaccccggtggcttatgagtatattgaactattaatgaagaccacatcatctcaatcatctactctttgctaacagacagtgttttagatttctgatttttaaatgatgtagatacttgaggtctgaaaaaaaaacttttctgctttaattcttatattattaaaagtattgcagtggctccttcttagcagcaga

SEQ ID NO: 97475 - DNA, 3113 bp, Homo sapiens
ctatgtcttaaagttcaccagtttttttgtgtgcagtgtctaaactgttgtacacataatctgtggattttttttatactagacattgtagtttttatctgtagaagttcaatttggttttaagttttacatttttttatgtctacttagcatactgaatctttagattctcaaacatatgaaatatagtcatagtcataagaattgttttaatattgtgtactaattcagtcattttcataatttctgggtcaattttgattgatttttcttatcagtgatattttcctgcttattggcatgtctagtaatttttaatctgttgccagagattgtgaattttaccttattcaatactgggttttaaaaattcctatacagtactcttctgaatactttacctaatggcctgtgtgttaggaggttctcccactctgattggaaatgggcaatattcttggccctgtatgaatgctgtttcttttcacctttttgagtagtttttttcctccatcctcagatagttttctcacatgcatgcaccagtcagtactctgctgaattctccagtagaccctctgcaaatctttgttgttctttctctgtgccttctctcctgcttggtaccctttcttgtgaactcaatatgccttggccttctcagaattctggctttgtctcctcaactgtgagagtctgctacatttcatctgggtttactttcttttcactgccgagtggaaactctctataggcaataagctggggcagttgtagggcatgttttgtttttagtcttctcagggaacaataacctacattgcttgatatccagtgtctttaaaactgttacttcatatgttttgcacagtattttaattgttttaggtgggacgttaaatctgactcctgttgctctattatggcctgaagtggaagtcccctgatttactatcacgtaggcttttaagagttggagcattttaaaaacatcagtttgtacagaactaagcataattttatttgctagtagttatgtaggaatctactacagaatctactagcaaaggtagttctaatatagcacatatttaaatatattttgtagtacagtatttttaatgaaaatttgaatgttcttcagagatttataagaattagtattttgctattttgttaaaaccttttaaaatttctaacaagtataggtagttcttggtaatggaattaaattttatgtgtatttcatgtatataaattttgtatgtatttatttatttaataggtcttcatcctccaggtccacctttagcaagacctattctcccccgagaacgaggtgctttggatagaattgttgaatatttggttggtgatggtccacaaaacaggtaatatttactaaggtggtagataaatgaaaatgaaaacaggatgtgtgtgtgtgtgtacacactagatgttttagttttgtggcacctattttctgactttagagcatagtggagtattttatagccctgcaaaagagtacatattcaattatttgacagtagaagttttgacaacatagtctggattaaatccattttgaaaaaatattaactctgctataacttttagagaaactggattatttcattgaaacttttaaacttaaaaagcaaaaacatagttcaactctgataggttctaagaagtggagctttataggtatcagtactggacttggtgatagtagtacttttaatgttaagagcaatttgcatgtatttatttctcaaaatgcttttccaattattcttaaaataactctaggaagatcgtatgatatgtacagagcaattgtcaaagtatagatttttaaaaaattcatcggataatagatgtttgacagcgctcctaattaatattatttaaaaaaaggaatgagaatttagtgtttatgtaataaatcgtatgttattcaaaatagaatgacatttgatatagcgaagtattcattgagtatatccacagagaactgagaaagtatataaatagatgtttagtgtaactgggaaaggtataagaatcatgtatagtaattaatctttgggttgtactaaacaaaattaaatatgtttgtttgccgcaagacatctcaggttttaataatattcattgtgaatctctaagagggttccaacttttccagccttatctgaccacagatttggaggctttcatccccagcactatactctgggaaacaccaaaatttaagtgttcagttgtcaaatatgtttctgctaatttaataaagatatattcatttaactgttagtttattttaaatttgatgtataaattatatttttaaatgcttgaaatttgggctttggttaattttggcttttatttaatgaatattgtttgttgtttactaagtctcatataatttgttatggcatatttagctgtgttaaaatataaattagccatgatggctaaattagtctctgtcatgagctttgtttgcatttgtaactggtctgttcatttttccttacggtgtaggtatgcacttatatgtcagcagtgtttttctcataatggcatggctttgaaggaagaatttgaatacattggtaagaattattgggcaatgagatttaaatattttatgcttaaatattttattctatgccattttctatgcagtgtcattttattttatatactctctttgtatacattggttaggcatattatccttattttagtacatagagcaaagcagggaagacaattcaggtttcttcctatataatgtacagcccctaggccagttgttctcaaaccccactgtgcatcacaatcacccaaagagcttaaaataattatgatacccaggacccatttacaaagagtctcctttaatggactgagtatgaggtccaggcatcagtatattttttaaagctctgcagatgattctcatgtgtagccactattaaaaactactgtggtaaattgaaaatgcttctgaaatattatgtactacattttcatgggtaaatgtgcaagcttctggattttaaaatacctaatgattctggttactagaaatg

SEQ ID NO: 97476 - DNA, 1039 bp, Homo sapiens
ttttgttaatgtgggctagtagattttttttttttaaggcatagaaccttagtattttctgatagatattttataaagctctattaaatgaacatattctctttatttcatagattatctcttttcactgtggtggatctctaggggaagatcccattctgaagtgtaatagactatagtaccctccagtttcttttggagtgtgactggggcatggaagtccactgctttagcacagatcacattgttttatgtagatttccatgtcatattgttgcatatgttagtaaattatttattttgttttagattattctaatgtagattactttgttatttcatgactaattactaatatataattaataatgattttgaggctaggcagtagctgatatcaggtaatcagagtatttgtgtagtaaaatcaataaaaaatggaaatgtcacttagtacagtagatgtttttcctgttttccttcaaaaatgcagcataagattttagaagactaaaaaaactcttcatttattaacaaattaagaatactgactataaatgaaatgtatacaaatcttaaaacttttaaaatagttacataaaacaatacttttaaatttgacatataatgacaatacttaaggcagccatatattttatgaaattgagaaaagttaaattgattgaaaattactaatgtttctgttgttatctggttgatttgagatacccatgatttgtaaattaaaattcctggttgtttaatgaaagaacttttttgggtgcgaatgtatggattatatacatttgtatatctaacttattttaagcaaaaagtttagcaacatataaagtaataaaaattgtattgcacatgtaagaatagggctatagaaggaataatagcctagattttatgatcatgtaaatataacatgttttactgaagtttttaattagtttctgtgtgaaagactgtgtttaaattgtacattgtcaaaaatgtgaatgagttaaataatttattataaagaagatta

SEQ ID NO: 97477 - DNA, 1023 bp, Homo sapiens
tggagtagatctgttgaatgttttggccaaaacaaatttgccaaaaggatagcaataccataaaggagaatggaaatggtacctaatagtaaaaatactttttcagcatttctatgactacttagattaattactttgataattccagaatatacttattcacttatcgcttagtttttagttttttaaatcttgaaaaacaaatctgcaatttggagttttgactaattctgataaactttctttcctttattatgatgaggaagattactttaaaaagacatggcacataattgggtgatttcattttactggatttgttttgaaaagtggtatcagtagctacacttagatcatggcttgttgtgtaaacatgtacagttgaactgtaagttcagaaatagagtactttgttttcaatgtcacatattatagatttattattataagtaattttgacactacaatgccttttggggcgtaaaattttaataaatataaattgtttgtgatactggctaatatggtatattggaaattaagtctagtatgtacttactcttctcagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtaaacagagcacttaatgttatttacagtttatattgttttctctggttaccaataaaacgggccattttcaggtggtatggaaatggcatttcatttggaaatagcagagcagttatctgattaagcaggagttccatattcaattagccataactctttacagctggcaccttgtgatactgaaacctatttcttgagctcatttaactgttatggcttctttgtttaaatagcaataa

SEQ ID NO: 97478 - DNA, 1076 bp, Homo sapiens
ggctggcaagtgatatatattattattaatagaaaactttctgcttaaagatagcttttctgtatggacttctgaagttaagctgagattctaaatgcagcaggctgattagcaatcttaattctatctgcaatctttatctgccttgcatgtaacatatttacagaatggacaagaagatggggacgtttttgagaggccattttcctgtttatcactctaaataagttgggtagcaggcagttggaaatttaacattgaaatgcaagaggaaaatagattgatttcataggtgtttattaagctcatactctgtaccagttacctttcccacatcatgtgtctacagagatgtagttcctgcttattagcttttgattaaaaggggtatacacatgtaataaacggtatggtaaggaccaaaatgaagataggcacaaattacaatgcattataacttttaataataatttgctgtgagaataggattgaaaaagtactcttcaggtaaaggatttactccgtgtgcaagcactggaagagagaaacaacttggcacctcgaggcactacaaatattgccatatccctgaaaaaggaaagtaggggtcatatgaaggagggatcaaattatgaagggctttttctgcatcattatgtagtatagttctggagttcaggactttatcttatacacaacatataaagtcaatggaggctttgaattttacatcaagttagcattttatgaagaatacttttttttttttttttttagtaacatggaggttatgttggattggagagaatatgactgagccatagagaacaattaggaatatcatctaatatagttaaaagataaaggcctgtactagataaggttacagcaatagcgttggggaaaaagaagagatttgagagataattcaggagtagattgatacaggcaattagatttggaaagcggggcaggggttgggggtgggaggaagaatcaagatgtgacctacgtttttgtttggacaactgcttaggtgttagtatgttaagccagataaagaacataattggaat

SEQ ID NO: 97479 - DNA, 1076 bp, Homo sapiens
tttttaattattgggagagcaaaacctttgttgggataactaaaacagagtcctgaagtactttagttctttttctaaattttatttaaaaatataaaagggctaggcatgatggtttatgcctgtaatcccagtgctttgggaggcagaggcaggagaatcacttgaggccaggagttcaagaccagtctgggcaacatggtgagatcctgtctctacaaaaataacaaaaaataccaaagaatttcatttaatttagccctaaagaaaaataaattctgttttaccttttgaagtcttgaagacttgacatatggaaatgtctgttgtttgatagcttatgttatctaggaggaattctgataaaaaccagaggaatttattgtccacagagaggatttagtgagttttattttgaagagagtatatttcaatttttgtagtatttacactgacaattatatatgctttttaaaaagtatctactcatttaagaaaatttatacatttcctacagaattctagccactatctctgcaattccatctttttttccccgttttctttctctgtatgctttttaaaagtcctccttccagcctgctactatttcagtgggtttgcactggagaagtgatacgagacttttttattattgcggaatccttgagggttatgggcattatgcttaacctatattctcttatctcccttcccttggtaaggacaaagcctggtgttttttgtacttttaggtaattgtccaaatgccaaataggaatctggtgctagttatttggtgttttcatgtcacaaaaataaatcatcacaatattaaaaaaaagtgtattatctattcctgtgtaacagattgccccaaaacttagtagcttaaaacaacagatgtttattatgtctcagcttttgaggggcaggaatgttaagagctgcttagctgggtagttctatctcaggatcttttgttcttaggtaaattgcagttaagctgttggtaggggccacagtcatctcaaggcttaactaaatccatacaatcactgtagataaagtcattg

SEQ ID NO: 97480 - DNA, 1035 bp, Homo sapiens
tattaaatggtaatatctgattgagtttgaatttctttcacaatttgaaaagatttttttagtagaacaattgttctaaaccttcatttgtaatccaatatacctgaggaatattacctagtaatatgagtaataattgctctatatggcaatgttttatgattttctagtagatgaccatgctccccgaagggcactgggcatggagtagtgggtaatggcaagtggggcagggtttgtaaaaacgaaagaataactgctcaaattattctgaatatattcacctcaactctcttcccttcgttttactgctatatggtcactgctataaagcaattgacccttattttagaaatattttataatatagcactgtataggaggcgtatcatgactgagaattttgagagacaatttaataaaaagtttgtttattcagtcaacaagcatttatgggtaccagttgtttagacattggattataatggtgtatggtacataaaaatacaaaattctctgactgtatatcttagactgcaaacattaagtaatgagtatgatgaatgttataaacagaagtgtaaaatgctatgggagcatttaataggggcattgcctcagtctgaatactactataaaaaaatgtgtttgtttagtctttagtgcagggcatattttcaatttgaaactcctgaagcttgtaaaattataagttcgtatgtagctacaagagctgaaattgagtgctttcataatattgcaaaataattatctctgctactttctttattttcattttttgaaatcttttggaatgcttttatcccagaagtagtggattttataattgtgagccccttttccttgtttcccttatcttttttcataagaggagaggaaagaaaattacaaaataagtatgagatgtttagtaaatttaagcacttttaaatactcaaaaatgcactttacatatatttccatataaagattgattttttgatcataaaagacttgtatctagttgtaacagaa

SEQ ID NO: 97481 - DNA, 1032 bp, Homo sapiens
gcatatttgacaagatttgagaaaatttaattttgaaataaatgttctttaatgattatatcaaaatgtaaaggtttgtgataagttttaatgctgtctcttgtttctgtttgtataacagacaaaaccttcaactgtagaagttctagaaagtatagataaggtatgttctttggctgtgaggtattttaattcattttaggtattaagtaaatattattgtagtatatattattttggagaccaaatctggtatgggaatttagaaatgatatagagtgagtctgagaactttaatattatgtgatctcaaaaaatccaaagtctatccgtgacttaagaagtctgtttcaagtaatagagccagttagaatgaaattagatctgtagtgtggtgtaaatcagtgttacaggtaggacaaaatagatgagatactgtacaatagtttttatcagtctacaaaattttcacagctttttatatactattatcaaaaatgattattttctgggaatattgagagtgataaatagatgggttactgttttaatttttattaattatttttcttattgccagattttttaaatgccttttataggaggaattattacttatttgactcaacaaatattattgccgataccaatttcattccctgaatctttgccaatttgatagtttaaaaatagtaactaactttgcattgtaaaaatgatgttagaataagcattatacatttttaacttcatttttagttttctttttcatattatgttttgttttaaactgttagaatattatgctttactgaactttaaataagagttttttcttaaatatctttcctgctaaaattttttaacattttaatttctttatgaagtttgaaatttactaacatggaataattttctcttaacaggaaattcaagcattggaagaatttagggaaaaaaatcagagattacaaaaattatgggttggaagattaattctgtattcctcagttctctatctgtttacatgct

SEQ ID NO: 97482 - DNA, 1851 bp, Homo sapiens
tgttctggttttgaagaatggatttttaaaaggtgggcttggtggtgtgcgatggctcacgcctataatcccagcagtttaggaggccaaggcgggcagatcacttgaggccaggagttcaagaccagcctggccaacatagcaaaaccccgtctctaccaagaatacaaaaattagccaggcatagtggtgcgcacctgtagtcccagctactcaggaggctgagccacaagaatcgcttaacccgggaggcagaagttgcagtgagttgagatctcgccactgcactccagcctgggcaacacagagagtctccatctcaaaaaaaaaaaaaaaaaaaaaaaaaaaggtagactctatcccaataactgtctgaaatcaaattccatatatgtggcatccaaataaattaatatttcataacattttttaggcagtattgcaacatctatagtgggtatgctgtgtgtttaacttaacattttaaatacttgctttatttctagctgtgaattcctttggacaattgatgatatttatcattgtgcccagtttctacaaataaaagatgggtggattattttctcgatggagggtaaggtacttttctttacagctagttcttgagtctaatataaaagtgtcacataaagctatttgtgaaagtctcctttgattatagccttgaatagtagtttgctattttccttaacttttttcttctcttttgaattacttttctatttttttattttaatacttccatttgttctgtaggtgtccaatgcctctgtttaacagaattatttcacttggatgtatgaattatttttatttctgtatttctgtatttgtgtgcaaatggctatcttgttttcttatacttcctaagtttcaagcttatttgaaaggtagttgaaagtaagtattctaggccgggtgtggtggctcacatctataatcccagcactttgggaggctgaggcgggcagatcatgagttcaggagttcaagaccagcctggccaacatggtgaaaccccgtctctactaaaaatacaaaaattagctgggcgtagtgttgcgcgcctgtaatcccagctactcgggaggctgagacaggagaatggcttgaacccaggaggtggaggttgcagtgagccaagcttgtgcccctgcactccagcctgggtgacggagcaagactcagtctcacaaaaaaaaaaaaaaaaaaaaaaattctatacaagacttgttttttacagactgtatctttttacttgaagcttatcataaatattgactaaagtcacactgcctgtgcttttagaaattataggttaaacaaaattagaaatgcagtttgattttattggataagcttttagaggaagtatctcaaagttacagctcgaaaatatgaattgtataaattatataaccccgtctctactaaaaatacaaaaattagctgggcatggtggtgggcgcctgcaatcccagctacgcgggaggctgaggcaggatcgcttccatccaggaggtgaaggttgcagtgagccgagattgtgccactgcactccagcctgggcgacagagctagactctgtctcaagaaaaagaaaaaaaaattatataaatgctcttttcaaaagtaagaggagataaggtagtctaggataaactacttatttttttttactccttattaccataataatagagtctaactatacttggtacacaatttaggttttggggtattgctggaacagccttgttttggatcagcattatattgaccctgttatgaccttataataatctgcccaaggatcaaatttatctcttc

SEQ ID NO: 97483 - DNA, 1056 bp, Homo sapiens
tgcaaaggttattcggttcccatgtattttccatgtatttgaaagaaaggagagatggattagaaaatagctacaactacagcagtaaaaacagtttgtattgagcaatcactatgtgccaagcactgttgtaaacaggttagaatacattaggtcatttaagtctttcaacatttaagggggtccttaactatccctcttttacagatgaggaaattgagtagcagataggttaagtaactgatttgtccaagattttacagtaagtgatgggccacaggacttggagttaatatgtttgggtggaaaggagagcaccagtggttgaatacagaagaggtatgaaattaaagctatggagaaatatttgatttaattatttaattttgttgtgttttcacatctgttagaaagtaccacctattacatatgcattacagtaaaacagttcctttaatatcagaatttgatagaaaaattgctgaaactgtgctggttgactgttctttgattatgaacctgaaagcatggatatggcatttaatgactatcactctaatattgttttagagtacaaatttaaaagcataatcccttgcttcaggggtcttagaggctaagatgtagattgtttcattaataccaaaacaattctttaagcaaataattgtcaaaattggtatagtgatattatgcatatatttcatattgtacttactttaaaattgacatgcagtaaacaaataaaggctgtgcttgcagacttctagtaccagttctgtccctagctggagctacatgattttggcaaatcatttaacttctctttaatgcagatttaaacactcaaatgtaatcaaataaaggaattgggttacacaatacattgtactaatactatttcttgtgcttattactcacttttcatttcagtagatttgtttaccaacaatttgataatgtcagaggtggtttcatatattttacatataaatattcaaatctaatctatacaaagcagactttatttctgattttgtgttattcataataact

SEQ ID NO: 97484 - DNA, 1036 bp, Homo sapiens
ggactcctcaggacggactcccttccagatgcacccatctccatccttctcaactccccaacctttgtcctccccactcttcgctcgcgcggcggtctgagaccaccaggaccagtttcaggggtttccttctccagcgagacttggcagaacaggctttaaaagcaaaggaggcagcggaagagtaagaaataactatattctaagagtcataataaatggcagtacataactgcgacacgacaccgagcagcctaagctggctgcggaggccacaaacacaagatcctaacctcccggccgacccgccccaacaactacccgcccagggtacggtcacgtgacgggggagcggcgcgcgccgaccgcggcgccaattggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcaggtagaacgctcaaggcgagggcagttgggagggctctgcagcggggaggcatgctgagctgtgcccctgggaaataagctgcgggttccccgcttgcctctccttggtgcccccgcctcctgccaagtggcctagagctctgcggcggctgctagtcaggctgcgcggtggtccgcgcagacccaggctcgccgccttgttccctggatttcccagcacactggcagtggtggcgctggagtcttgaaacccttgtttcccctctagggctggtagtttctccagctcggttctaggagattccgggtggtgactggcttgagccccagctctttggcccacttgtgtcgagcttatctcgacacaggtggggcaaagaggtcagaaggtcccaaactagcatttcctacgctcagctgtccgctttgagcgttctctccgcttctctttctgagttgtgcggaggctccaagagttagaaagaccagaagggactgaaa

SEQ ID NO: 97485 - DNA, 1053 bp, Homo sapiens
agcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttaga

SEQ ID NO: 97486 - DNA, 1021 bp, Homo sapiens
atcagggcccatgaaggtaaatgcgcgacttcttggagaagtagctttggcagacaacctggcttggtcgggcagtaggaaaaggagtagacacaggatattcccctctcgcttctttttcttctgccgctgagggcatttgttcctttctggaaaataccacttggtaaggaggagggttatttggatcctggtgggggagggtggttaataaagccgccatccttgggatggattatttttctttctttctttctttttttctttcttaagaagaatattctggttgttcgcctgcttggtaaccctgaccctggcagaagaatgagggaactcattgcttcaaattgtcgccaagcccattaggctacctgaactgtctcagaaagtgcgggtggctgcgtcgaacggtggtggctcagaggaagagattggggccggcagcgacctaggtacctcactctgggtgggacccagaggttgtaacgttgtctatatataccctgtagaaccgaatttgtgtggtatccgtatagtcacagattcgattctaggggaatatatggtcgatgcaaaaacttcacgtttcttcggaatagccagagaccaaagtgcgacatggagactagaagcagccggcgctggtcagccgcctcgttctgttttattaccttggactccaggaggatcagctgcgcctggtgacatagagcagcttttcctctccagaagctcctcacctttaaacagagtatcctctgggtgctgaaaagaaagaaagacagaaagagagaaagagagagagagagagaaagagagaatgcaagcctaattggttgcatggatgcagggccaaagggctaggttttggggtactagggagtgaggtacaaggccagcttgcccagtcccagctctgccctccaggaacatgaggtgcaaaggtacccaaatgggggcttgcttgtatttggggcctgtgggaagaaagcaagcttcaaagaagcccagtggggagctc

SEQ ID NO: 97487 - DNA, 1063 bp, Homo sapiens
atagcctctagcttctgggctcaagccatcctcctgccccagcctccccagtagctgggactacaggtgtgtgccaccatgcccaactgatttatttgttatatttttaattttaggaacactttaataaagttcaacaacacatttggattgctaaaaaaatccaaacttgtaaatatttttctcccatacttctagagggctctcttagtgaagaagaaacagttatctgttagtttcatctggtttctctctcttattacgtctaagtaaatgtaaatttaatatttttatttaaaaatagcatgcataatatgtatccagttttataaaattatttctatgtaccaagttatttatgcaccgatcactcctaatatctgagtgtctacatagagctgtcaagaaagatgttcacctaatattaatgatggttacttctttttttttttaagttcagctttttattgaacacgttataaaagaggtttagtcaaaaagaccaaggcccatgtcatcatcagactccttggattcttctttctttgcttccactttcttctcctcagctggagcagcagcagtggagggggcaggacgtcctgctggtgcagcaccagctgctggagcaggtccaccagcccctacattgcagatgaggctcccaatgttgacgttggccagggcctttgcaaacaagccaggccaaaaaggttcaacatttacaccggctgctttaatgagggcattgatcttatcctccgtgactgtcacctcatcgtcgtgcagaatgagggccgagtagatgcaggcgagcttggagacggaggccatggcacgggcgagtgtagggcaggcgctgccggacgcggtgctagtcgcaggatgaagtgagggccttaccccaacgcggccttagcttcctcggaaggaccgagcagcttggcggcagctgagggaaggggtcggtttcttctacatagtaagattttgttgacatttttttctttgtagtgattttctgttttgcttaaaatttaaataattaaattcagaaataata

SEQ ID NO: 97488 - DNA, 1287 bp, Homo sapiens
gctcaattccctgttgaagaaatgaatgatagaccttatctatcatttatttgactcatgtgtacacccatgtatatcacagacatttttatttaattattcaagaattggcacatgagaagcattatctaattcctctgggaccttccactggcaaaaataaatgcaatgactgtggctaccagatgaattttgccctttttcttatatttgaaagtaatgactttattatttctgaatttaattatttaaattttaagcaaaacagaaaatcactacaaagaaaaaaatgtcaacaaaatcttactatgtagaagaaaccgaccccttccctcagctgccgccaagctgctcggtccttccgaggaagctaaggccgcgttggggtaaggccctcacttcatcctgcgactagcaccgcgtccggcagcgcctgccctacactcgcccgtgccatggcctccgtctccaagctcgcctgcatctactcggccctcattctgcacgacgatgaggtgacagtcacggaggataagatcaatgccctcattaaagcagccggtgtaaatgttgaacctttttggcctggcttgtttgcaaaggccctggccaacgtcaacattgggagcctcatctgcaatgtaggggctggtggacctgctccagcagctggtgctgcaccagcaggacgtcctgccccctccactgctgctgctccagctgaggagaagaaagtggaagcaaagaaagaagaatccaaggagtctgatgatgacatgggccttggtctttttgactaaacctcttttataacgtgttcaataaaaagctgaacttaaaaaaaaaaagaagtaaccatcattaatattaggtgaacatctttcttgacagctctatgtagacactcagatattaggagtgatcggtgcataaataacttggtacatagaaataattttataaaactggatacatattatgcatgctatttttaaataaaaatattaaatttacatttacttagacgtaataagagagagaaaccagatgaaactaacagataactgtttcttcttcactaagagagccctctagaagtatgggagaaaaatatttacaagtttggatttttttagcaatccaaatgtgttgttgaactttattaaagtgttcctaaaattaaaaatataacaaataaatcagttgggcatggtggcacacacctgtagtcccagctactggggaggctggggcaggaggatggcttgagcccagaagctagaggct

SEQ ID NO: 97489 - DNA, 1049 bp, Homo sapiens
taaaatttgccggaatgtttttcactgctttgcgtttgtgtgaacgtacatttcttttttttccttcttcacttaaaaacattattttttagaggagagaagctcctactagattgcaagcttcctgaaagtagggatcaaacttgttttgttccccattgtatccatagtcagttggtgctcaataaatatttgcgacccaaatcaatgactaatcttgagatttcaagcaatgattatttctgcttttaccatttatgttgaaacaaaatcaggcttatatagttagatcagcgatttaatttagtttgctactatgttgaaaaaaaaaacttcacagtgtatgttgagtggttcactgtgtgcatgtgtcctaatatgtgatttcttttaatgagaaaatgatgaatgtcttttaataaactttggatactgctttaagtagtgacgtttaaaaatttctaggcattttgtctgtctgccgtcttagctatttgtagtgatctgttactctaggaggaagcatttaaaaatggataattcaataaatggtgttggaacaactactaagtcattacaccacatgaataaattccagattgattaaagatctaaatataaaacaacaaaattgtaataaaataattagaggaaaacatagattattttaataatccttggatagcagaagaggcctaagcaaaacttaagaattcataatccataagagaagaaattggcagatttgattgccgaaaaaattttaaaactttgataaaagacatctcaagttagtacaaataagaagacaaaccaacagaatcaaggacaaaggattggaacaggcatttcacaaaagggtgaaatatagatggacagtgaacagatgaaaagatgttctctgtccctaataatgtatagcatcctcccacccctgccatcagatggacaaaagtgaatatgatttctagtactaatagggcatggggaaaagttactctcaaactattgggtctgtaagttagtattactttttgggaacgtaatgt

SEQ ID NO: 97490 - DNA, 1071 bp, Homo sapiens
taagttacaaagaaaaaaaattcaagtctcacattttgggaggcaacgaactccagcttcaaggtgccggtatctgatgcgagcctttgtgctgcattatcctgtggcagaaggtggaaaggccagggagggcaagagccagggactgagagggctgaacttgcttttacaacaacctactcttgggataaagagatgaatccattcatgagggtggagccctcatgatctagtcatctcttaacaatcccacctgttaatactgtcagaatggtaattccatttcagcatgagttgtgaaggggatattcagactatagcagtggttaaagtaataatttatcggaaaccctgtgtttgacttgtaaatgacttataaatgtgactcaaatccagcaactattcacagtgttctgtttctggtagtacaggttggagttatgtatctatatagatctgttataacttaagtaattatgaatctgtttttgtagttgagagctctaatttttagtgtatccaacactttgcttattacctttccttcctgtggacatgagctaacactgattatttcttttggaaacatttaaagatatctggcatctctctgtggtattcttgaagtgacttctttgagatccttattcataaggatatctttttagaagtcttctctgaactccccagtttaagtgaactgcttctatctccttactaccagtatttcccttgccaacttttctcagttatcgttcctaaataggacttattctgtccatttctactgctgttaccttagttcaaagctttgtcattttttgcttagataaccatagtagtctctgaattgatttctctgcttccagtctggcttccttccagtagagtccatacactgcaagcctcagtgggttttttgtttgttttgttttattttaattttccttaaaaaaaaaaaaacctcctcttgttttaacattttgttggtttctcattgtcagtaggacagcctcatgtcttgtcacttctttccttgccccttgcctgagatgtgcactttgcttgaat

SEQ ID NO: 97491 - DNA, 1075 bp, Homo sapiens
ggcaaagtaagtgcaaagcatgcaaggcgggcagtcaggagccgggggagatccaggactaagcactggcaagaccaggtactacctggagtgtctgatcccagggaggacttagacccttttttaaagggctttcaactgataaaatcaggccacttaggatactctcccttttgattaatgtaaagctaactaagtagggactttaattatatcagcagaatctctttatggcagcacctagattagggttagaaaagctaggaggaagtgtgtgtctgctacaaaatgacgttgcctctcttctcttcccaacacctggcggagaatatcccttgtagcccactttagagacatagtagaaagggaattttggcaagtgtattcagtgtaggtaagctgatgtgtcccaaagccatcacacgtgtgtgtgatttttgtctgttgtaagcagtgcttacgtaaacatatttatgcatctgttcagtagttttttggaatatattttttaaagtggaagataattttgaactgttcttttagcttaatatggaaagaaatggtaagttatgcttttgaatgaatagttgtttctctagatgatgatgtgctggatttagaattttttttttttttgaggtggcattttactcttgtcacccaggctggagggcagtggcacaaccttggctcactgcaacctccacctcccaggttcaagttattctcctgcctcagcctcttgagtagctgggattacaggtgtctgcccccatgcccagctaatttttatatttttagtagagatgggatttcaccatgttggccaggcttgtcttgaactgctggcctcaagtgttctgcctgccttagcctcccaaagtgctgagattacaggtgtgagccactgtgcccggcctagaattttaaaaggataaaaatagacctggatattattaaaaatagtttaaaaatattttataacctgtatatttgttttcactttttttaatggagagatttttcaatacattactcacattttgtttttttaattttgttcttccagtcagtt

SEQ ID NO: 97492 - DNA, 1297 bp, Homo sapiens
gccaccatgcccgacccactctgggtcattttaatcttttgcttactaccttgttccaaatgaatgggttgctggagatagttatttgtggaatattatttgagttatttgccgtagttcagtaaattggaattcatttggtgttttagagattatacactgtcgtgtatgtttttttcttgttttttgtgtaatgtgtagcccaaacagaattaagccttgttatatgtataccagataatattgtcataatgaggtagacttcagtgtttttaacttcagacattgtaaaggtacacataaggagataggccacatgatacctctaaaatagaagtgccttatgggcagttacttggttttctttataattgtgcctttagctcttagaatggtgcctgacactttatatgcattcaatgtatttattgaatgaacgataaaactgatttgtagctgtggctaaatttactttctgaagtaagatgtatgtataatttactatacatatttatatacactgagtatccccaatttgaaagtccaaaatctgaaaatgctccaaaatccaaaactttttgagtgccaacatgatgctcaaaggaaatgctcattgaagtgttttggatgtttgatttttgggttagggttgcttaactggtaagtatataatgcagatattccaaactatgagaaaaatccaaaattgaaacacttctcgtgtcaggaattttggataagggatactcaacctgtatgtaacaagcaataatggatatacagtagactcttatgtcagtcaacaagtttctttttcctaaaaacttgtgatgatgtgtagccaaaggaatagttctggtctgaatcttcttctagaagaatcttctagaatctaggacttcttttgtatttgtgtctaatacttctctattttgtcctagaatgtttgctttctgcttcaggatttctattttaattgaaggtagtctatatctttgtatctacacctgcttgcaaatgtgttttttaagtagccttaccactgtgctatgcaatactgactgctttttttttttttttaacgtttatggaaatggcaatatgacgctgcacttccctgttctccaacacaagccattttcttacataaacactgatctctgactattaaggtaatgggaaaatggttttaaacaccttttgtgggaagagtcacttctgcttacacatcctgtatcgtatcattaaacattccctatgaaacactagctaaggggcattactatttaataatttc

SEQ ID NO: 97493 - DNA, 1031 bp, Homo sapiens
tgatataaactttatggagtaattttcttctatatagtgggccagcatttgtttagaagaatcagttaaaggcctacatttgatgtataaaattgatcaaaacaatgtgacaggtatccacaaactggattattttctagaagataccagatatcaaacatcagatattttaatagtctgccagttaggccattaggaaatttaaattttacttaacacatacacttggtgtttattatacccccaaaactaagtgattgggtctttttgaactctaagaacttttatgatttcagtttaaaaataatttttttttcctgtagctatttccccttagatttgctttccttcactcttgtatgttgagtatactgaagtattagtatagcatgtttctctggtcccttgagccgaatgtgtatatatgcagtattatacacacatgcacacactagagagacagagagagagagagagatatcttccattctgtacttgtgctttgaaggacttaagcttatgctgactggaaaaagtaactttgataataattctctgttactattctctgttacccccaaatccaaaccagccatctaataaatacacaatgttggccacatttgtgatttgaaattttctagaagcctcatttaacaaaagtaaaaagaaattggcaaaatgtattttaataatatgcattattttacccagtatatccaaatattattttagtatgtaaccaatacataatttattaatgggactttttatattaagttcaaaatctgatgtgtattttacacttacagtacctctcaatttatgctagccagatttcaaatgcccactagtctcgtgtagctagtggcttttgtgttagacactgcaggtttagaatacaatatgagcaaatacatatatgctctcaaaggttttggccaaattgttttatttaagaagtttatgtctattgattgagtatatgctgtcttttatagaagattccaattggtatctgtttcaaaaaa

SEQ ID NO: 97494 - DNA, 1051 bp, Homo sapiens
aattcatattaacccatttaatccttataacaactgtatgaggtaagtgctgtataaggtaggtatcataaataatcctttcacacagctaccctatgaggtaggtactattattattcctattttcctacagattaggaaggtaaggcagagaggttaaacagtgagctcaaagttacataaatagtatgtggcacagctggaatgcagacccaggaagtctggatcgacagtccacactcataacactttgctgcatattggtctagtccagtgataacagatattgaagtttcacctaacaataagtgatcatttaatcacaaattacttctgacatttcttagtaaattatatcttatgattaatagtttacattaaggagtaaaagaacatgtcttagcttttgtatctttgaaatgggataaagatagtcttacctctataatattatgaagctcaagttaggtaataaatgggaaattcttttgaaaaaagtgaaaggaataggaatgtaagatgtcaaatacagaattagtgcctattttgacttcaaagatttatgtacatattttgtgagtgtctttatataataaaatgttactttctaataagttttagaagtccaatgtgctagccgttgcacaacagagactttctagtaagttttagaaagaatttcgcttcatgtatgtgaagccagttttaaaaagctggtgttttttttttttttttgtatggcttaatctagatattataaaaatttgaatttgttttttagagtgtctcaaactgatgatcattattagaatattgcatgaacaagtaatcttactttgtcctttttacttcaagtaagaatagcatttaaggtaaagtgaaggagaatgttcttgttccatttaatatttttactttttcttactctttgttaataaatacttttctctaaaaatgaaagggaagacaacagaaaaaaactattttatttctgttgaatgtagtatataatttaaaagtcagcattttgttttgttttgtttttttgaga

SEQ ID NO: 97495 - DNA, 1630 bp, Homo sapiens
ttctgcagtgtgaaatagattggtttggaaaatgaacctggctttgctataaattacattcacaggtacaaaggaatttgttattttgtttaaaatagtcacaaatataattaaggtcttaatttatgttaaactacaaatatggctgttatggtaactggattaggaacttaatctgttgcgtcaagaatgatacctaacacttttcatttataaccttagataccttatttcaattacagggtctgcagctgtttgatataaaaatgaattattttatagatagatttgttcatggtttttaattttaaattgtgcctcttcagtaaggtagaaaataattcttcaattgtcacaaattttcctttgtgtctggttgaaaaaggatatgaattaaaattcacaatcatttttattttgtgtcctgaaaatggcattgcatgcttgcgagtagtcgttagtgaattcttacataaaatatttcaaatttaattaggaaataaatagaagctttgttctaaagaagaaaaacctgaggtctgctgtctaaggatagctttacctggttggactgaaaatggattgctacctatctagaatttgaataactttgttcatgtgacttacataaatttagaagctgtgtttataacgccttgaatctcatggtattaatcagtgtaaagcatctaatctttaaaaacttattaaaggcaattctttaaaattttgaattacttttatatttttattggcaagcaatgctgattttattgcttaggtgcaactaaagagagtgtgctgtgtatctaacttgaaagacaaatgttcatttttgtctttggaataaagaagaggaaagaagacagttggtgctggtcattggcaagtgtttcaatattgagttactattagttaattaaaaagaatatatgttccttccatctactagttcatcctaagaattttaatttttttgttattatttttatcagttgggaattttcttgtaagtaacaaaattttaaagcattcattataggagctcagaaaaagaatatatatattttttcgttttctccccaactgttcattgagtgctaactatgtaactgctgttgtgttaggttattgggttacaagaattgttctttctgtactttcgactattttataactcttgcttaattttgaccctacaactttatgaaagttgtaaacaagatagacatggtctgtatgtactaatgaagcttatattcttgggaggacaggcttttatccgttcatttattggttttatcagtgcgttatttatatgtaattatcacagggaaagcttatatctttctctattctaattgtctcttttgttgctttcagaaataacctgatttttttctatagctgtcagatgttgatgtatctaaaattgactcaaatattccaggagtagtttctaggtgagagtttcattaaggaaggtcagtctatgaagtgatatgtcttcaaatgttctctcaaataacatttcatattttttggtaataaattcactctctttaaagctttttatgcttattgaattgtggtttctgatttctacatagatcattattattatttttta

SEQ ID NO: 97496 - DNA, 1300 bp, Homo sapiens
ttcgtgagcacagaaactacatgttggaatatagggtattactggagagaactttgaggtagcagagatagtattttgagttttcctctaaaatgaggaagatgatgatcctatagaaaatagtggaatgaagcaattaatagcttataaaatttggactttagtcatctacttaagaaaattaaagctatatatatagtattgctggtttacataaactaatacagtaacataaatgtggataatttacattttattccttaggtatacatacatactttaagtttcatgtatttactgatgtctaaatcatactgatttttaagtagtgacatgacatttttgtttggaaaacaaatccttcactttaaattggttcattgttttctattagagttttgtagtatgaaactattcagtttagaaaagaaatgcatacaaatttctgttcaaatatgcatatgctttttactgggcttattgtatgtatcttgatttacaggcctttttgcaaatgtgtaacttgcctatcaaagtagtttgtagggcaaatgcagaatatatgtctccatctggtaagtgtgtttttttttcttctctgttaatattatggagtgataaaattatagtgatagtccagtttgtatctacatgttaaaatgcctgattttttttgtttaccctttgaagaatctttccatggttttagaaagtaacaattgcaaatttgacaatcttggggttggcatatctattcatttcaactgtgatcagagatggttactgacgtgtggaaatggttttaatagtaagggaattgttttaaatagtaaatgttaaggaaatacatgatctcagatttccctagtcttaatgtacataagactttcctgttgagaaaacaaattttagtaataatgaatccatttattattccacacatctttcttaattatattctcccataatacagctggaagaagagagattgtagaaaaattaatttgtcgttagatcttgaagtcatcactgaatgtttttggtttctaattattttttctaatgcttaattttaacaggttttgagatgctttagcttcctattttttaaaatcagtattatctttatgtcagtagattaaattactgttttaaataaataattcaaaatttttaatataaaaatgtgctacaaagctgataaataaatgttatatataattatcatggatgattattgtaattatggttttgttggagcaataatacgtagaattactcctttttgaataaattatta

SEQ ID NO: 97497 - DNA, 1069 bp, Homo sapiens
aactctagaaatgaatttacctgttctttttttctaaagttggttagtaatcagtttaaaaacttacagaatttaatatacacatctgacaaaaattttcaaaagttacagttttatgaaatccctatttataaatacctgagttttgtgttaattttttttaattatcacaaactttaacatactggaagtatttttataaatactttttttttctctcaacaggtaaagtaccttttattcatgtgggaaatcaagtagtatcagaacttggtccaatagtccaatttgttaaagccaaggtaataaaaagatattaaatgtatttgatcagttaccaagtcattcatcattctttaatgtgtcttaacatttacattgatttcaacctagttttataaaatgccaatgcaaactactggaaaatatttctgaagtgtaagttagtattttttcatgatataatggcaaaagaggtagctttttttcctctattaatgtcaaatttattaaaggtatgtaattttaatatctagtctaaagagatggtttgatctttacaaaatggtagataattttctaacttatgcttactacaactgtggtcataaatgaaaaactattaggttttgaagtgtctggctgacctttgaaaagggagatacaggatttgtttgaagttgaatgtatttatccatttgaatgattctgcttttcatttattcagtttagattttaatagttattaaggaacaactcccattagtgtttctgaaaaatcattccagactttttgaatatatagaaaaacctagatcatactagtgtgtattattttgcaacataccttttaaaatcataaatatgtttggaaattcttccatattaatagctgtaggtatatatcatcctttcacattgttgtattctgctgtattggagatatatatatatctccaaaatatatatatatattattttttttttcttcaacaccctccccctgtattggataaattagaattttatttactcaagtttattgttgggcttttaggtcatggccaat

SEQ ID NO: 97498 - DNA, 1045 bp, Homo sapiens
tgacaaaaccctcaacttttatgcattaaaagaatcattctttatattgatactcctttaaaaaaatatatataagatttgcaagaaaaccatttcctgtgattttcactaacatgaagtaattttatttctaaaaaatcatacatgcttgatgtaaagcaaacaatgcaatgcagatatgtgtaaaaaagcaataaaacttgcctgaaatctcatcacctagaaaataccacccttaactatttggagagccttcttctagatgtttcttagtaacattttctcaaatgggatcattatgcctgctactgtataacctgagggtttttttttttttttaattgaacaatacattgtgggcaccttttatgtaactaaatatagatctgcagcatcagggcttaaaaaaaaagccctgttaaatacagtactttgtccgtctgtctgtctatctatctgtctatctgtctatctatctgtctatctatatttttgctactaaagtagcaaaacttaaaaatacttatcttgtccacaagcatcattaagttaattaatgcccgtcttttccaaggctacccttaatactagccagccatctcactgatgtgtgccattggctacaagggggtttcagtaaatgaatagggatagaataaataaaaatctatctccactagtgggaaaataactcaaatgcttttactcatagtgggtcaatgttgttacctttattaagcagattttttggtatatgcaaagccatttgaatatatggattcaggaagacacttttgttcttgacaaaatccttataagtaacttaaatgtacttgtattttgaaggacattcactgagaatttcttcctatttcttgtatacaaagtattatatatatatacttatatagaaagtatttcttataagtatttcttatatagaaagtatttcttataagtatttcttatatagaaagtattatatatatatgtggtctatggtcttattaaaatatattataaaaggttaacttaaatttatatt

SEQ ID NO: 97499 - DNA, 1016 bp, Homo sapiens
tgacatatctctaagttactctaatttctctatgtgtatgccagtcctaaaattagaattaaccccctacaattagaattaatcccctaaaattagaattaactttccttctagctcaactactggggatgttgggaggactcgtgaaagaaaccaaataccgttacttgatgagagaaaaggaaaagggtagttaagggagatctcacagaaagaataataattgggaaaagaggccaaaaagcaaggggcttgatttacaaaacttgggtgacagccctaaagataagtgattaggatgtaaagaaaagataacgtagattatttctagtactataaagagatgaaaagttaatgggaaagaacaattaggaaacactcagacaaaattaatgcttttgaaagcattaatatagatgatactatgaaggtatcagagagaaataaatgtgaaataatgaataagcaaagcaaaaaatatgagtgccagaaaaatcttaaatggaaaatgttaggaaaatgttgaattttactgagtgccagaaaaatcttaaatggaaaatgttatgaaaacgttgaattttactgtttttgttttgatattcaaatgaaaaaatagtagataaccaacaggaatgtggaaagaataataatgtaagaaggcatcaaatttcttaggactttaaaaatatatttgtcaccctggaatatttttctaataaaaagtctataaagataaatgcaataatatatgaaacatcttagagctcataggaggggaattgctatctatatttgaattataatcacaaactatttggtaagcagaagggtagaaagttgtgttttctcttcacgtgatatagcaagataattaaaattggaggtatatgaagatcttgacttgattaaatagttcagtagaaatactggataaaatatgttacttgtctttttgttaagtcaggtttattgatgtgtaatttacatctagtaaaattggcacttttatgcgt

SEQ ID NO: 97500 - DNA, 1025 bp, Homo sapiens
ttactttttttacatccatctccccagccaggtcagaggctctaggtgtgctgtgaccatctccactcatcaccatggaacacctggcatacggggcctcaggcaaagctgctagtggaggccttgggccacccccttctctcttcccacactggacaccccagtttcatactcaagctccatcctcttccacttaaccacagctggtcctgtgcctcctccttgaagccatttggacagggaattctggggtcttgggtacctggagcagggcctagaaatggaggaatgtgaccagggcaaacagtgtatattgtggggcccagggcagaggccctgattgcctgagtctacaggcaatgttgccagcattccagaaacactgttgtgcatgtgacgaacattaataaactgcagcactgctacagagaaataacatgaagccaactcagagggccctgaacagcaggaagcggtgtacaggctttgccggaagagagggcaggtctgaggggcagcaatggtagagcctgaatgaaacactcactgtagcttaccatactctagctattatttttccattacttttctataacttttaagggcagagaatgttccttttcattgcagaggaagttccatttacttggatgtttactaaaggataatctcaagcttcccagtaatgactcaaacaaatagaatttggacattctgagaataacctagaccctcagattttttcccaatctgtcactagtagtttgtacacccacacagcatgcctaacacgtttctgataatgtatttaaggttcagagtgaaatttcatactctgtgaaatttaaaagcaaggtaaattcttgtttatacagcagtgcctatagggtagagatcaatgaaatggggacatctgaatgaaacaaatataaaacccaaacagaaatttttactgtatgaaaacaaaaccatcttttctatagctagaccaatgctatatgtcaggatgattttgaagttaaagt

SEQ ID NO: 97501 - DNA, 1048 bp, Homo sapiens
tggggagttgtttgagatgccctggaaaccttcaagtggagatgtttttctttatttctcttcatttttccttctgggaacttcatattggtcctgaccagtaacttgtactatatcatgatctataggaaatctactttgtttttccttctacttcttgagacctctctaagattatattatacactctcatctctatcaatttctaatttacagatataagaggccgccctgtagaggaggaaggaggaagttggctgtgattgaccttgctaggtcatcttcctaatctttgtcctttcctgcaccccaaatggaagataaaaggcaatgcaagatcagcatcctcagagacatcgttttgtttgggtttcatggattgcaattgccagagatgcttaggctgcctctagagggaagatgattgattgttaacctatgtggtccaaccaaatgtcttaggggttattgataattaaaatggacaatagcgattttccatttcttctggccttgggtgctggcatgtggaagtggtattgatactcatgaccaaataggcacttatcgatttcagttttcataagttgcctaccaaatgcaaactagtaacccagacgtgggagacctaatattccattgttaatctttaggtccataatttttatttcctctacttgcctcttcttccttcctctgcataatgagttgggcttatataattgcacccatttactcactcattcgttcaatcaattatttgttcctattttatgccaagtaatgaacagaaggtgttggggatgcaaaacccaactaattggaatttctatgttacaggagcttatgctttagtgaaattatagacaaattattatacagttttaatccagaatagtaagtgctatgggagcatgcacagaggaaacaacccaatcttaaggaatcaggaaggtttgcagaggactgacaggaaaagtgggcaggtgaagaagatgggcagtgagaggaggagtggaagcacttttgctagggaaaaacatgaata

SEQ ID NO: 97502 - DNA, 1044 bp, Homo sapiens
cccatgtatgtgaaatataattttcactatagatttttatcaaattgtgatcctaaatactatcattactttttctcattaatataaacatctttacatgacaataaattatccctaataatcaatgttgatgattatatagtatttcattatgggagtatgccataatttacttaatcgctcctccccttattgagtatttaagttattatctactttatatattataaattataaaaagcattgtaatgaatatcctggtttacaagtctttggacatttggcaaggaaaagttttaaatatcctcttttaaacaatcaagtttaggcaagtgaaagtccctttttcttccatcacaagattaaacaataaatatagcttatctgaataaatttctttagtgtatgagatggactaagatttttaaaattattataaaataagggcatgctaccctgattgatgataatggaattactttctgtctcaagttgattctagaatacttgtttggcctcatttggtcttttgtggcatgaaaaatgtacttctttattagattcagtcatataatggaagaaatgagattctaaatgttcatgtttcctggaagaagttgctacctagctgtgtctttgtatagtttcataaaactataggttgggaaggagactggtttctgtgattaactctgtttctcagtttccattttgtaagtgggacagaactaatcactctaaacatctagaaatcttttaaaactttaaaatccaaatgctttacattctgttccccctgcttttgtggttgtactgcagcaattctgtgttttggagctagttagtaagcactttgaaaaccactatcacagtgtttacccattttgatgaagctttgagtatctcggctttgttttttaaaagcctatacatggcattttcaggtggtctcccatccaatattaactggaccattcctgcttagcttctgaggttagatgagatcaggcagtatggccatatattggatatctatgatttggc

SEQ ID NO: 97503 - DNA, 1052 bp, Homo sapiens
tttttttttttaagacaaaagcttgaaggcataaaatggagttattttcatcgggatatcaccctcgatgctgctgctttactacatgttcatagtcaaaattatttcatgtttcccttgaataactacgatcagtttgaaaacagctttgttaattagtaagagatgacgcaatatatcactgcatctttagggctctggcgccagctagtggtaggagaggggagccgccctgtcgctctcaaatctgggaaggcgtcggtcttctcgcgtccccttatccctcatcctcctcattttttttttccatcagcataatgggggaatcattgcagtgtggccagagaggagcagacgagattatagatgaaagtagagaaaaacggtgggcaggggcagggagaggaaaggccagacaaatgcaatcatttctccaaaggatttgagaagagatcatttatttgaaatattcctgccatgttgatggagcagctcaatcttttgccagtgaatctttagcgttttgtttttcatttgtagatatggttgaacatatacttaggacacgtaataactatggaacttcatcacaaacacagcactgaggacatgttgtaagtgtaaatttgtgttcatttttaagtagcaaatatttctactgtgaagaggctctgttacctcctcacacgtatgactctgagatgaataactctcaaatggttaataaaggagaaacctcttaagatggtatttgtagatggtacactatgaaaaaaatacaaaatttccaggcaaaagagactttatttgggaggtatgaagtagatgtaggtttggagccctatctattctcaaatagaaataggctgtgatgatttgcaggaaaacagaaaacatacagtatttattttaagaacaaagaatctttggcaggccatctttctcatttaattaagccataactgatcttactagggttatggagggacttcaaatgctaataaataaaacctgaagctgagacatttctttcactaaacagctggagctgt

SEQ ID NO: 97504 - DNA, 1036 bp, Homo sapiens
cccagaccaaagtcacccaggtgccataataaaagaatttctaagggagatttcaactagaaaaccaaaaggccatcaaaacaaacattgatttgcattccagatcactttctgctcttgttcatttctgggatcttatttggagattaaagggtaatgattcactgatatcctgtgggaaaaccagttcaggagcagcctttgacaaaccacatgtagaaatctggctgatacagggagaaaacaagtttcaatcttatttttagtgtagggtaaaggaagtccacccaagataaagcttagcattctttctttgaggaattagggtaagggtgaagaaaagaaagcttgatatttttctgcctatgaaagccagaagaaggctcagagaagcccgttccttcttttcctctttttccaagtgccagacctccgcagctcccagaggaaatgagggcatggggtgggtaatagggcatgtgatttgaatgagtattcccagccatttaatatattcacaagtcaaactataaagtatttctttaaaaaaattatagtatttcactgaagtttgaatgtactttctcttgccaaaataatcagagtctttcatttttctaatgataaaaatgtgctacatgtgtaggaaaatttcccaaatgaaaaataacattttctatggcagcacatacagtgcttgaatttttcaccttagattttattctagccagacctaaactctgtcttacttgcataatgataattcatgtcgtcaaaccaaacgcactgtttgctgctcgtttgtccaggagccatcttttcctaaagtgagcaatattacgtgcattttgtctggctggccgagggctcctccctacagcttctgcagccatggaagagtctggaaggacagtgttcgcttgtacaagaagagggaaggataggatgagaaaagcaaaatcttggagagtctgtggtcggaagaagaaagctgaagctggttaggaggaaggagtgtgtgagtgaattaggagct

SEQ ID NO: 97505 - DNA, 1052 bp, Homo sapiens
catgtcaaccaatgcttccaccattgctgacaaagacaaaaggaatgtagtgaattgtatactgataaggcttggaactgaaaataacacatgccattttgctgactaatgcaagtcacataccatatctaacttcaaaaaggtaggcaagtagtctatttgccctaaaagcaggagaaccagaatgtgtggataatcccaataatgactataatttctatcttacctaagccactgttattttgggttttcagccaattgcatctgcactgaatcctaattaagagaggaatgatcacatcaatgctgtgataactatgtcctgtgaggaaggctgtcactgggtgtacaccttatactcggaaggatttgcaggggtcactccctgtggcttttctgagaaagaagaagccacatctttcttaagatcctcagtcatccttcagtcattgacatctactacactgcaggcaaatcactaagaattcctattcctaaagttcaggctaccacctctagctccttctaagtctacgaaatattccctattcttttgaaaacacaactctagtctttttctattctgctttgttccggcattcaaatcttagtccttgagatctgtcatctttcccagaggctctaaatatgtccttacctccttcaatttggcaaatatcttcactcgaccctatgacattttccaaatctatagacaaatgagtcgttctatacctattgtctttttgttttccttttctgaaacccctgtgatgaggcttctgtttgtaccattctacttaaactgtctaaaaagccattaatggcttttatcaagaagcgtttgtctaaaactctggaatttcctggaaacatgctttcgtatatttcatatagtgggatggataacagcagataaaaacagtcataggtttagtaaaacatagtagagccctttctgcatttgggtagtatgggaatgccttctgatctgctacaggtaaaatcatatgtctgtctgctcctgccctaaaacacaggagccatctgca

SEQ ID NO: 97506 - DNA, 1795 bp, Homo sapiens
gaggcctcgggagggaagccggcctgccggctgcgcggcctccgaagcgaggccgagggcggcatggcgggccccggcgggagcggttgggaggaggtggtgggggaggggaggggacgagcaggcacatccgggcgagcgagcaagcgggcggcggccacattgacattgatccgccgccgcgttacgaaatggcgcattggcccgcaatggccgccgcctcgctctgccgccgggaaagcgagcctgggattggagggaagagggcggaggcggcccggcagaaaaagccgcaaatggcctcgaagcatggggaggtagtgctttcgctgaagttctgccgacgcttttctaggccttttacgggtcctctccgcgagaagtcgataattggccttttctttttttcgcagcatcctgttggaaatacgagattgttaaaaactttgctgctttaaaatacttcctgatatatttttgctaaagtacttacattacacttcttaaaccgccatgtgggcgaaggacttaatttttgagaatttgagtgtagatgtgaaaaacaacccagccagctccttcccggctccggccgctgaggagggtgggtggagaagaatttgagtatagtatgttaaggaagaatttagaaatgttttttatcttcatgttttcccattctttgagtcggctctggttgtagtttcctggaattttatttagaggactgcaaccagagttgaaattttcacgtttttgcagtacatttaatgtggatcctaaatatttttgtcgatttcgttattgtcaatcgaatacatttatccaagacttgaaaagatgagattacatgaattaatgctttaggctattaacgtttttttctagcatgtgacaatctcttcacattaaacggtttaacatctctacctctaggagacacaggaagacattagaatgtaaatgtgagccccttatttaagaacttcgggtgaaggaaaccttaatgcatgcattaaatgacagttcatgcaatgtgttaaaaagtcttgactaaagtataaaacaatttcaagacatcttaattcttaaaaatctcaatttttgttttgctgtactccgttcttatagtcagacaatacataccattcctaatgtaagtccaacttgccagttagttgtgactcttaaaattgagttgtaaattgcagatttttgcagcatataacaaacatgggttatagaaagctatttgatcggcttttttttttcctcagtttttttgggaaatgctggtttggcttaggaatgcctgttttaaattaatttgcttgaaagcagtgagtttctgtaagtttgacattcagaacttttagattgttcttcatcacagttttgagtttaaatgtatgggccgggcgctgtggctcacgcctgtaattctagcactttgggaggccgaggcgggcggatcacgaggtcaggagatcgagaccattctggctaacacggtgaaaccccgtctctactaaaaatacaaaaagttagctgggcgcggtggcgggcgcccgtagtcccagctactcgggaggctgaggcaggaaaatggcgtgaacccgggaggcggaggttgcagtgagccgagatcgcgccactgcactctagcctgggcgacagagcgagactcagtctcaaaaacaaaacaaacaaaaaaattaaatgcatgttgggttgtagactgagaagagttgaaatgggatagatgcaacactgcttctccaacagtttagtgcct

SEQ ID NO: 97507 - DNA, 2558 bp, Homo sapiens
cagttgtagcttttaaaaaatgaagcgattttttgattctggaattgtcttggatttcaatttagttgaagtgatgctggcatttgaaaggctggttataggtttccttgacataagttagcccctttaacagttgaagtcttatttctggtcaaagtttttgttgttttgtttttttgagacggagttttcgctcctatggcccaggctggagtgtaatgacatgatcttggctcaccgcaacctccgcctcctgggtttaagcgattttcctttctcgagtagctgggattacagacgcccgccaccacgcccagctaatttttgtgtttttagtagagatggggtttcgccgtgttggccaggctggtctcgaactcctgacctcaggtaatccatctgcctcggcctcccaaagtgttgggattacaggcatgagacatcgcgccggtgtctggtcaaagttttaactggacaaagtgttaactgtcacaggaatttgatgttgattttattacttaccgtacattaaaggctcttcgtgcatcttaattcatctactgtaaggtaacttaagagtattggttctttctctcagggccatgatccaaaggaaccagagcagttgagaaaactgtttattggtggtctgagctttgaaactacagatgatagtttacgagaacattttgagaaatggggcacactcacagattgtgtggtaagttactaagagaacagaagggttctaaggggtgtagagaaccggtggaggtgttttcaacgttataaaactttttattttgtaggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggtattttaataatacattgtgtaatatgtgaaattgttgtgaaagtttgtttcttgacttaatatattactttatttgtaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttggtaagtagcaatttatggtaacttgaatgagaaagtagaactggtttttctgttttgaactaaatttgctaaattgtaattttctgttgcgtgtaatggcatttatagtgtatagtcaattttcatagtgtctgcctgtgtaatcagtatccagatcaagaaataaacataaacatctcagaatgctccttcattaccagagtcactacctgattatgtcttaatgggttacataatgacagagggtatctcatatatgtgcttttccaaacataaaataactttttgttttgtttgattgaaaaaaaatttagttcagaaataccacactattaatgggcataattgtgaagtgaaaaaggccctttctaaacaagagatgcagtctgctggatcacagagaggtgagtaggaccatacacatgtatacagtggatatgagtggtgtttgtaaggttcttaaaaatctcccttgcctgtattaaaggtcgtggaggtggatctggcaattttatgggtcgcggagggaactttggaggtggtggaggtaattttggccgtggtggaaactttggtggaagaggtaggctgtttatcttctaagtacatggatacctgacattttggtaagttgaatatattattttaattcatttcttgtttttcctcaggaggctatggtggtggaggtggtggcagcagaggtagttatggaggaggtgatggtggatataatggatttggaggtgatggtaggtggcttattttcattgatgtttgatattttaactttctttacttattgaaaattatttattacacttttctaattttagttaaaacttcagtggctaaatggttaaggtgtatttccaaactgtacatggaagaacaggaaccctttttcccctggagagacattagctgctctttttcagcaagtagtaggggttgagctagaattgttctattaagtctgagactatatttttcttagtgaaattttgtaaaatgaaaactgattttcttttttactatcagaagatgggttacacatttatttttcattcttactagtgcagatacttgatactctattattattaggtattaccaggcttcagagtgctaaatcaattcattggcttatttgccagtggcttaaatgtaatataaaaccagagttgagtaattctagctattcaggaggctgaggcagaggggttgcttgaggtgaggattttgagactagtctgagcaacataaggagaccgtatatctagaaaaataaaataggggaacatggtggc

SEQ ID NO: 97508 - DNA, 1048 bp, Homo sapiens
tgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagata

SEQ ID NO: 97509 - DNA, 1045 bp, Homo sapiens
ataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgttttggtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagttgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaata

SEQ ID NO: 97510 - DNA, 1005 bp, Homo sapiens
aataggcatggaaggaaaaataatttttaaagttatcaacccttgttgcctaaaataggtcttgaaagacaatatatgagatatttgggtgatacatgtgaggaatctatgaacctttgagggggaaaaaaggataaacgagttagtaaatagaaacaaactaggagaaaaaagtggttgctaggagggagaggacattacagatgttggaattacctagtttgatcttgaaaggcagtggagtggttcagtattgtatggtgagagtaagttggggaaaacctttcatgaaatttagtagtcttaaacgacactgccgtttgacacaaagggaaaagggtaaggatgatgtgggtaatgatcatccgttttgttggattcatttgtgggggtaggtcttttgataatttattttttgaaatgtgtgtatttggatttctagccttaatagctattaagcacattttcccaatatagttttttcaagtgaaatactttataagttgaagccagctgaggattcttcgctagctgttagacttaatgcatactcattttgcttgtattcaaacactggtttcatgttctgtgcagttaagtaatcttaaagaatggcgtgtctaggctgggtgcggtggctcacacctgtaatcccagcactttgggaagccaaggcgggtggattacaaggtcaggagatcgagaccatcctggctgacatggtgaaaccctgtctctactgaaagtacaaaaaattagctgggcgtggtggtgggccacctgtagtcccagctactcgggaggctgaggcaggagaagggcgtgagcccgggaggcagaacttgcagtgagcagagatggtgccattgcactccagtttgggcgacagagcgagactccgtctcaaaaaaaaaaggcatgtctaataatttcagtttaatacttaggtcctggaataataaaggacaggtgtggacttatttccaacaaaagtatatttaccct

SEQ ID NO: 97511 - DNA, 1083 bp, Homo sapiens
tcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtc

SEQ ID NO: 97512 - DNA, 1016 bp, Homo sapiens
tgttttccagaccccacttctcttatataagccagtggcttagagtgcttgctctaatttctatattccattaaacaagggtgggatttcttctcattcaaaccatttgtgactttgccctttagtgacctctaccatcaccctatcattaatgatccaagtgattagaatggatggctatgtgtttgtaggttgtttgttgtctttaatgaatagattcattgaatggaattaactgtgctcttctagaacattggatctgtgttctcatttagattgtatttgtaatctccccacttcccaccatcaacagtggcataatgtgaattaatttatgtggtatctgtcatttaaaaaacatgagctctctccttcctttttttgtcttaaacataggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggtacagagtactcagttcttgggaaagttatggcaggtttaaggaaacactgagcaaggaattaaaatatctggatttgagttccagctttgcctttcttttacttaaccttgtcaaatctactttccaacctcagcctcctgatgagttcagtacctaacctgagttcagtacccaacctattgatcttaacagtgttattgtgaggattgggaagacttaagttacaccaaagagttttgtaaagtatagaaacatcctgtaaggatcaagtagcagcaacagaagtagtagcaggagaaccaagtagcagggattactggcgttactgtgtgtggcaagcactgttttaa

SEQ ID NO: 97513 - DNA, 1052 bp, Homo sapiens
aaatctgagtagcacagagtatgacattaaggccataacaataaacctattgttgctgcattctaaatttgatcaagatgtctgtttttgggaatccaaaatagttgcttcaaatttagcttttttcttttatgaagcagttttgttttgttttgttttgagacctctcatagcaagaaaaaacattacataaacttttttttgagacaaggtctcactttgttacccaggctggagtgcagtggcacgatcttggctcactgcagcctcgacctcctgggctcaagcagtcctcccaccttagtcccccacgtagctgggactacaggcacatgccaccacgcccggctaatttttgtatttttagtagagacagggtttcaccatgttgcccaggctggtctcgaactcctgagcacaagcgatctgcccgcctcggcctcccaaagtgctaagattataggcgtgagccaccatgcctggccacataaatataaacttaaaaatacacaggaaaacctttcagaacactttgaaacctattttggtcctattacgattgcactgaatgtcccccagcctaatgaagagcaattagatgtcatttggtggcattcttggtggagacagtaagctagggccgcaggagctgcttagtctcccagggtccagcattgtttcaggtaacgtgaacaggatgctcaagagctagtctaaataatgcttcatgtcttatttttcctgtttgttgataaggattcataaagatgtctttttctggtcatgtcaagggaaattcaaataaaaaacattgaattggtttggagctgtccattgaagggtactcacagcaggaattgagtggcaattgaatgtgtgtgtgtgtatgtttgtaaacatttatattagagtgtatgcaaatgtatatgggcgtgcccactgccatcaccattacccccaccaacagtaacaaaaccaccatcaagagcaatatccactaaaacttctaatttgcttattaatttgctttattatttgtaaataattcagaa

SEQ ID NO: 97514 - DNA, 1058 bp, Homo sapiens
gcgcccaccaccacgcccagctaattttttgtgtttttagtagagatggggtttcaccgttagccaggatggtctccatctcctgacctcgtgatccgcccgcctcggcctcccaaagtgctgggattacaggcgtgtgccaccgcacccagccgagattatttacttcttgtgtgttcttgccatctccatagcctcctttgctttcaaatgcccacttgggctgggcctttggaaaatagatttaacccttgtttattggaaggatattcacacagtaggccagttatacactttgtggcagtcgttacctcttctgtgaggtctttctgtgcagatttagtggcacctcctccatgctgcctgggcttctacttgcttctcatcactttgtctcataactcagatcagagactgtgtcttactcatctttgtatccctggcatctgagggggtggtatctgatgggtagatggattagtgatccacttagggtatttacactaatcttgttgatcttgactactacctttataaccaccaccattctacaagttttaacttttttttttttttgagacagagttttgctcttgtcacccaggctggagtgcaatggcgcgatcttggctcactgcaacctctgcctccccgggttcaagcgattctcctgcctcagcctcccgagtagctgggactacaggcacccgccaccatgcctggctaatttttttgtatttttagtagagacggggtttcaccgtgttagccaggatggtctcaatctcctgatcctgtgatccacctacctcagcctcctaaagtgctgggattacaggcgtgagccaccgcacccagcaaggatctttttttttttttttaaagctaagtgttttatacatataataatattgttaataaaatgtatctaaaattcataccaccagcacacaaggtctccggctagcagcagtaaatggcatttagtacttacttagcccccaagcctggatgactgactatactgacttattattacttttagctatttgtaggta

SEQ ID NO: 97515 - DNA, 3057 bp, Homo sapiens
tcttcctagaattaacaaagtgaactgggcacaggaaatagcacatggcacaccttcagcaaatggtggttgtgatcattttcatcattccatttcttcttgaaaaaaatccctttttttttttttttttgagacagagtctcactctgtcgcccaggctggactggtgtgatctcggctcactgcaagctccgcctcccgggttcacgccattcttctgcctcagcctcctgagtagctgggactacaggcacgggccaccacgcctggctaatttttttgtatttttagtagagacggagtttcaccgtgttagccaggatggtctcgaactcctgacctcgtgatccgcccacctcggcctcccaaagtgctgggattacaggcatgagccaccacgcctggcaaaaatccctcgagttccagtgtaaacactcacgcccttttttgctgtttgctataaacctctcattctccttggtcttcttgtccttgtgtgaggtcctggttgttgtggagactgaggtcttctgagacagaaaaccaaccccatagcaggcctggtgtgtgccctagaatggcagaggccccacacgttgccccggctcctctggaagaccctccagcctgtctgctggattccttgtacttatgaggattgttaaaccatctcataggattcctttccagactcagcccttcacttgtggcagcatttcttactctgaggttctgggcctagaaacccagtgtccataggcaaggtctagggacagagagagtttgtagaaagtgggaatgcatcagtggaaggctaaatccaaacaggaactgagctggcctgggtggctttgtccttttgccatcttcgtaaccctttaaaggctttaagacacttcttttgtaataactaccccaactaaatttggccagagctgtgaagggaaagaaaatctaagacccttgagggagatgacagccgaacgttttacatttttaccacctttgttgttgccatgcacagctgatacataaacaagtaatggcctcatcttctattcttttatttactggttagacccagaaccctaaaaggtagatgcttctcatggtcatttggcatttgcaacaggagctgaatttattaatagtactaatacctcatccttggacatccttgggttgtccgatatttttaaggggcatttacatcctttgtttttcatatggaaaacttttccgtaagggctggtatcatcttggccttccattgcaggaacagcacagggaggttcggtggctaggccacagttacccacgcagctaggtagcagcagaggccccacctggcaccccctggcttcctaagcacatcgcactgtgcagcctccctgaggaagcctcgagtggataggaactctggttctttaagataaacctgagttggatctcactgtcaccatttatcagatggggcgatgtcttcaggcaaaagtacttaacctctctgtttttgtttccttactccaaaatggtaatgatcatactactacccacctgggtggattggtgtgcatatgaaggaggtcatggggacaagtggttggaagagtgttgagcacatagaaagtacaagataaatggtggccattatgttactacttagactatatcatacttgtctttatctgggcttagaatcttgacactgagatctttcattctcagatcttaatatgaaagcttaccaggtaaacactaccccaacataattatttagtgggttcatacatgtgaaagcagttgaaatacaatttctgaactccgggttaatttatatccttagttggaacaggtagtaccctcccagcacctaaggcctctcacttctatccattcttcagatgacctttgcaataatcatggtaattgaatagcatctgcaccataacattgttgaataacatcaaaatgatccatttagccatcatgagccttcctagtaattcagactcacaccagttctttcaggttattgagtagcttttacaaataattgctaacagtacaaatactgtctcaggtattttggaagggtgaattttcccattgatttcagtgtatctttaggaggtaatttgcaaaaccgaagagtttggttccgtcaaagtcacccctaaggagtgtggaggaccacattgtaggtttatactgcactgtccctcatgcttgaaatttggctcatgcaaccaaggaactgaatttttaatttcgttaaattttgatttaaattttaaaacagaaatagtataaaatatttttctgttaaatataccttgtagtgttggcaagactacatttcgtgttaccatgctgggtaagatttcttgtagtgtgtattgtgttttgtcacctcgttaataattttcttattttggttgcatgttaaaataattttggatatattgggttaaataaatatattgttaaaattaaattcacttgtttatttttttgttggtgaggctaggctactaaaaaatttaaaattacccatgtggattgcattatatttctattagtgctgctttagctgcaagtagcctatttaaaaaaaatcattattttcagacttatggacttcatagaatcagaggtatttagaggaaaggatcttgggggtcacctaatccagctccaacattttgcaagtgataagaccaaggccagaggctacaataaaatgactgacctcctcccagatggggactggatcccagtggctttatagcctttgccttggatcctggttttacttggaaacatagcagacatcagagctgcagagaacttctaccagatccggagtgaagaaaatgccttatttatttatttatttatttatttatttatggagaccgggtattgctgtggcctaggctgtagtatagtggcagaaacatggttcactgcagcctcaacctcctgggctccaggatcctcatgcctcaaccttctgagtagccggggccacaggtacgcgccaccacgcctggc

SEQ ID NO: 97516 - DNA, 1032 bp, Homo sapiens
gagtaagatcatgtctcaatgaaaaaaagaaaaatcaaccctagtggactggaacagggctggtttactttgtgtcagctgcagtgcccccactcgccaacccacatgttcttctcctgctggttcccaagcagagaccagaaccaagaatgagaatcatcctgtgggtgcaggttgtatcttatcctccagagacagcacttcaccctctgttagaaacttctttaccacactgcctgtttggtgaaatccttagggcagtgacttccaaactgtgatccaggggccacccttggtgggaggatcaggaaggagggggaatgtatcttaagaaaagttgggggaagctcatatctcttctcgttgatcctgagaagtaaagtctttcctcctcagagagatgcgggtagacatgactcgcctagatagaagctcattcatctccctcccttctgcctctgcaggactcttggaagtctgggtccccgggagtatgcggctcttgctctgtgctacaggtttccaaagttcacttgataacagtacaattgtgctgtaaattgtgcagtaatggagactgaggaaacaattagtctttcatcttcattcatgttaccagctcacttcctatggtgtgaaaagagccagactttggagttaggagacatctgaatacagacagaactggcaagattatggggaagaaaagggaaaagtaatgaatattttcaaagaggttaagccatttggccaggacaacactgcttgcaggtagcagaactgggattttgactgtccataatccctattctctgcttgttttactccttccctctcttctttcttttttcattgtctaatgacctacagacattctgtcagctgctaaagaatgagggactcctttataaagattgataggacagtgtcgctacttaaggagttccttccatgtggaccagtgggggcgctgttgacgcatggggctggacttctctttggagcagagtcctgttccacggatcgctgtga

SEQ ID NO: 97517 - DNA, 2231 bp, Homo sapiens
cctgtattatcagctgtacactgacaagctctgaactctattgctttttcaaatcagagaagaaaaatgagtaagaaaagaaaaatatggatcacttaggctttgatgcctcctctgagtttatagtgtttaccttctgtattacttaggtgatcctctctaatggcattttaaatctctgttgatacttgtcttacttatgtatctgtttttttttcctctatagtagatagaatttatagatatatatgtattttaaagtaagatacaatttacgtaccttacaatttacccatttaatctaattcagggttatgcaaccctatgaatttagtagtttattcatagagttatgcaaccatcactgtaatcaattttcaacaccctcaaaagaaaccccatatccattagcagtcacttcccatttcccctcaactctcctggcccctggtaactactcagttattttctgtacctatggatttgcctattctggacatatcatgtaaatggaatagcatgtaaatggaatcatacagtatttatccttctgttgctggcttctttcacagcaatatgttttcaaggtttaaaaatgttgcaacgtatatcaatagcgtcattcctttttatggctgcatactattccattgtatggctataccacattttatttatccagttgatgatcatttgagttgtttccactttttatgtttctgtttgtttcttacagcagtggttctcaaactgttgtatattagactcaccatcagtatttaaaaaactaatgcccaggccatatccctcatgaaatcaaaatctctgggggtggggcccaggcatcactattttttaaagattctgaggggattctaacgagcagtcaggtttgagagccagtgccctagggcagcagtccacaacctttttagcaccagggactagttttgtggaagacagtttttccatagaaggaggtagaggatggtttcaggatgaaactgttccacctcagatcatcaggcattagattgtcctaaggagctggcaacctacatcccttgcatactcagtttacaacagggttccggcttctctgataaactaatgctgctgctaatctgacaggaggtggagctcaggcgggaatgctcgcctactgctcacctcctgctgtgcggcctggttcctaatgggccactgacccctccgcagccagcaggtggggacccctgccctaggggacccacctcagtgcttggtatccattgaagtatatagtgatttagaaaatctggttaggatgtcttatttaaatcatgaaagcaagtgcttttgtctttgatcattgcccttcacagccttacagttaacacctacattcaggaactgtgtttcaaagtgcctggcgagtgtttgaaactcactaaatatatataacctgggctcattaaacccctccagaagatttgggtaactttgttatgaaagggcttccctgaagtgggtcagcaggattgctctgtgttttttcaggaatgtggcctgtgataacttgcaatctagattatttggaaatagcactgagagaagccagtgaggacagaatgctcagaagcttgggataggtgttgaacatcctggaggccaggacggaacactgtcttactctaggaagctgtgttcctgggcctcattatcttcctccgttaaaaacaaaagacttaaatctccacagcagctttcagcaacttcattttttggttctctgtatctgcctgataaagtcccactttgtagtggctcccacttatatttacctgaatggcttttgggttgacatatttggaaactggggctaacttccaaactgttggcaacttgtgtgtgggtgtgcgtgccacagcacagcagtcccacttgagagacttgatggtgtggtggtggttggggggcttctgaagctggcttagccccagccctatacacccaccccacagatggtgggaacaagcccagaagagagtgggtaactctgtccactgtggcctccacagccaaggttgccaggcagagctcgcaaggcccaattccagtcttgtctttgaccgttgcccctttgtgttgggggggtgtatttagtcacctttctggaagcatgcttttctaattctagtcatcagtagtttgttgctttaagattttgaaaatggtatcctgttatttta

SEQ ID NO: 97518 - DNA, 1025 bp, Homo sapiens
ggattacaggtgtgagccactgcgccagtctgtttcttaatataataatagttttaaaaatttctgatgtttggcaatgtccaagattctgcctcacatttttcagaaactgccttttttcttaattaaatctcttagctactggagtctttgcctttgtttgccttgctacttggtacatttcttctgttccattggctctttttgttttgaagtagtgctcaaaaataagtttggtagtaagaatatggtgaagagtgtgacagacagggttaaaccaggctgaaggaaagagagcagaatggggaaaatttgagttgaaaacagctagcagaaagctgatggcgcaaattcaaccctaatctcatgttttggcacttctgaactatagcaagcataagggctcaactcttatctagttgaagcttacttgggtctttgagaatagtacatctcaaaattaaacactttcttagtccttattgttaagttgtttttggaattattgtcttatttgtctgaattaagtgtgctgcaggacttataggatctgatggatgatttgcctaaaagttggtccaggtcaacctcagggcatttaaatgcttggtccagccactttctgaaagttgactgaaatatgttgcacagcagggtagaggaggacaagtttactagatgtcatttttaacctgcttgtcttcatctctgactgtagaaatgtatattcattataagtttgccacaaatagagaatagagtttattctttgatcatctaatttctaggagctattgaaatttcactgctacctgcttttaaataagcgccaacaaacatttattaaaagggctttaaggtataggccaagatttattcaattgctaatggtatgttttctgtaaatgaaagcaaaaatatgttcaagtgtataatattaaatattaacattcagaaacttggagaaatacagatggcttttttttttgagacgcagtcttgctctgtcgcccaggctggagtgc

SEQ ID NO: 97519 - DNA, 1686 bp, Homo sapiens
tcagacatcgatttgcatatttgaaaacagaaaaagaacaagaaaatttagaattgattttgtttatgattcatattagattgttgtcatccataaagatttgaacagagtcaaacattttcttgaccttttgtcaaaaaaaactctccaggtgtgaagtggtagtaggatatagtttttcaccttctgtgcagaggatgtgttgataaacagggcagtaaggagagccttagattcagtatctccattaggtggaaggaaccatccattactcttttcaagggtgtcttggagagataaagcactttcctagatgagggatgaagttgatattgaaatagaccgatgagattatttttaagtcaaacaaaagaaaaataggacaggcctctcatctcctgaatgaatgttaagcaaagaacaacttgactttttagatatgtgaaaaatctcttgagaggttgtggaagcagcatgtaggaggataaatgcataactcacatcagtcttttacgcattaaaaataacttgggccattttgaaatctttctttcttgccctgggttcttataagcaatgttggggggaaaactgactctgtctttaggattaccaggaaaagttgaaagccaaatgcatcatttttcttaatatttgtttttattgaggataaatcatgtttaacaaagctgcatgaaaaaaaggaacccaacaagtacatttttttttctgggaatttcctctgtcctgactgaagacatttaaagggggttttgtgtcaatatttcctccttaactgttcctcaagcctgggttaacttttcagtatgcaggaagaatttggcactaagataataatagataagttactgggcacgtccctgggtgccagacataattgcttcacatgcataattttacagtaacctcacgggaaatattattatccctggtttccaggttgggaaaaccaggcataatagttagatcaggcattaggttaggaaaggttaggagagaggcatagagaaaggccaggacctgctaaggtgaccatactattgagtggccaaggtagcattcaaacaggtttgactcctgggggcttctaatcaccacttccagactgtaccaaaactccttaaactctaaataggaagaaaagctcacactttaaaaagtgggtaagttgagatttgcctattctgggggaaggagaggccggaatataaaagattaatgtctgcagcttttccatttagcaagacatttaatcactgtatgtgacgtggggaggtggaccttgttaaatacagggagagtgaatacaatccatcaatggtacccactgtggtccttttaaggaagacacagaggcctcggtggattcaatttagaaaggcaggactgttttttgttttttgtttttttttttttttgagatgaagtcttgttctgttgcccaggctggaatgcagtggcctgatcttggctcactgcagcctctacttcccgggttcaagtgattctcctgcttcagcctcccgagtagctgggattataggcacccactgcccggctaatttttgtatttttagtagagatggggttttaccatgttggccaggctgggctggtctcgaactcctgacctcaggtgatccacccgcctcggcctcccaaagt

SEQ ID NO: 97520 - DNA, 1955 bp, Homo sapiens
ccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggtgctgcctcggccctctgggccctgcggtggtgccgggacgggggcgggggagctagggaaccgcggcccgggagggacagccgcaaccggcttcccccacgtctggccagagccaggaccgcggcgctgggtagagccgccgcgcttgcgccggggcagggcggggaggggcagcggggacgcggccgggtgatccgaccgaccacgagcccgagggcgaacgggtgggaagttgcgggaaggtctggggactgagcccgctcgcgtgggccttgggggagaatccagccgcgtccccgggcccgagagctgggactccggagcccctaagtttgagcggcccggtgggcggcggggcaagagggggcggacgctggccgtctgagccggcgcggcccggcccttccggggctgcgcggctcccccgcctcggtgccggcaaaaatgtgcctagtcacggggccgctctcgggggaactgaggtcgccttcgggctgggacccggagccccttcgccgcgccccaagacctccttgagtgcgggctgcgacgcgctcaccccgctgggccgtctgtgggcgcggctttgcgaagtcatccatctctcggatcactctctggcagccttgagctctcttgaaagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggtaagagttgcgagtgtagattagaatttctgttgcttttagtctgttagtaattttttgctttcagctattatttctcccctgagtactttatatatgtttccttttcagttgagaatttgcctcaatttcttaacatgttccccctcttctgcaggggcagagagtggaacgcttgcgtttcaaaacacttgctaatttctgtgaattgttataaaagtgaaaagaagtttctgctcatcctttgtagaaactttaaaagtagatatttatatttctaacttcttttgtaaatgaattttaggaaaaaaattggaattcaaggaaatgtgtacttgatgtacagtaaatacgtttatgctgttaaatgtaaagttttcggttaattccaaagatctattgtaaagttttaagttatggacaatgtattaattgt

SEQ ID NO: 97521 - DNA, 1066 bp, Homo sapiens
ttttacgttttgatgaagtcaagtgtgtatgttttcttttgttgcttgtgtgtttgatctcatatcaaaaaaccattgcacaatccaaggccacaaagagttatgtctatgttttctagatttttatcattttagtgcttacatttaggtctttgatctttttgtgttaattttttatattgggtgtgaggtaaaaatccaacttcattcttttgcatgtgatatccaattatccagaaccacttgttgagaaggctagttcttcctcactggattatcttggcacccttgtcaaaaataagttgactgtagatgtgaaggtgtatgagttgctaaaatacctcttctgtgatatttataatttattttctaaaaggataagttataggtcacatctcagattacaatgattcaagtcaaaaagttcaaagtagaatttactttcaaaattgtttgttcccccagagctagttaatgcccccagagctagttaataaactctatttgcagataaaagcatgctttcccttcaaaggtatttcaccaagacgggaaacacaaaactaaataagctgggaaactgaggatacacagagggtctccttaatctctggatatgtggtctaatgtatcctttttgtgctcattttttcccttttatccagaaatacaacattacctttttataaaattcctggagattgatcatatctctagtgtttgggtctagaatgtattttttggccaaaacatctctttaccccacttccacatgtggaaagaaagaaaacatggtactctaatctcacaagtgaggcatggggttgtttcctgaaatgaggcaaggactttggacaagaacatgtttggacttgagatggtttttgtaaacccaaatgatattagttctagtctgtctttatcgctcactgtattttgttttcattcatactaatgaataatagacttgattgtgttccatcatttatgtcattaatatttcctttatgtttgagtgctgtgcagttctccttgaaacttgtatggagattgaacttgatagtga

SEQ ID NO: 97522 - DNA, 1063 bp, Homo sapiens
gcattgttatggatcttaaatgaatccaatacttacagcaaaccaggtggcgtggagtttggctgtatcagacgtgcaggataatgatgcaaatgaccatgcttacacaacccctctgcatgacttaggaacaatgcctacattatctttaagatacagaaaacacaagtaacatgtaagagacactgttagagtcagttcccctgatcactaatatcggtgtgtcgtcagtcattttttgtattcccatgtaactgattaaatctatttgggaaaaagtgtcggccatcgtatcttagattctgtttcttaaaaaaaaaaaaaaaaaaaggaagagtgagttgggggagggctgttgatggcagtttgctgccgctgagtctggcctgctgtttttctggcattttttcatctgtgctgccatctagagaggagaattggaaacacgcaaaaataaagtcccaagatggagttcagggaaagtggatactgtgtatttatttgtagaaaactggaagaaacatcatgagatttgggactataaatttatgtttttctcttctctctctctgtccctccaagatccaaaacaggacttggatatctgtttctcagtttttgtgaggacattccaggcattgctgggaagccatttcctggattcgaactgactccttacatacctaaaattcaattgtataaactttctgggacctctaaattgtcagaaagtggtctcacttttctacagttgaaacattgctggaaatgctcacattcccagttctgtaggatttggaaataaaatggcagctttttgtgtgtgaattaacaagagaaagaagtcctttcaacacagtggagcagtttcctgaagtctgtgccttccacagaatctaccagatctgcgggatgtttataggtgaaacgttggtcaaatgaatttggggattgcaaggtaaaacaatgttaagcagtttttataggctttaatttaccagtgtccactgccagcttgcaagagaggaaaatgctgggcaagctttcccaaacttgtttgacc

SEQ ID NO: 97523 - DNA, 1053 bp, Homo sapiens
caggagggcacaggcgaggtgggaagggaagtgacacgggtgggcggaaggcatcccggtccctgaaagtagggacccacctctctttcgagagagtggactagaccctggattctgtcaggaagggggcgggatgggatggtggattttggtcactatgtgagggtaacaggcttgaagaactctcgttggagaagggtttaaaggattcctttttcctgagcttttagtgccaggaattcattttttatcttgaattaatacttttggtgctgaggtcttggaatgggtagcagaggttctatttttctccgaggagatataaatttgtactagatgatagatcataggaatctctctcattcgcgaaagcctgctgtgggggaaactggtggtgccctggaaaaaggtgctgactggtttctgtggggtaagttccacttgcttaggatcaagatgtattgactttgagggaggaaaccgatgaatggtaagaagccataaactgcaaacactagctagtggtttaaggtgtggtggtatagctactgagctctgtgtaaccagaagctaaaagacaagagtctaaccgatgagggatgtttgtaagagatcttgactttcgatgtttttggagaaatctttttttttttttttgtatttttagtagagacagggtttcaccgtgttagccaggatggtctcgatctcctcaatctctgatgaaggctattaggagaagctactttctgacgtgtggctttgtcaccgtggataaatggataaaccgagagtgaaaaaaataagtagctaatgtttaaagtgtacttttaagtgtgccaaagtgtgctaaatcctttgtttcttcccaagctatgaggtatgtgcggttttctcccattttacagatgaataaattaagtctgctggagtcttagcagatatgctgtgtgacaggttagaatttgaaagcacatcaaattgacttcatggccaagttcctaagctatacttgcttctgatgaattaattcaacatacatgagtctttaca

SEQ ID NO: 97524 - DNA, 1022 bp, Homo sapiens
tggtggggaggggaggaataaaggatttcatctcgtctcctggcttcaattgaggttatattattaatagctgtcattaggtttaaaattttctaaatggtttcatgtacatttatgtgttctcatttgtatgcatatatgtgattgtacattttatgtagattcacactcttagaaccaagtaaggagggcaggttttccttatggttagatttaatggcttggtttacagcattcagagaaaaaatagtaacgtttgtaaggcacaccaagatgatggttgaaggtgactggtcagggatgccctgtgtggctgctccaaggactgaaggcatcgatagttcaggcacgactgtaacccatttgttgcataggttacagctggtgggaagccctggtctttggttcggggttagacgactagtggtaaaatctagtcctgtactggtactttgagattttcatcaaaatatgagggaacacagaaacttgtattagatgacacatcaaaagcttccacagagggtgatatacttgatagataatcatgaggaacccaagtctcccttctacttcctacttagctgggcctgcagttgccagctacagaatccagcctaaagggaagataaatgatagaggaagaaggaaccacagtatatatctaataaggtgtgagtatgcctatatgtcaattattttggaataattttgtgatttgtgtattattccttcccttttattactttggatgataacattgcttgtaattgttttatcacatggttgttttatcacatggttggttatatcacatggcctggagtagtgacttcttgaaatgccatattttcattcctgttacagaatagtcatgcatatgtttcaacatttatagagtagttgctttatgaaggtcctgtcctaggcattggaggtaaagagatgaataagtagtcttcagcctcaaagagttcacaatctaggaagtgagagacacagtgcagtttgattagagccac

SEQ ID NO: 97525 - DNA, 1099 bp, Homo sapiens
gaggcagaggttgcagtgagctgagattgcgtcattgtactccaggctggacgacagggcgagactgtgtctcaaaaaacaaaacaaaacaaaaaagtattatttaacatctgccggaagctttggtagatattttccagaaggaatacagctgagttaacctcttgtaaatatttcccaagagggtatcctgaagcctgtaagagctgatacagagcaaaggttatttgcacaagtgacctggcttaaaacttaacatcgtttggcaaaattcgagcttattttggtagttatgttgaatgaaatatttaccctattttgagttcctagctaggaattctagtgatagtagtaataggagttttaattgactaagtcctaatatgacaggaaccatgctaaagcttatgtacattatgtcatttaaatctcacacaacagctctgaaaaatgagtgatactatatgtacattacagttgaggaactagaggcttagagaagttaatttatctaaggccttgcatttgtgaaatgaaagagatggcatttcaactctgttcttgctccagagtccatattctttcctctatgctggattaccacatctgatgttcccggggagatatctacttactattcatcaagttgctgtctttgtcatgctaagtttcaaagtttttgtgattaaatagatcatgatcaaatactttgtcatatagttaagaaggcattagtttatgttgtacttaataaattataaaacatcattctgtcaaaatgaaattcataataagaaaatgtaatgggtggtttaaaaaggtagaccagccagtttacttttgtgagtgcattttgccatttgacttgtggaagaagacagtgtttggaatgaaagggaattaggaagaatgtggaagacccaagatcagagaagaaaggaggaaaagagaataggtcatggagggtttactgcctagttgcaaactgtctttggactgtgaatgaacaggaaactgaagatttaatcgctgtggttatttgttaatatgcttctctagattgcattttaagatggaccagaccttctctacatagact

SEQ ID NO: 97526 - DNA, 1034 bp, Homo sapiens
tttatagatattactgcataggaagaggttaaagtaattaaaatagtgtttaagaattaatatatttacttttcttaagtacatcaattgtttgaggtaataaacagaatgctcccaggtactaaatcatttttataaataaattaaattggatttttaaacaaagtgaccttgcagtgttcacatattatttacgagcttataagatttcagcttaaaatcataagtccaactctattactcaattacacattttaaatttgagttacaagtcagtcattcttaaagactagattctcttaagttttgtaaatatataaaatatcaattttttgtatagttttcttaaaaacattaacatctgtctttggttctcttaagcatttgtatatttaattctggatctttcagtagttgaaatacgcttactcattgaaaaaaactgctactattccagtaactgcagttacttttgatgagagagttttgcctcctgggtgagattcggaggggtagatatcgtcttgtcattcactaagaaaactgttatatgattgcatataacatttgttcttgccagcatgtttgaaattactaatcagagatttggccaggttgctgaccagattcttgttgttgacctcagtgggactctccaaattctatttatagttgctgtgtcagagacctcatcctataagcaggggaatgctcaggtatcccaggaccttagaatcaagtaatgtgaactatttaatttgctataatcacagaagttcgcatttccaactcagattgattacctagttgggttttacattttttctaaaggtgcttgaactaactgtataggaatccagcctaaggaatattaaaatgacacctacttgaattctcttatcactttagtcacatatactatggagtggatattttgctgtcaactcaaattttgtaggtcgacactatccagtagagctttctgtgatagaaatattctgtaatctgtgttatccagtatcatagccactatg

SEQ ID NO: 97527 - DNA, 1287 bp, Homo sapiens
gtgcaaaattgaatgattcaaccattgattttgataaataaggatttttacaactatgaaatattggtgttttgcaaattaaaaatagcatgttatgaaatattggtattttggaaattaaaaatagcatgttattttgaaatattgaaagtgagtatggccattaactgttacaatatgtaggtcaaggtagagattggtagctatatggaatttgaagaatttagaatgtaaacccagcactgagatttttaatctactttattgtgtctactactagtcagtctacttggtaaattggtctttttttaaaaatcgtagcagaaggttaataattatgatttttttctcatgtgtaaaactttgtttccttagttttaattgcaaagctttttaggtcattctacagtgtaaacccaataacatgtacaaaatgagacatttatattttaagcatatcttcttcctttttgcaactttttatttcttcctttgaatgcattaaatttattggttgtagccctctgtgaagcaggtgctgctcatcagagtgattctatattcagaaatattagtatatggacattttaatgtgtgctaattttatttaaccttatacaatatttgtgggcataaggtattttagatgattgtgagttaataatcaatgatatactgtacagttttaagatgtttagcattggtctcacttatatatattttcttctcactaggcaagaagttatgaaatggaatggatggggatataatgattctaaattcatcttcaataagaagggccaaattgaattgactgggaaaaggtaaccctggtttatttcttcttttgttcctcctttaattctttctttctatgaaaaattttaaacacacatgaaaatataatgattcctccttgagtttaaacattatcaacattttgccataactgctttttgtctcctggtaatatttcaaattctgatgttgtcatgtcacctctaaatatatgtatttgtgtgtgtgtatatatatattatatgtcttaaaaaataaggacctaatataaccaattatataatattatatatccaaaatagcaaaaaatttttatttagttatccagttcatattcacattctccagttgtctcacaaacatcttttataggtagtttatttgtgtcaggatccaaataatgtctataagccacccaccacccaattcccatgccattcagttttttgaaagtagcttcatatttaaatctggtaatttacaaggagt

SEQ ID NO: 97528 - DNA, 1063 bp, Homo sapiens
ttgtatttttagtagaggcgaggtttcaccatgttagccaggatggtctcaatctcctgacctcgtgatctgcccttcttggcctccgaaagtgctgggattacaggcgtgagccactgcacccggccagaaatgctaaattttatcgacaggtataagtgtagatagtgcgaaagtcaagtagctttctcccagtctccttaatctgaaatggaagatttaatactttgctgtcttccctgttgattacaatctttagaaatttgtaatttgttactctcataaagctgatttctatatatgttgtgttgtattttcctatgcttcagccttactttgaatgtttaaaaaaaagtctacattttatagtcattctctctaactgaagtacccaaaattcgttgtctaaaaataagtcaaagaaatcaattttattttctaggcatccttaaatcctagtgatacacctccttctgttgtaaatgaagattttcttcatgaccttaaagaaactaatatttcatattcacaagaggcagatgatcgagtatttagagctcatggtaagttactttatattagccctatttatttttaacaaaaaaattctatattttaagctgtttttgtgtttttcttttttttaaccacaaaacaggtcattgtcttcatgagatatttttgctcagggaaggaatgtttgagcgaattcctgatatagttttatggccaagtaagttttcccctcctcgtatcattaatttagtattgctaaattttaggtaaatttaacattggaaatacgtactttttggcatatgagttgtaaaaaatataaattgctgtatttttaagagagtttacataacagtcttgaagctctttcttgacttggttgttctgaactattggttttaacaattcattttgttgctgataattaaatcatcattttaaatgtaaataatcatatttgagatgtcagtggaaaaacatatttttggataatttggaagcttcatgaaattagtgtcagtaatacattcagatatatagaattatt

SEQ ID NO: 97529 - DNA, 1987 bp, Homo sapiens
aggctaggtagttgaggataagcagtgaataaaacaaaaatccgtgctctcaagtgccatacaatttaccgaggggaaacagataatccacaagtaaatatgtaacatattgggtagtgttaagtgctgtaaagaaaagaaaagcatgtaagagggtagtgcgaacaaggatgtgtagtggaatgggggtgcagtttcagataacatggttaaggaaggcttttgattaggtgacattcctagaagataattttgccttgttgaagattttttaatagacatctttgggtgttttgtgaattattaattaatgagtattctatttagtaaatttaccacagatagcaagctttataagtttaatccaaaagcttgaaaatagatatttattaaaaatcggaatgaaacaaatgacatgttttcttagctttacacaaaccttagaaaagataattgcaacttttatggaactatttttgctttcataaatggatattcatttgctttcctcagcattcttatttcctactaagtccttaggctcttagcaactaatactggagttttgcatagttttcttgcctcaagtctcgctcctccatgccatctcttattatatcaggagattgacttttctaaaacaatctctttgccatcttgttcccctccttaagaacctccactaatgtcctattgccagtcaagttgagtcttagcacctcttgcttggcatttaaaatcttccagtcaggtttttgttacttgtataacttttacaagcataaagagaaccctttagttctgtacaaaggaaaggaattatgtgcagtgtattttgtgcaatattgtaaacatttgtttaaacaataaatcatcaatggtgctaaaattagtaggtgaaagtatgatgagaatcatgatattttacatagtctaagatatgtaaatactgtgtcactaggttttcccactataaggatactgtgtttcttgttgaaattaataggtatttaaataataggtatttgaacaattaatacctattaattttgacaagaaacagagtatccttatagtggggaaacctagtaacacggcctaaccaaatgctgtattaataagttaacattactggaaatgagacatgttcatatcatgtgcctctagatgtaatgcactgacaaagatgcaacatcacttctgtggaattactcccaaaatatataacctgaacttaatcatgaggaaacatctacaaacccaaattgaggggcattctatgaaataactgaccattgttcttcaaaactgtcatggtcatgaaagttaaagatactctaaggaaatgcctatttttaaagaagacacaaggcaactaaatgcagggtgtgatcctggagttgattctggtccagaaaagaggacattagtaggacaattggaagtatttgaataaggtctgtagattagtttattgtattgtatcagtgttgattgcttggttttgaaattggactgtagctacataagatgttagtatttggggatgtgagatgaaggaaaattttcgtactatctttgtaacttttttgtaagtcaaattatttcaaaatgaaaagttaaaaaggtaaagtgttttagtactcaattaactcattgtgttaatgagcaaatgaatgaaggaaaagtttagataaagaatttcgtaggttcttatttgccaaggttatcagattttatttatgcctctgtaattaatttattttcccttttttcaacagcatgccatgatgatgtagttaagattgtgaatctagcttgcaaatataatctttgtatcataccaattggtggtaggtattgtgccttttgaattttaatatgtaaatttgttctatttaaaatatttgtattttaaatatttgcgtcaccctactgaaaacaaacattattgtaattgtgatgtggttattctcaaaaattggtc

SEQ ID NO: 97530 - DNA, 1047 bp, Homo sapiens
actcgcttgaacccaggaggtggaggttgcagtgagccaagatcacaccactgcactccagcctgggtgacaaaaaaaaaaaaaaaaaaaagaatctaatatccattttgttttaaatgtatttcatcattacattttacccttgtattcagttctccaaaaggtaggtttacttttaccctcaggtatatatgttgatggctattttaccaaatttgaatttttttttcaaatacctaagtagagagaatagtttacccattttttagatgaagtcgttattaacattttgtcatactttctttatctttcttttttttctagtagttttagagcaaattctgatacaatgctactttacatgtaaatatttctgtataatctcgtttaaaaaggacattttctcacataactattattatcactcctggcaaaatcaaaagtaattctttatgttatttagtagttagtctacattaaatttttgataaaaagtgtctgttttatagttcatttgttcaaatggggatccagacaaggctcacatttgctttccattgtagctcttaagtctcactttatgtaaaagcttcatcttactccctgtttttttcttttgaatgttatagacttttgaagaaacaaggttatttgtagtatagaatgtcatattttgaatttatctgttgctgcttcttgtcatttaactctttatctaagccctgtatgtccactaaattagaagttccatataaagtctagttagattcaggcattgcctttttttggttttgtttttacagcaagaatccctcatagatggtaatgtgcttttaaaaaaatgtcacataacatcaatagaggtgtgtagtagctgattgtctcacttttagtgatgctaaaattgatcaagttcagatggtgaacactttattttattgtaaggttccccattaacctatctccttatcccagattttaagaaaaggcaatttatttcctcagaagatagctgaagaatagcctgttctggaatgttaacatggg

SEQ ID NO: 97531 - DNA, 1053 bp, Homo sapiens
aatcttatggtcatattctgatattcttaaattagatagtgattgctatgttaacacagtgcagatagtatttgcacaatgccaggacctgtatatgctgtttttttacatggagtacctcatttaattattgtagccaacactttatgtattattactattttacattttacaaatgaggaaacaataagcttagacagttaaataatttgcctaaggtaagagaaggaatttaaattaacctctgaataaagacagagtctatgttttaagccaacccctgcataatatgctgcctttgttactatgttgtcatgttgtatagtctgggataagtggacttggtttccagtgtgggtggttgaggggaacccttcttgcttaatcactgtcttaccacttgttgctttgaattaggaagttatatttcctgagaaaatattagtagttcctggagatcagatttctttcttcctttgcaacagaatcgaattctctgggttgatgagaacaatttgacagctcatgtagaggctggcataacaggacaagagttggaaagacaggtatgttatttatttttcttatttttttaaattaacttattctaatatcaattctgatgttatttctttaatgaaagttttcaaaactgtatcccctctatgaatgaaataccttttatgatacattcattcactcaaagaatttgtttagtttctattatgggtcaagcattgagctagattctgaggacatgatagtgaataaggcattgtctgctaccttcaggtagcttagattaggacagaaagttcgataaataattaattatttggagtgaaaattgctatgtggatgctaaatgcagggtattatggatcatcaaatggggctaggtgggaacgagttgggcaaagaaggtatcacatagaacctggcattttttttgttgttgttagtactgagtcagtggcaaaggacacagcatttaaaatgagacttcaggatgagtctgagttagcaaaaaaggaaagaacaatccagaggaag

SEQ ID NO: 97532 - DNA, 1045 bp, Homo sapiens
aaatgcagctcaaaaatatttggaaaaaaaaataacaataccacaaggaaaataatacaaaaaatatagtagaacaacaatttacatagtatttacattgtattattcataaatattctaaaatgatttaaagcatgtgagaggatgtgcataggttttatataaatactgtgctgttttatgtaagggacttgagtactatggattttggtatcctcgaaggtcctagaaccagttctatggggatactgatggatgtctgtatacaaatattattttacaagcctcgtggaaatgaagtcttcaactctaccgtgattttagtccatttacttagatgatttcgtttttgctactctgtttccttaggagattttgcatttttctgaaaataatttttcctgtatagaattaaataggctgattgaaattgttctaccaagtagtggtaagacctgtcatgttttatgtgcacactgctttttgtagctgatatggtgccactttgctgggagttagtataataatagtatataactctgggcaccctagttagggattaggtatcatttgttgctttttcaatgattagttgtgtgaatttgtacaaattggtttacgtttctaaacttcagtttcctcttctgtaaaatagaataatgatatttgctgcatagaattattgtgaggagtaaaggacataaaatgaaaactcaaaatctctggtgtgtagtaggtgcttcataaatgttgtttccttatcgtcaatattttcatagtagtttaaaagaactttaatttgagactattaaagtgatgttcccaacattattcctggagctatttagctttgcttttgaaatctaaagtttccacattttcatcaatatctttgttattaggaatattaaatctttaataaaatatattggttctttatagttaacactgaggaattaaaaacttttgtctatattgtgaatactttttaaatattttcattatcctatttatttttctttattcaaggcatttagaaaagcac

SEQ ID NO: 97533 - DNA, 1179 bp, Homo sapiens
attctcattgaaggttagggtttttttgcccaataaattgtttttaagactaaaaataagcacaaatatcaaaatacgcttttgtctgaatacatatgagacataagaatccattgtttttcaatttttttattttaataagttgtaatactttaaaagccatttaaaagtaaccttcttggagaaagtttactttaaaatgttgaaaaatatttgtacatgactaattaaagcgtattcctaaagcttttttgagaaattgtaaaatttgcttaattttataattttttctagaatgacttgagtagccattattccccaggtagacttgataaatttaaatgtgcataataaattgaattaatagattaaatagatttaaatatgatttagaaaattgtcatgtgatgtactggattattcccccttctttttttcaggaactcttggtgtaataacagaagctacaataaaaatcagaccagtccctgaataccaaaagtatggctcagtagctttccctaattttgaacaaggagtagcctgtttaagagaaattgcaaaacaggtaaaagaaaaaatatatatatatacatacatacatatatgtttatgtatttatatttttcaaattctactacatagttgattgtgatatgttacaactaatcttcatttttagttgtattatatttgtggtttttacccagttctatatgaaaaggtagtgttgtacagtcatcctttaagtgcagttactatttctttgagtaagtatattgctatcaaacctatttcttggtctagatggctatatgattgtaagccaaggtaagatagtactttgattggtagcttcagatgactttgccttttattgactgttatgtgtcttaagttatttttgggtaagatattttatgattaattgaagtgatatttaatttaaattgagacatttattgaaattaaaagtaatggctaaatatcaaagaccccaaaatttaaatataggtaattcaacttcatcaattcatagaatgtgctgctactaggctatactttgtttcataatattatctaagctatagcttaaattaaggaatatactatgtgtaataagctaaaaagaatttttattttctcccctccttaaaaaatatattattaagatttttt

SEQ ID NO: 97534 - DNA, 1023 bp, Homo sapiens
tgtaatgattttggattacagtcattgggtgaacatcctaagaattttttaaaatgaataaaaggacaagttttactgatttgtgtaaggatgaaggaaaattccatcccctgcttgtcttaaatagttttattttccctctgtctttgatgagcttcactattccccccacaaaaagtgtggttttttgtttgtttttttaagatggaatcctactctgtctcccaggctggagtgcaatggcgcgatctcgatgcgctgcaacctctgactcccggattcaagcaattctcttgcctcagcctcccgagtagctgggattataggcgaccaccaccaagcccagcagatttttttgtatttttagtgaagatgggattttgccgtgttggccaggctcgtctcgaactcctgacctcaggtgatccgcccgccccggcctcccaaattgctgggattacagtcgtgagccaccatgcccagccacaaaaagtgttattaaagaattgtagttcatgtcatttcttgttcaagtcttgaatgacataattctaattcaccattattgcctctaattttatgaaaaaaaatatgaatgccaaattagatttttcctttctgagacagggtctcactttctcatccaggctggagtgcagtggcacaatcacagctcaacgcagcctctcaatctcctggatgcaggtgatcctaccacctcagcttcctgaatagctgggaccataggcacacaccactatacctggctaatttttttttaaacttttgtagagatgggatctccctgtgttccccaggctggtcttgaactcctggactcaagcgatcctccagtttaggcctcccaaagtgtagagattgctggcatgagccaccatgcccggccccaaattagattttttaaaaaattacagaagttataaaagtagtttggatttgtatttattttcaacaaaagatctcagagaggtcgtgttcagtctgtattgaccaactctgccc

SEQ ID NO: 97535 - DNA, 1673 bp, Homo sapiens
atttttaagacgttctcagaaaatacatttcctgctgtagcctatgaagaggaggaaaataatgttttttaatcagcatatcagtgttagatataacgtgttattattctctaaaagagataaataaaattgttagtttggaaataacgatgtctttacaaggttaaaaggaaaaccgagtgttaaaacaagctcagaagcagtttctgaagcttgggttttttttgtttgttttcaataaaaacttaggagtagtgccctatggtattttgagaggagcatttattccaacaagaggaaaaactgtatttggtattgattagtactcattcctctcaaaactcttctcagtaaaacctagtttcttcgaactaggtttttagaattatagatgaaaatgcagcttttcttcccactaccttttgatggagggtaatttttccttccttctatcacttttattttaaacaattttaaactgatgaaggtttggggttttttgtttgtttgttttaatgattttagattataatttgggaagacataaattttatgaattgttctgttttaaacttaatttatcttggaggagttcaaataaattagaaggagtcaggtttagcacttaccttataaaacacttaaaacttctttttattcaacagtaattcttgggagtatttattacatagagaaactgaaattattttaaatcattttttttgtgtcatgcgtttttttctctgaagcagagagaataaccctagtcaagtgtttggttaattggatcatttactgtttgatccagcaaaattaagacagttatgagacatgttctctaccagaagccactcagaacaagttattatacctttactaaactgaaaaactataaagttataattaggagactggcattatcttttggtcttttccttaatataagtggagggcaatattcactccctattatgtattattttattctttaaaaccaagcaacaattgacttgtcaaaataaaaagttcttattgtttatcatacggactcctagctgtaagtcagtatgtcatctctaagatgaccaaccagtaataactgtagccttaaatagtctatcatttcatctgtgataccaactctgacttattagttagaagaagaatttgtctacattttaagtttttatgtccagaaattcacatttaacagattatctttttttacatagccttttttgaacttttttttttttttgagacggattctctctctgtcacccaggctggagtgcagtggtgccatctcagctcactgcaagctccacctcccaggttcatgccattctcctgcctcaggctcctgagtagctgggactacaggcgcccgccaccacgccctgctaattttgtttttgtatttttagtagagacagggtttcaccgtgttagccaggattgtctcgatttcctgaccttgtgatccacctgcctcagcctcccaaagtgctgggatttgaacttttaaattaatcaattttgttgtgtgccttatttgaggtagtgtgctcttagcttgataaccaacataatgcaatggatagtatgcagttatatgtggttcctcacttctagtgaggatgttgcatattatgataattttttgtgcccaa

SEQ ID NO: 97536 - DNA, 1735 bp, Homo sapiens
gcctgaaatagtgctcatctaaaagtcagaatgtcttcatcttctacctttactgtggataaaatacagtatagttcataaaatggcataatacttgaggcactggattttagttttagaaacatctttgttctaaaataatccactttggggtctggtatttcttttaggatattctcatatgtctttgccagacattaggcagctttttctgctgataaatttaaaatctgttaacttatgtttgtatttatttatctatatctgtagatttcttctctccaaatattttatagaagtcattgatatttgtcttcataaaagtatatgaaaagttaactttttttcctctgtaaatccttaggaactaagctcttgatctcttaaatatagaaagataatattcacattctacctgtctagcttcttactgtattaaatttgtatcacttttttttttctttttaaaacagagatgtgctccggcatctattcgcctcatggacaacaagcagtttcagtttggtaagtaaggagtggtaattttaaaatgtcatttagccacagaaatttatgaaacatcagtaggaagagtacggagtgcagaggtagaaagaacgtcagtcttgcctttcaggaagatgtcagtctaatgaagatagacaattacataaatgagtgagggtagcagtgttggagggcctgtgaaagaagactgcactggataccatgggctgcaaatgaaggaattgattcttcttgattttgcttgaggataaagagtcagaaaaggcttttataagagagatgcttgagctaaatcttcaaaggtgaatataagtttgcctagatgtctcttcttcttctcaaccagacttcttcacttggcagcaaaaatgtgaaggtgtgaaactcaatgatgtgtgttaggggacttcaaattgttctatgtggctcaaatagagggtggggttagagttgttacatgagataaagttggttgggtgggctagggctttgcaggatagatttggattttgtcttgtcagcagtgggatttctttgaagaataaaatcaatcaactttacatcttagctcattctggcagcattgtgcaggatagattagaagggtacatgcatggaggagagacactaggagatgaaacagctcaagaagcaaagtttgagggctttgagcatggcagcagcaatggagatagagaacggatgatagattttcagaaaatcagtttgctaactggatgtggaaggctaaataaaaggaggagttgaagacaacacctagactgatttgattgggtagattaaataacatagaagaatgggtggtggtcttgggaaaaagatatgataatgggttgtagttatattgtgaaatttactttgggatttaagtttatagaatttaaataccctcaaaacaattcctaaaatcatgagagtgatcgttcagtaataaatactaaaggcaaagataggcaggcttttgtcatgtctaaaagtaagctgagattttaatttagggaagcatggttatagttacatagaaacttaactaaagtcaggttcgtaacatattaagagttttaaaattacattcttctaagttagtcataattgtttatttctttaagtaaattactttcaaaatactatactactgacaaaagtttaagataaatatgttctataagtaatgaaatacttaaat

SEQ ID NO: 97537 - DNA, 1913 bp, Homo sapiens
atccccaaaccttaaaggcttttttaaaaaagaaaactttttatttggagataattttgacttacttaagactgaaattctttataaaaattttgtataaatggtatgacacctttttctgaattgggctgctaacactgaggccagatgcatgactcttaaatgtagcaatcataggagttgagtcgttactactttctgaaaagtgagaaaacagtaaaaggttttcactcaattaagcttaatctgcaggcaaagatgttaatttaacagactttgagactccatttatgttattttggcaattttaactctccgggtgtgattaaggaagcaattgctagttttatgccaagaattctggatgaattaacaattaattaagaaacaaccttaaacttggcattaactccatatttggatagttctgaatagtttctatataattaaaaaaaaaagtaaaaccagccaccatgggtgttcttaatgaaataaaaattaatgaagtaattttattatgtgtaaaccataccgttgaaagaaaacctaaactatgtgtagtattaattacatatagtgatttgacttaaaaaatcaaattgataatgggttttgtaaataaaaagttgtttgtgacatttgaaagaagataaaagtagcaaatattaatataactatatatcgtaatataaatatttatgtaaataacacgggaagattttaaaaattaaagttgtgaaaacttttactttcttttaggattctaagttggagtagcttcttgatcttctgaaaaacatagactaacctattaatataaacttttttctcttcttaggtcatgctcttaaacctcaggtttcctctatttttacatcatttttggacggattaaaaaagttttatattacaaaggtaagaatttttataaaatgctaaaattgtaaatgcttaagatatctgttttctgctttcttcccacatgcacctattgtaagggtgtttttccatgttgctatgtacatttcagaattacagtttttcatgttggaataaatattaagtaaatcaggcagtcaatttcagaaaattttatttcttttccagttttgaagcttctaaaaataacactgcatttgaacagttttgttttcataacattttctatagtttaaattttttcctttatggaaggtatccataaagtgaaataagagtgtggattttttttaacctttgattgttgaatttttttcctagagtgttaagccatcttataatacatgtgtgccttcttttccttgcatccttgttattccatgtgggattctttttgttacatttttaatttaccagggggaaaacagtactttcttctagttcatgttttttgaagctccaatgagactgaacgttaacattttttttattttctagatctaatttttgtgtgaattcgttggatatggttatttttgccaggtggtggtggggggtgtgcagcttcatgtttttttcttggtactttgatgtatctttttttgagattggaattattagatgtcctttgtcataaatgttgtaagtaattttttttcccagtcaggcatctccttttttaatagggatttttcttttttggtgtaaaagtttcaaatttttatatcttttcctgtgattatttaatatagtctaagcttagaaaagccttccttcctccagtaatatgatcagggccattttcttcactctctctctcttatactaaatgagaatttaaaaaaaaaaaagtctttattactatttgtatttatttcaattttattatgtgaaaaagatctaaattaatcttcacctcctgctcctccaattgttaaccggttgtggcagcaccattaattaatctgtgcttc

SEQ ID NO: 97538 - DNA, 1089 bp, Homo sapiens
gttagattgatatgttgctcttgtctaatcatatatatattattattaaacattgtatttttcctagatttttacattaatgtcaatttcatgatatttgttctactagagtaaaatagaaaattcattgtcctcttactctgtggtgataatagtgtatgtataaagcgtgctactagtgtgtttttaaaaggaaattgtgtttaatcgaaggtatttgataaattatctatactgcaccccctgtcacttactgttttgtgctggtataaagaaacagaaaacatttcacatctataaccaactgaataatggtagggtggtttctctctgtcttcttgatggattataagactgattgatgagaactatagtgaaaatgccatttatcaggactatgttttttcctttccttttaaagtacataaactaacagtttctagacactaatcttttcttttttgatttcagggattaaaatatatcatatacattatgcttaatattagttctttgtaaatatttattttcatttctttttcattgttttttaagaaaacaaatgaacacttaatttggacccatgtgttttagaatgccccacttttatgtattttttttcatatctaatattagccctttatttctagggttgtctgaatttagtgttaacgtgcagtattcttaaaggggaaaatagtctaatcttagacttaaattttagttttcttttgcactatttttaagtattgaaaatgtctcacttttaccctattctgaaattggcaaatggaattttaattttttcagtaaaagagaaagtttattcatctttcatcttttctcgatagctgttttgggaattgctgatattttaactaaatcacttaaaaataattgtgctataaaatccatgtaatgaccagatggcttgaatttcaggtcatctcatttttgtttgaatttttgaaatgtacatgttttccttcccagaaggaatttagccctatgtatgtacccgttttttagtttctaagttatagggagtacgtatgtaatttgattaaaggactgttttcttaaaacata

SEQ ID NO: 97539 - DNA, 1651 bp, Homo sapiens
ctttacattgatttttatgaagtattcccaacaatttagagcatttttatgtgttgtcttagccattttttctctttgcttacccttcactcacaccccaacatagttcaatacctttgaacacatatgacccaacagaacatagtagccacataatgaataatcatactttgattgtttatccatgtttgctagtaatgtattttaacttctccaagagcagagcagaataaacattacctgtcagcactcatgacaggtgttttgacatttaccatagaacttaaggtaatatgttatcattatttttaaagcatgcttaagttgtttaatataattcaacatgagagtgattaggttcaccagatggcccttttatataaaaagattgtctctcattcctctttcattagtctttccagtccttcctcatgagacagctttaaatttgtttaaaaaccttgaattgatgtttgaaatttgtggggacagcaggaagtaggggatcgatgttgctactttaacataaagcagtttgaatctacatgcagtcattttggagtgattacaaaagtcacaatttagaagcatttgatttttaagccctactattctttaatatattgtattttaaggtaattctggctagaatattgacagttctgaaagctaaaaagagaaaagtttcaaaaagttcagtcataagtctatgatttccttgtaaagcccagactgactctacttctttgggcttatgaatttagaaaggacatccaatttcttcctgctttgaattagaaaatgcatgtttctctgtggtttgtctccctggatcctaatgtgaacagatctgtttcctccctactgccagatattagaaatattagaagagggtctaaagaaagatgacttaggactgaaaagtaagactttttgtctcatctcgacataacagaggcaagcctattaaatgtttatacctgttacttctcatcagatacatacttggcattctcttttctcaaatattcccaacacaggtgccttgcaccttttcctactcctcactctcttttcctttccttccaccactaggttcaggatggatgaactgtttctgtttcctagacctgtggtgctttttctctcttggactcagagtctgactctattttatatctacttgagctatgggctaagctgttttcctttacgcacttgccacagcagttttctgacttgttttccttttgttttgaaacttggaggctttctacctccaacctcacatccaactcagaattgtgttttatctcttcttctcactttcagctgcttgaccaaagttttatcttctttgctcattaacattctaatacaaacagtccccttcattttttttattataccccattctcaagtagttctagactagagctgcttatatcaaatctttgccacttcttttggataacaccatctacctatagtggcaagtcaggaaattttgatttagcccatttagcttgaaattatcttacagtatttgtacagaacaagagtacatctacattgtagtgtttacttactaccaaattcaacacaacttcagaagaagaaaatatttaattataaggtgttaattgaggtg

SEQ ID NO: 97540 - DNA, 1089 bp, Homo sapiens
gcttttttgagaatatgggtagaagtagttgagtttatgagtcaattttatttcgtggataaaagtttgaaattaagatgaaacagaaatattaaaagtgttttcagatttttgttattcaaacttattctcttgacagctttttgatacatttatgataaatgagattaagataaaaaatttattaacagtttgttctttaattacagtgggttggcagctggagaagataatggacagagaggttatttgctgacctatgttattgcatacattcgagtaagttatatcatatttcccttgccacttaatttatgttgcaaacaatactttttcttactttaagtgaatgcaattgtcttccctattttttaaaattttaagctactgtaatttagcatatcattttacatgaaccttattttagctacaaatcttcagaagcccatttaaaccttctccatatgctcttgaagaagttaaagatgatttaatatgtctttctgctctttaaaagaatggagcctttctctgtttaaaagttgagcataccattcataacattacttggttaaaatcaagctgttttacttagcaacactcttcacttaataatctgttttaatgatgtgtaaatctttaactgtgttgtaaaattttgatatttaacttgaagtagttatttgttcactgatgatgattatagaattaaagaaataattatgtgtacttgaacactcaaatgtttctaattctagattttctacttacgatatactgaaatagtcttattatctcaagtctgttgtatttactgatatgaaattgttcttttgaaattttattttttcaatttagttttgtttttctactttgtaacaaattcaaatttcttaattgctttctgctgttgctggggttactttttttattttttatttttcctgtttacataatttgaatgatcttactctaaaaggtcattttttcagatatcctattgagaatttggcttccacaaatactcagctttcttgttttaattataaaaatttttggaaatttatacataataaatatacatatttt

SEQ ID NO: 97541 - DNA, 1412 bp, Homo sapiens
gatccaaagaacgaaggtattgttgaagtttacattttgaagaatgttattgaatgctcagtgttactatgtggttatacttcgctttgacttaaattcttaagtgattaatattgcttaaatgttctctaaaaagtcctcccaaagtataaaaccagttaactgtcctttataatattatttagtttttgatatttgtatgtgtaaaaatgggaatttaggtggtttataaaggaaatttagtttaggaaattatgtacaatttctgtttttaaatttaagcaaaatgttgatactggagcatattttaggaaatggcccaaataagatagatggaaatagattttagaagggtttctttactggaaatacatacatacagtattggttagtgacttaataaaaactgattaggaaatgcgaaatggtttattaatagacctgtgagttgtattataactcatccagtaataaaaaaaatcctcaaagagattgtctatacaatcccttattcaaaatgctcaggaccagaagtgtttgagattttagaatatttgtattatatatttaccagttgagcatcccaaatctggaaatttcactggaaatcactgcagcatttcttttgatcatcatgttggtactcaaaaactctcagatttgggggcatttcacattttggttttttgcaggatattcaacctgtatatttttatttgtttctagtatactgatattttacttttctttataaaatttataaagtactttaaatctacaatgaagtgtataggacggaacaattccctgtgaatctacttcttagattgcatatcttaatattttggtttcttccaatccctcttttttcccccagaaaactttttacttttctacatgcagtcatcatctactgagttagtacgctggtgttcgtattccatgcattgttagctagtaacccagtttatgttatactatcactcagtcattcacaattttttttattttttaagtcagatttctcaagttgaaatgttattcacaaattttgatgctaaattttaacaaggggaataaatcctttcaataaaaaaattatcaagtcatcagcctttgagtagtagaaatagtttggcagcggctgggcgcggtggctcacgcctataatcccaggactttgggaggccgagacgggcagatcacgaggtcaggagatcgagaccatcctggctaacacggtgaaacctcgtctctactgaaaatacaaaaaattagctgggcctggtggcgggcgtctgtagtcccagctactcggcatgctgaggcaggagagtggtgtgaacccgggaggcggggcttgcagtgagccgagatcatgtcactgcactccagcctgggcgacacagcga

SEQ ID NO: 97542 - DNA, 1028 bp, Homo sapiens
aagaaaaaactttcttctttttgaagttaggaatggagggctcaatttgagtgatcagggctcttttccattcttgaaaggacaactatgaaagctttagctaagaaaatgtcagacttgaatgatgccagattaaccaacgtttattagcacttgtgtagttctcacttgaaaacttaatattgtattcatttatctttttttagggtggtagatctctgtagaaatgtaaaagaaagaataacaagggaatgcaaagagaagggtgttcagtttgctcctttttctacatgcaggtaagttttaaaaattgttcttatacttcttattctgaaaaaaatgttttttttaatcaagggggggaatataattttccagctgagaaaaagcttcagtctattacatttggccagctttcctaaccttcacttaccaccttgttaggattgtgccactggaattttacagtagtcctgagccttttaggagtaggacacccttctgtgagtaagccttccctgccatctgggtggcatggcagtgaagagccaggtgtctggactcctggaaaaagaagaggactactctactcactgaaactataaattatatagtcaagaaattataaattatatacatactcaacatgactctgaagagtgaaggcagtgttttgttgtttactagtaatttaatctcttcaagctctaatattatcagtaaaatagtggtaatgccatttcttcatgggactgttgtaaaaatgaaatgagaaagcatatgaaaaaactgttaggttctgctgtagtattgttttgacataattacattaagcttgaggtagataatccatactagtattagtaaggaaaatttgtatatttccctttcctttccaatgacaagtcctcattaaggcattcagttgttaagcttacttgctccttatagcatgataatttgcatatatttgttttccaagactagaaatatttctgtattctttaaactgctaattgtatgtgtgt

SEQ ID NO: 97543 - DNA, 1066 bp, Homo sapiens
caaggtgtgaagatatgaggcctagggagaaaggtgagaagatatgaggcctagggagaaagaaaagcaggtctgtgggccacagagggtctgtgttctgtagagttggtgctgagtgaaggtatatctcctcaagctttcacagcagtgatagccgttgctcctttgatattggtttcttcctcaagttctttggtttttcttattcctgatgtcagaattgtagttattttcagctcatttttccctgcttttttcccttaatctttttgttcatctggttcctctactcatggatgtctagctttttttactctcctttgttatctcctggttgatttctcctatatcttagtaatattggcatttgttttacctagaacaatatcttatgtttctttgtcagtctccatttaggtatgcctttccagaacacttttcccaatccgacctatcccaattttcttattctttgtatagactgatttttaagctgcataagctaattgatggtgtctgtctttatgttctctcagcattcttcaatctcgtttgtcattctgtatctttagactatgtcatattttggctatatacagcttagaagagtttcttctagtgcatttaaattatctgtgtagaaaaaaatattattgatatttattttgttgtcatttatttttaaagttatagccagaactgaacagtgtctttgttttggtctcaactgcagtgatttgctttttttctacccagaatctttaagtctgttgagccaggagaatccaaacaaatgatgagttcatagtattgttgccagagtgtgacaggaaaagggtcccaggatgatccagacctcaggagaaggttcttggatctcacacaagaaagaattcagggcaagtccacagtgcaaagtgaaagcaagtttatcagcaaagtaaaggaataaaagaatgactactccatagacagagctgccccaaggtctgctgattgcccatttttatggttgtttcttgatgataagctaaacaaggagtggattattcatgcctcccctttt

SEQ ID NO: 97544 - DNA, 1019 bp, Homo sapiens
acacatgctgctgatagttctcattacttctagataacaaaacaataaaatcagtgaaaatggcatttcatcataaaattctgatacaatgtataaaagtttttgggttatttcccaatagaagttttagtaacatgggacagacatgaaaaagattgaatatgtacctataatattgactaatttggtacttcagtgaaggtaaaattcttgttttgcactgcgtcctcagttcacctgttttggcggacaactctaaagcaagccaatgtgtattccttccatggagtagaggctgggaagaaactgagattatatcttaaactaatcatttgggtcgtcttgactttcagtttctagatgttaaatctgatttcacttaacttaaagcccctgtggggattttgtttgttttttagggtgacgcagacttacgatgcaggtgcttgtatctacttctattttgcctttaactacaggggaattagtgacccactgaccgtatttgaacaaactgaggtaattttgcatacctgcatatagcttttacagctgttgattaatttcaataaattttactgtcaatttatgaattttaagttgagtctctttaatcacacatggtttgcctagctgttagcccttagaaatgaaaagcatatttgtttccctggcttatgtactgaattgtgagtctaaaattaaggtactgtacacctagtctgtgattcttcagttgttacagtacataatagctgattaaattaaataacaattaggaattcattaaattaaataactatataggaatcttagatatcactttcacagcccactcatttccacatggtggttgctgttgaggtcagcagccctaatgcccttggtctgtgttgttgtaatgtcattctagatttgtaatttttttatatgctatagctgtaagtgggtgctttgggttcattagctagcagtttctattactttcttaaagagtgtcaaactgtttatttttataa

SEQ ID NO: 97545 - DNA, 2310 bp, Homo sapiens
ggagcttggttaggaccttacatattagggtaaaacgaggtttttcttttcactcttaggtatccataagactgacaagtaatttatcccaagtcattgacctaagaagtgttctccataaaggcatttatggttgatttctaataggtttaataaagactctaatagctttataactctgatgcccactatatgatattaggcaaataatttaacctatctaagccttattttatctgtgaaatgggagtaattgtagttatttcataaagctatactgaaaataagatactgcaggcaaattacttggaacttttctggtacacttataggaagcagtcagtaaattttagtcactttgttggtataatgagagatgttcgttactaagtagaacctgactctacatttacaactttgcagttattaatattattaacaatttagtgtgctgaatggtcattttgtcttttttccctagaatctcaaagtgatctttagacattgtgactattcactagaaaaaaacttatgaagctaggctacttatttaattgctttttaaacacatttgaccaaaagagaggaaagttaggcttctagtttattatttaacccaggaaacatgtgccttctttgggagttgggtctttttctttcactgcaaaatgaaatctaactagcaacaatttgttgtgttgtttccaaatacaggcagctgctagagaagaaatccttgctaatggagggagcctgtcacatcaccatggaggtattcttttttgggagtagaatttctaatattcttactttaaaaaatattcagttcagtaaaatgctagggagagacatggtatgaataatatgagagtacttgaggtttctttaaagtttctatgtctttgaaatagctgttactgaggtagatagttaggttgtggtagtagccactagaagcttactttgacacgcctgcctagaaatggagcccaggcaaccttctgaggtctcagggacctcatgttatcagagaatagcccagcttgcctgggaggtacttgaccattacagcaaacgtttttaaaggatgatggggaagaaaacctacataaatgtttttcagccactatcggaatgtagctggtcatcagttatataatatattgaagggctgtttgttctgcccacccaaagctcagcaaattaatcaagacaggatatgagaaaaatcttttttcaaggttttaatgctgttttgttattacttagtggtcattttggtaagtatcgagtgttgtcagaatttatcacatcaccaataaaaattattacaatatgtctatctttgttactagcatgcttatgaaaataatgaggcaaccctttaaaacttaaacaatggccattctgttattaaaatggcaatgtttgaggttatccacttgttctgtagaatagaaatttgttcttaatatatccctcaatataatttgatgcctaggaaaatagaaatgtgtagatttttaaatagtttttaggaagcacagtgacaataaccacctaatttaaaaattcaactgctctggactccttatatccttttttttcctgtttaattttcattcatagcacttattattatctaatatgctgtatatttgtactttttaaaattttgtcttcctactgcaaagtgagaatccatgaggacaggaattctagttttgtttgttgctatatggtagcacctagaacagtgcttagccccagtcagccctccatacattgatgcagaatgaatgaaagaattctgttggaaaaggagtggactatggaaggtgtgtgtccatatcatattcttacagcaaggtctggaaaagattgctaatgttgatgaataaagtagctcccaacgtcattgtgtcaatttaatcttttgctatacttttctcttaacccccacaaatgaattcttaacttagccaatagcattgaagataatatgctcctctctcctttttctatttattatcctttcatttgatggtggttctcatgaatgctagcataacaaaaatggaaaagggagggaaatgaatattagaaacctctcaagtggaattaaaagcttccgattactctaaaagtccaaacctaattttggaaatttgaatgaggagttacttaaagatacttagattttagcaccttcctgtaaaattttcagaaagccatatacattattttaaatattttttattctgtttcaaaatgacactgtattaatattcagggaactttaatatatat

SEQ ID NO: 97546 - DNA, 1100 bp, Homo sapiens
cagaccttcatttctctatattcactcatttatttgatgattatctcaagtttcacaatttaaaagaccatctgtatgctaactcccagatatcaaaagataacacctctataccactaccctagttgcaatcactattttctgcagtagcctcctaactggtctttcttccactctgctactgtattctcatttctcttgctgctcgattaatctgttaaaaaaatcaatggtttcttctcacattcagaacaaaatgaaaactccttatcatgaccttcaaggatacattgtatatcactctgtcctcagctttgattactttgtacctctagcagcattggccttcttgctattcctcagacatactaatcccttttcccattcaaggcctttgctgtttgttccctctttttataatgttctttcttttgtcctctccttcagatatttgcatgactcactttctaccattgtttaggtctctaataaaaatgtcaccttcttagagggatcttccctgtcctcttgtgtagtttctgtaatccccatttgaattaaatttattgaggttaatgactttatcttgtttgtcactgtatttctcactccctaaacagtgactggctgctctacatagttcaacatcataaatgctcaatgaatatgttaaatgagtggataagtgcatgcccaaataaatgctcacagaatttgagcagttttgcaaattctcaaatagctctgaatcttgcatattaatcctttttttttttttttttttttttgagatggagtttcactcttgttgcccaggctggagtgcaatggtgtgatctccactcactgcaacctctgcctcccgggttcaagctattctcctgcctcagcctcccgagtagctgggattacaggctcccgccaccacacccagctaattttttgtatttttagtagagacggggtttcaccatgttggccaggctggtcttgaactcctgacctcaggtgatccacctgtctcagcctcccaaagtgctgggattacaggcatgagccaccactcccggccgcatattattcttttatattagaacagc

SEQ ID NO: 97547 - DNA, 1036 bp, Homo sapiens
tgagctcaagttctccttccgcccaatctcctgagtagctgagactgcagatgcgtgccgccacatccagcttattttttatttttttatttttatttttttagaaatggggtctcactatgttacccaggctggtcttgaactcctgggcttaaatgatcttcccacctcagcctcccaaaatgttgggattacaagcatgagtcactgtgcctggcctagttttctgtaatattcagtatttggcccatcttttttatgtcttataaaatacatctaaatacttaagtacttaaggaatcatatatttagaataatagagaattatggaatgcaaggtacttatcttgttttcagagatggtgatcttggctttttgtagctctagtgttgactctcaggctagatttatacttctagagcatcagaagtcaaaggaatatgttgggtcagtagctatgaatatcccacatcagatgattcaggtctaaaaaagaagaataggctttatgtggtatgtgtacacatgcctttcagtagataactatcacatacaaggtaaattgaaatagttttaggccacctgttatttgctgtcttcagtaattcattttcccttcctttaatatggtgtgctacataagggacagagtataatttcttccctttctgaaaatgagctttacaggtgtttaataaggaactgctatatagttgtatacccatgtgtgttaacatgggtacagatcagtatggtcagctaatttctgaatgcccagcagtacaactaagaattgtacaaagggcattattagtggtggtgtttagctctggaataaaaatcttgtactttgaagtgtgtttcttctccaagattaaggcctgtggtgtttgttgttttattgatccatgtggggtaactacataaggttctccagaatctcaagaagactccaataattgtcttgttgttaaggcatattgaacgtttttgtttgaatgtgttttctacctgtatatgtatcctgtgaagtag

SEQ ID NO: 97548 - DNA, 1017 bp, Homo sapiens
gttggagcagttgtttgcagtcttttcaggacaattacatccataaccacaggatacattcagtgaaactgtattacagataacagtggagactggtattcactgctcgtcacccctctctctcttcagctgcctcagtgtgggcagcttatagtagtatggtaaagccccttttaccattcacagagtagttgtttaaaaaaaaaaaaatcctgtggagcaaatctggaaaaaactgatttttaacttttttaaaaagtgcttaaaatcatagaatattagagttgaagagaccttataaagtctaatccatttgcaagtgaaaaaacaggctgaatcatagtcatgggcagtcccttaggagataatagaaggtcctggtagaatatcttttaggtggtagagattgcaggaatagggatttatttactcttagcttctggttttagagctatctcaaacaaaatttttcattttgaatttaaggttttttttctgctgaacttcatttccccccgtcttaataccagcaatacctttttatttctgaaagccaagcagataatttgctttctgagattatcacagtatttattattttgatgacaatttgatggtttcttagagaactggacacaaaagatggttttagttgagctcgaaatggtatttaaggtttccaaaaggcagatgctatgatgtatcactatagcctaataaatgggaatgcattatagaatgacaggctgaatactttaatgaaagaaggtttcccatttcagttggtcaattaaatcactgttgatgactttggatcattaatgaacatttgtagaaaatgaccgtttgaattcaattagtatgataataggttttttggagaagtacaagtacaaataatcctaactgtaaattaaaagatttatccattttgccacagataagttagcatattgcttgctttttaataccagagcaaactgacatttcagaattcttttacagattaagtacata

SEQ ID NO: 97549 - DNA, 4470 bp, Homo sapiens
ctttatgttcgttaaaatattttaaggatatatatcctgtcatttttgctgaatttacccaacaaattcgtctcaatgtgatgtttttctttagttaacttcattttctctaaaacttgggtgtgttttggtagttaaggcagaggtgggttctttcgaaatgcacgtttttctcattttgttatttgtaaaatgggctataatctctgtccaagcttccttcaatctccatttcatagtttacagagaaaggagacactgtggagcacagacttcccctgggaatacattgggcttaatgagcttgatagtctggtgggctcaataaatcaaataaagcaaaacatttctcatttttgaataaaagcatttatcacacagtgtttgttcactcatggtcacaagattgattggttcccagtatcatagcatatattgaagcatttttgattttgtttttccagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaggtactaatgtctcactggaagtatatatatatatatatatatatgtatgcatgtgtgtgtgtgtatatatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggcttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatattttttttcttcaaagggagtgtgaagctgtttattct

SEQ ID NO: 97550 - DNA, 1034 bp, Homo sapiens
ttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcattgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaa

SEQ ID NO: 97551 - DNA, 1090 bp, Homo sapiens
cttttttaaatttaattttgaatgttcttgcatgtttggtacctctctcctcactgctaaagataaattgtttatctgtataacataactacaccaatgtcatttttgtatacgctagtacacaaatgtgtttttttattaagtaatgaagtatttgctgtgaaaaatgtattatttgtgccaccgtttatatctgtgttcattttctgtgtgtatatgcgtgtgtattcgaatctcaatttttcttttactctagtttagattaagacatatttagatgaaattttaaaaataacattggaaataggaggctaagttttgttgagtctcattcccttggggggaaattgcttttgccattttattttcatgtacaataacctaaaaaggatctcctactgacttccttcctaattattattgttttacacgaaagaaaggaaatacgttttcaattgagttgtttgaaatcattcactttgtgtagatttcccagactgatgtttcattgtaagaatattacattatagacaggttggccatttcacaagcaactaatccatagttttggaagcccgctttaagagacctgaatatctttgtttttaataaaatacttagagtttaactaaagctctggaataatctttatttcttttgagaagggtgatttcagggctgaaagaaggaagcaagcatccaaatacctacagtttaaatgttgactgttaatttagtccattaaccttgtgttgatctgtgatgttttcatgtgtgagagggacactaggacacgcctgtccatatagctttttaaagatgacaaaaggttcttcaaattatcgaagtttttctggaggtaggagagtctgcggacaaatgctgggttcctgtgtccgttacagattgctcaaatttgcatgggcaattacacagggggatcgcatcaatgcagggccgctagccacactgtcgccatacaattacacaacggcttcggtgcttaaactttaaaattcttacaccattgtgcctgttctattagaacaaactgcagcaaatgatccaaagccaattcaaatgactggag

SEQ ID NO: 97552 - DNA, 1049 bp, Homo sapiens
cactgggttcattatattaatggtattctattttttgtatgtttttaactctccaaaataaagaatttgaaatttatgctaataaacaggttaaaaattaagccttagaagtggttataaatgtaatagaatataataataaagttatatataaaattaatccaatttttaaatgtatgcatcaaacatctacgcaacatatgtaattgtactggactgtgttgcctttctgagacttacatacacaagcacttgcaaccgtagttgaggctaaagggtcaacatattcccaaaacatgactaaggttttatgatttgatagtaagtgccttcagaagcttctggttgggaaagaaagtcatttatatatagactgtaaggtttttccaactctgagcttggtaaggaaaggaccagttaggcctaaatcaatagttaattaatgccaaatcaatatttggttgcattcatcttgaaaagaaagataagcaaattcaatcaaaactatcccgttcccatgaataattagacaacctgcaattggcttgttacattgcatactctggtaaaggagacatgtgagtttgttggtcctagatggtgattccctatcagctggaaaggttctggtctctggacctcaaaatggggctaaggtgcccccttttctcttcagcagacccatttattggtagacaaactttactgtaaatgccgagggagtatgaccactaaatctagatgctatagtttgctcagtagggattttttcccctccattgaagtttgtggttgcatacctgttcttccccttatgctttcatcacacactgtctctgattgacaaaggtaagatccttttttaaaaagaaggtatgctgcgacatccagtagtataaatactcataagcactcctagtaagcaattgaaatctgcttccactccaaagcttgagatagtcctctgctcaatattattgccttggagcatataaaacagtttgatacccattaggctgcccctaggatctatatgttgagtggttgcc

SEQ ID NO: 97553 - DNA, 1136 bp, Homo sapiens
tttgcacccatccttctccctatctgtatatataaatcgctaacaatctacctgacccttctcaactgcccctttctccatgaagtcattcctgctgtccttcagtcaaaagtgaccttctcatttgcctttcttcctaccatattcatcactttctaccttgcaatataaatcttggtgcacctgtctactcaaatgattaaagcagttgcatttttaggagagaatccttgacttactcatttggtaacccttatatcacctaaagccatgccttgcacctgggtgctggagaaatttctaccttgtgaccaaattccttgaaatgttcgccatttttatggcaaaagaacttataatgcttgggtggaattttgaagcagggacctatgacgatggaaatttctgacaatttcaccccaatccttgctttatgctgtttgaaaccccttgtttttatgttcctggttgttgtcctgtgcaccctaaactatatgaaaataaagggattcgttttctttgtttaggataggtactcctatcctctttggagtgtgctgtaatgatagtgtctctcttccccgctggaggcaaaagccccttgccctttaactcttagttgattcagcaatctctttactactaaatacgtttcttcattcatgtatcctcctaccaccaccctgctgactaaatttttttaaacctatttttttgaccttcaaaacacctaatgctttgttatttgtatttgtatttactattttatatagttctatagtctgtctttcctgtttttgaaatcatgctctggtttggctgttcttcctatttttcctcatttggaaatggattcatccaaaatcttttaagtgtttgtgaatcataattctcttggtctcaagacaccctatgaaataggaagttaggagacaatgtctggctgaagggttttctgcagtctctgtagccagatctgcccttttaacagtctttgtaagaccatggacacagtaagacaagagcaagcaagtgtataaaaagacaaagtaaccaccagaccttttggttaatttcaatttctaggctccaggtttcctcatctgcaaaacaaagccatctctagctaaaaaatg

SEQ ID NO: 97554 - DNA, 1146 bp, Homo sapiens
gattctctaaggtttgtaggtgaagaaggagttagcatttcccagacttatttgtttgagatttgtgtagattaagaatgtaggctgggtgcgaaggctcatgcctataatcccagcactttgggaggctgaggcgggaggatcgcttgaacccaggagtttcagaccagcctggaaaacatgatgagacacctgtctctacaaaacaatacaaaaattagttgagcatagtggtgtatgcctgtggtcgcagctacttgggatgctgaggtgagagaatcgcttgagctcaggaggtcaaggcttcagtgagctatgatcacactactgcactctagcctgtgcaatagagtgagacctgtctcaaaaacaaaaccacaacaaacatgtgtctggcagcataaaacatataacatacatatgctatttatgtgtgagtgtgtatatgtctgtaaatatgccttataaaatgccaccaatgtgcatttatttgtctcacacaacaagaattctggggcaggggagcccagggtcctttctctttccctttctgttctgttcacagcaagctggcattcactgccatgcttgtcacctcatacacaccagattttgctgcacctccaggctttacagctgtattccatgaaggaagaaaaagaaagaagcagcgccgacactcccacttataattcattgaccaaggccgtgtcataaaggccaccctataggaccaccccagctgcagggagcctgcgaattggggtttttaacttttaagcctctgtgtcagtgagttatgatgtagataaattgcaaaagttgattctcactcaaatgacatgccatcagctgcaggttggctgcagttctactcaatatatcttctttatttgggggctcagactgaaggatcggcccctctcaggccatgcccttcccttggtggagggaaaaaggaggtggcagaactatgtgattgctgttgaagacacactcaaaagggcatttgttacttttcccattgaccaaaagaagtcatatgccaatgctgatgtcaatagggcagggaagcacaatcctcttacaaaaggggtcacagatatatatcaatataatctttcctaatataataaaagcaggcaa

SEQ ID NO: 97555 - DNA, 1050 bp, Homo sapiens
cccaaggcctacctctgtgtacaacaagattgtattttcagacccatccctggtggctgcctgctttcatattagattttgccaatgagttgctgcaatgtttaattagcaggtttgctctttcctaggcttttgtcatcttttgtggacttggcatcaacaacacaattatgtatgatcaagtgaagaagtcctgggccaagcagtctgtggctcttgatgtaagtacagtgtttatgtcaggtttgtatgctgtcagctctaattttatgagggaaaaaatttccctggttatggggcttaatttctcaaattttaattattcattgggccttaatcattttaggttgtgggtttaaatctcatgaagtccagagaaacacaatgttgcatatgatttcaggggttcacagatgccttgaagcccattcatataagtcctatgtttagatatagattttttaaaattacatttattaaatagtgacaatccaaagataatttggcaggatttcaaatttattttaaacttagatttgaatatgtatagataatctataaagtcacaacttttcttatcgtaggagaagaattcactacaaggatatatgacctagatggggaaagctactcctgtcattatccgattccctttcttcctccctcccccaacacatgtcccatcaagaaccttgacctgttcccatgtctgcacatatgtcctctcagacactaagttccaaaagagcagttctaatctcccctgaatctcagacgcttgttttgactcaagactcgtttttttctagcttctgctctgtagttgttttttttgttttgtttttgtttttgttttttttgcccaggctggagtacagtggtgccatctcggctcactgcaacctctacctcccgggttcaagcaattctcctgcctcagcctcccgagtagctgggattacaggcatgcaccaccatgcccaactaatttttgtatttttagcagagatgaggtttcactatgttggccaggctggtcttgaactcctg

SEQ ID NO: 97556 - DNA, 1050 bp, Homo sapiens
gttgtgactatcagatgggtgtcagatgacattgctgtaagtgattggtatctaccatctagcatcatataatgacaattgcctgcttctgtcacagctgaataaatctgggtggtttttttgttgttgttgttaatcttggtccaacatttcctgtcagtgagattacagataattttattattatctctaatttttagtttccataatggaaaacatgggaaataaaactcactttgcagggctgtttggaggataaaataatagaatgttgaaggctgcatagcgcatagaaggctctcaataaataccggctctttatatcacaaagatttttctttaattaaaaacaccaaggtgagacatgctctgtttaactgcttaacttctaggacagtagagagatgttaaatgtttttgacggtggcatcattatcagatttggagaaatactgaggagaaaatgtgccagctggcaaaactgctgatactagagcagtcaggattctatcctgctggaggtttcaagtagccccacaatatctctctgtgagggtgctgtggatacctccatacatctctagattgagggcacaccttcccaacaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtgcatatatatgtatatatatgtgtgtatatatatctatatatatgtgtatacacacacacacacacagcaagaaagggagcagattcaatttgttaaaatattaattaaagcatgttaaatgagagacctactaaagcaagacagtcaaacataaaa

SEQ ID NO: 97557 - DNA, 1046 bp, Homo sapiens
tctgccttagcctcccaagtagctgggactgcaggagcgcaccaccgtgcccagctaatttttgttgaccttgtgatctgtccacctccacctcccaaagtgctaggattacaggcatgagccaccacgctaccctccgccttttttttccttttttttttttttgagacagagtctcgctctgtcacccaggctggagtgcaatggtgcgatctcagctcactgcaacctctacttcctgtgttcaagcaattctcctgcctcagcctcctgagtagctgggattacaggcccaccctaccatacccagctaatttttgtatttttagtagagatggggtttcaccatgttgttcaggctggtcttgaattcctgaccttgtgatccccctgcctcagcctcccaaagtgctgggattacaggtgtgagccactgcctggccttaaatactttttgaaactatcccccccagatacttgtaactctgaaaaattactgctataaattttgaaaatgaaaatcgttaagctctgttattgatcaaccacattattaaaaggcaaaaataagtgagtgttaaaattgtaacattaaagcaggaaccacaaagtccgatatgcagaaaattccatatacaagtgaattttcattgactaggcagttatctgattgaaacaatttatgtttctttctgaaaagagtacatggttactaatcatgtagcttgtactaggttaatccttattccacctctatccttacctatccccgttggtgctgggatgaggcttatcaaaggaaaaagtatgttggttctgcatattattattatttaaagaagctgaaactgtagtgagtggtgtgagttttaggttggattcaaatgtcacatagtcaattctctctcattctctttcccccttctctcccttcatttccatcttgtttcttaaaggatttgaggcatctgatggaaaatattggaatatgaataaactttcatggccagataatgtgataagctgggaattctcaaggagttttt

SEQ ID NO: 97558 - DNA, 1106 bp, Homo sapiens
ttttgctattcttattcttttaacctctgaaacagggtggcagaaattattgtctctatgagactgaaaatacattttgcactagatctagagtgcccattgttttaagatttgatccggatgatgtggcttgttgccatggatgtttccattgttttacactttaaagagccatccagttgggtgtaatagtgcaggtagtgggcttggagaagtgctgaggtggcagtggtgccggcaaggatgaagatagtgggagcaggccctgggcttgtcgctcaccatgccgatggtagaggagctttacggcaactatggcatcatggccgataccacggagcgagtgggccagcataaagatgcctatcaagtgatactggatggtgtgaaaggtggtactaaggaaaaacgattagcagctcaatttattctgaaattctttaagcattttacagaattggctgattctgctatcaatgcacagttagacctctgtgaagatgaagatgtatctatttgacgtcaagcaattaaagaactgcctcaatttaccactggagaaaatcttcctcgagtggcagatatactaatgcaacttttggagtcagatggctctgcagaatttaacctagtgaacaatgccctgttgagtatatttaacatggatggaaaagggactttaggttcattgttcagccaaatacttcaaggagaggacattgttagagaatgagcaattaaattcctttctacaaaacttaagactttaccagatgaagtattaacaaaggaagtggaagagcttatactaactgaatccaaacacgtcctagaagatgtgactcatgaagaatttgttctattcatgaattactgtctgggttaaaaagcttacagacagtaagtggaagacagcaacttgtaaagttggtggctgaacaggccgacctagaacagaccttcaatccctcagatcctgagtgtgtgggcaggctcttacagtgcactcagcaggcagtacccttcttctctaaaactgtccattccacaaggtctgtgacatatttctgtgagcaggttctccctaaccttggtatcttgactac

SEQ ID NO: 97559 - DNA, 1029 bp, Homo sapiens
gtagacatataaatactcatagtaatatcatagttaaacacctttcctatttgttctattcttatttttaaataaggggttgcaaaattagacctatatgttttacatcatcttttgcacatgcactttttagaaatgaaaaggaatataattgacctggataaattaatataattctttgaaggctgaagtaaaacccgtttgataccaatagcagtttctgaagtagctatggctagaaacttaaaataagcctaattaatgagatgattgtctttatgaaattggatgttataatatatctgtgtttttgagcactcatacattaaagcttgcatgctttaaaggatatgtttttgtttaacatcatcagcattcacttcagtcaaaatgatggaattcttttttctccccggctttgaaaatctaatatatatatttttttggtttgtggttttaatgttccattgcagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggtaaaaactagcagttgtgggagagaaccagatacactgtaggaaagaataaagcatatgatttggcattataataatttcctaatttgcagcgttaaaaatggaccactctttacatattactgaaatatggatttatatcataagacctgcatttggataactgatcatccttttaatcagaagaattaagaatcttgtatggcataggtttttgcctatacagggtatttgattttaggtaatacatttttcttgaaaaagtataagctagatttttaaaaaatcatattttagtggtataatggcagtagtgattctatttgtagtattgattttagcagagtgggagaaatactatatagtttgaagcgtatattc

SEQ ID NO: 97560 - DNA, 1033 bp, Homo sapiens
tatggttatggtgaatgtattttgtgaaaaggccaaaaatgtgcttttgtgagtgaagttttatcctctatggtctgtgctcaaaggctcactgaattctgaacctatttaggtaattaatagaactgataattgaatgcagtactctgagtgatgtttgaagttttaaagtaagcttctcttggataaagtaagttttcttacccggctttccatgaaacctgaactattggttaatagcttagttgtttttggatactgcctaaagaaaactatcttccctttacttggattgttgacactgttatgggtttccacatagatttaaagaagttagggagagctggttttgcaggttgttgtgtataaagcattggcctttcttggagcagtaactaagaatgtttgtgttattctgccaatattgaagaatacagattgtttaaccacagtatgttaaacaatttatgaattgtagttaaacaataggtttcttcaatattggcagaataacacaaacgttttctgtttctattgatagatcaatatgtgcttaggactctactctcaaagaatttggtattttcatgatgtctgtagtagtaattctttgtgttcaaatccatcccaaaccccatctcccttgcactcattcttcacagaacacaaaaacagaaaaatagaacccagacagcatattccttactatattaaagtacacttttttttttttggacagaaaccgcaagtgtttattgcagaaatctggccaaggtcccagttggctgggcaggtgagatagggaggggtggaggaagtgatctggcccaggggctcagagctgtgaggtgatattgggtgccaggctgcaggtgagacctatgccatcaggttccacattcagggccttcattatgccatcctgtaccaccatggagaacctcctgagacatcgataaagtacaattttttgatagtttgaacttattttaatttttacatcattttagatggaggaggcatttatttagtt

SEQ ID NO: 97561 - DNA, 1123 bp, Homo sapiens
ggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggtgcgggtgcccgggtcggggtgccctcgggggaaggagtgggcctcttggacctcccttcacctgctgctctgccggggtgagggaggagtggaacatccgttcccggcagctgaccagacagcacctggcttggggacaggggctgctttgaggagaggctcccctcccacgaagctgcgccgggttgcagggaaggggacgggatgcggagtgtttgccccacgagagcggacccggcagccgcggccaccgggtgacagaacagcagtggctgggcttcccctctccctcgccctcactaatccaccagctcttgagttcactgccaaactcgtcctagcctactttgagtacttttctgaccttcctctctcagatgcccagatttccatatataaaaaacggaaaaactctacttttcctcaggtacagatgaggcgttaacaacttgacagaagtactttaaactggggagggacctctggtgttggacgttttcctagtaccaggcgaaagaatacatgtacagaaagaataagtgcaggtgtttaaaacggtcactgttacatattcttcacattttgttattttggaaaattgttttgaatgagctctgtttctgaaagtgttaatagcatacatttggttcttgaccctttctgttactgcaacttttctttgaaagcagaccaaagtaaactgccttaagaagagccaaatcattgtgataatgacacatggcaggaaggatcattttgagggttatttgacataatatgtgctgtcagcacagtgcctcacacagggtaagccctcaataatgtccttgttattgatcagtagtagccaagatgtcacagcttac

SEQ ID NO: 97562 - DNA, 1033 bp, Homo sapiens
tctgaaatgttgttggaataaggtcaatagagtagtcttggggaattacataactgctttcatcaatttcaatctactctttaaatattaaacctagcataaattagtttttaaaattaaagaatatataaaagctggaaaatagtaatggtagtctctccctactttattgtgaaagtagagattcgcagaaatgaagcataaagctcagaaacttttaagtaaagtcacacaactagtaggtggtagagctatgatttaaacccaggctgtcggagtctggagcctgctcttggtctttaaaatttcaaagcacgcttttatcactcccctctattgcctggcatgtagaggcgaatcaggcagacctgagtgtgtgaactgtattatctagtattgagaacgggcctatggtgtgttgacatggtactcattcacagaaaggcttattctttgaagagtttttgtcctaaaattgggcctttgaaggaattatatttaaagaagaaaacgtaaatatagctctgacctatataagtgaaatttgaggataattttatgtctttttagccattaacttatgcagtgatgagctttcacacaaattattaaaaagcaattttttaattgttttgaattgtagttttttatcttttttctactaatcctcccatgaattgggtggcaacaagcaagaaagaaaacaagcagtaaaaagtaattttcaaactttctctcctaccccaattgagaattcaatgaaatacttcaaaaataacaaataccaaaaacgtatattttatacatcctccagtagtaaggaaaatgttttttaccttaaatatttataaatttttcttttcctgaatgaacaaatataacactttaatgtatagtaattaagttgctaattgattacataagaatttataaaataaataataaataccaattatattccatatttctttgaacattgaaagtaaacactactgcatgtttctcagaatagtaactttctgagtgaaccagc

SEQ ID NO: 97563 - DNA, 1007 bp, Homo sapiens
tttcccatttgccttacaagaatgttagtgaatttgatagacaggaagcttgttaaagagctgcacaaaatatcagggacataatgtgatagtatattgaggctcaaaaggaaaaaaatatcaggatatggttcaagtattttgacctttatttaactgatatatttagttttcttcttgaacctcctctttgttcaaggcaggaactgtgctaagtacaagagacatgtaaacaaaatattaaatggacaagacattatgattcttgtcctcttagagctgatctcatgtaggaaacagacaagtaaacagaaaattacaacccagggtgattgttgctgtgataaggaatgtgtaagatacaaaggaggagcagttaccttagaaactctgagaagccttgaaagaaggaaggtgtatgtggagacctgaagtataaaaataatttctccacaggtgaaagctgggggtatgcatggttatttctgccatagagaatgtaaaagaagggctgttaaatagggaatttgagagattgttaaggaagatgaaactaaagagtccaaggacaatgtcagaacggctctagagctatattaaggaatttgttgtcaccatggaggcaatggggagctgctgaggggacttttagggagtaaatgatcatatttatgttttagaaagatcactcagaagacagagtgaaaaatggattgaagagggacaagctcaggggtaaggaaactagtgaaaaaggagttagattaaggaaaagatgatggtctgaatgagaagagagatctgaatgagaatgaatagaattgactgagatgtttaagattgacatgagttggatgttggatctggggagaagggtgaaaatggagtcaagaatggactccaaattttagacctgagcagttgtatttatcaattttggttgattatttttttcactttgtttcagtcgttttggtaacctgatcgaagtttaccttgtgtcagga

SEQ ID NO: 97564 - DNA, 1478 bp, Homo sapiens
tttgcccttctgtaaaataaaatcacatttcaatttagaaagataaataattgttttttgtttgtgaaatcttcgattttaagaattcaactttttattatgtgcttatataaacttttaagttgtccggtgctagaataaggattgctttaaaaaaaaattgaaatacttctaaagatttttaacttgaaaaattggtgtcttgagttatgaattgaggtaatttataacagtcgtttataaagataatgttttgacttctctctaatgaaatgcctaaaaagcaatatcaaataatatatcatttttggaccttttgaacctaaatgttggtgttttctggacttgtatttgtgagtttgtgcattaaaacaatacattcagaaaatattctcgtatgcatatatgtattttttaagaaaacctgacaatttaccaaaaactctttattgtaaattttgatacatacagccatatgaattccatttcctattttatttattagttttcaaaaatcaaactacaatttatttgactgtgacagtgagtttatatctgtgtggtttggggaaacattccttaaagtttgactttttttttcccccgagacgtctcggtctgtcacccaggctggagtgcagtggcgagatctcgattcactgcaacctccacctcctggatacaagtgattcttctgcctcagcttccccagtagctgggactacaggcgcgtaccaccacgcctggctaattttttgtatttttagtagaggcggggtttcaccgtgtttcgatctcctgacctcatgatccgcccgcctcggcctcccaaagtgctgggattacaggcatgagccactgcgcctggcctaaagtttggcggtttttattctgtaaaataattctgaatttcaggggaagccgttttcctgttcccacacactaactttccaagtctactataggtcaaatgtagtagatggcaggcactttgaattcagtttgaagttactggcttgaaacctttatttttttcacttaagattttctttctgaccaattgtgtgagctagcacgtatgagaatgattcctgccaggcctcactgctgatgacccttcctctcctagaacagatcacatgattagttcctccttcatagcttcatagaaggcatttgacaagagaaagtgcccattgggcccataatcctaatttttaaatctttttaaatgttttattaaatgacaaaaccactctcattgtaccatacattgttagcaatttaaccctggatatattaaattgggagtggaaaagaattagcaagcattttttcctgtttatggataaaatgttaagaatgaattctgtttggagaagctattctctagcatgcaaaaaatgtgttttttctagtctgtgaatatttcaataataggaaataaatagttcttgcttttactcaataaatctttg

SEQ ID NO: 97565 - DNA, 1685 bp, Homo sapiens
tgaccctctttgcctttttgaggcccagttttctcatagggcttttgagagacaatgagtcaacaaaatgtaaaatgaaaaaaaggctttgcaagtctaaactaaaactcttgcatttgtagcttcagtgaaacctttgagatgtcctcttatctaaaataatgacatccaaatgatcagaaactaaaagtataatgatataaaactaccttgtggccagttggtactgtgagaactaagctttataaataccacatttttcccttaaactcatccaatttcctacatcagaggaattgcattttcagcatggctgttcataaaaattttaatctatcatttttcccttttttgaactgttacgcatattcagggcagagataaaatagggtcaggttagttgaaaatggctgtttggataggatacgattagctacacggttttgaatttcttctaattgcagcatggctttttttatttttgctgcggatctcctatttacaatggactccattatgagattcttcttctttgttggtgtattaaataaacatattaccttattttaagtttcgataaaatactgtggaagactttgccaaattttatatgattgtgacaagttttttggggtaggtgcacttttttgtttgtttctttaatttttaaaaggctgcaaacacagctcatgaaggctggtttcttttatctctgaggtatgggcctgggattaagtgagtcatgcctaggaaatagaagcaactgatccaaggatataacattgaaagtagttgaattctattttgagatgggtctgataaccacaatgtaattctctttctatttgaggaaaatataaattttagtatttcagagcatcagattttttgttaattcacaacactttccctctagaaattcagcacctgcatcgcccttcttagtaagtttggttttatttgggggcagctatgattaagcagataacattgggtatattgaaataaaggaacaattcctaacattttaggaatactacaacagctatttcctttcctttcaggtgatgattttcatacttgtgttgtgttctttctacagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaatcatgacttatttatgtgaaagacaagaacggaaaaatttaatagacagtctttagaatttgactaaatgacatatgtcattgattttgagatgcacatctttcacattttaacacccctgaaagtagaagcatctcaatatcagttgtatggcatagtgtaatcgacaaccttattttctttcttaataaaacatgaaaaggtgcttttttcaatcaattgcatcttagagtcaataaaatatggtaattgctactcaatctatatatgcagcttaactgtttacacttaatctaaggacaaaagacaaaatcattggaaat

SEQ ID NO: 97566 - DNA, 1049 bp, Homo sapiens
ccgcacctttcagggaatcggggaagccgagaggagcggctggggaagttgtgcattgggttttattgtgcgcgtgcactgcggactgccctcgcggggcacccctgcccacccgctgctggcgcccctgcagccctcccggcagcctccgtccactcccccggccagggccaagtctgccttccctggttcagaccgggacagcgtttgcattgcagtcaagacgtgcttcccctgcatcaagccgggagctgcccgcagatcgtgtcgccggggatgctgggggaggagggaatgggagacctgaggagaaagcctggagaagtaatgacacaagcggattttctccccaaagcttctgctgcgtatagacacatctgcaaggcaccttttaagctgtttttgaaagttataaccagatactgattttgtgacaattctatgatatacctgaacggttgcttaaacatagagacctaaagctaggggaagcattacataatggacatgaagcaaatgacacgaaactaagtgaacccactgggttgccagattatttctctcttctggacacaaaatcctgtaaggttttttctataggaactttcatttttaaattgctgggctaagtttagccaattgtctattatattcagttgtgattttttttttctaaataattttcttggacatcttttcttaaatttaaaaattgcatactaatggttacatatcactaagctgattaggaaatgtagtcttcacaaggtaaaaataagaaatttcccatcttaatacattaactttgttttcctcttgttttgtttttgtttcttttccttctttcatccttccccccgcccccaacccccgctttattttttggaaacatttctacagttttgggtactgcaagctcacaacgttgatatttctatcacatgctacagcattgcggagacaaagactaataataaatgaaacagaagacctcgcagtaactctgagagttagcagggttcccaaggtcgaagggaagctgcagtgta

SEQ ID NO: 97567 - DNA, 1096 bp, Homo sapiens
gtaagttttcttatccctagattgctataaccttaagttaactttatttcaaggagaaaaataaagtccttccaagatgaaatctttgtggttggaggtcttagtaccaccacagataccggattaggtaaactgcataaggagataaaaattcttatgactttactcatgaaactgttggactagagagaagataatatagttttgaaaggtaaggcatacattctcaaaagaaggattttgttgttttgctgcaaaggttaggtcataattatgatactttttaaaaagtggttttaaatcttgggggaaaaagggtctcatagtatccattgacttctggaacttttttttcctcactcaatattatatctctggattcattcatactgtatgtagttgtagttcactgactttcactgcagtaaaatattccattatgtgtcttataacgcagtatgtttctcttttctcctctctgaccattttttttttttttgagatattgcagtgttgctctgattattgttgtttcctgggcacacgtgccagtgtttctcttgggttaataccaaggaataaaattgctggtttgtaggttatgtgaatattcaacttattaagtattgccaaattatattcccaaatggttgtactaatttacataaaccagggaaacaaccaaatacaaacactaaataaaaacatgcacttctgttttgcatatatgtctgttgaaatacatatctttttagaaagcaagagaatgatgaacgtaaaacttagaatggcagttatcttttatatggactggagggtagcatgtggggaggaacacacacatggatgtttgttattgataatgacctagtccttgggtttcatggtgagtttctaggtgatcattgtacagtaattcccccgttatccaaagggagtatgttccaagttccctagtagatgcctgaaacctccgatggtgccaaaccctatgtatatgcttcttttccatgcatagatacctatgataaaatttaatttataaattaggtacagtaagagattaacaatcataataaacagaacaattattaac

SEQ ID NO: 97568 - DNA, 1072 bp, Homo sapiens
ttaaaagaaacataaacataaaactcaattttcttaaatcaaatgagagctttcatgtgtcagtatccaaaggcagcgttttaaattttgattatactgtgaaattctgctttaaacaaataaaaattcacattattttccgtcctcttctcttcccccttaaacccctaccattactctttctacacacttaatatttctgttaatttgcttctgagggaatgcttgggtatttactgctaagtgtttttctgggtctttctagaaggccgactgattttattgcttaggtttggggccaaatcctatggttgcctggctctctgagatattgagtcttcaacctttagctgcctgtgagtgactgctcaaatgtcatggggagcctctgcaagataaccattaagggttttttttttttttttcatttgttaaatccccaaaactaatgctattaaggggcttttcatagaactagaaagctctatgtattcatctttttaactcccacatcacatagccttgtacatagtggacattcagtaagtgttgataaatatacaatttttgttaattgattcgtataaaattacactgtacattgtttgccgtttgaaatgctaattatagttctgtttggtttgtgtttacattctaatctttcggaacactgggaaaaaaatactttaagctttttccctttaaactttgaaggaaaacacatatttggataaggcagtgctgtacttctagtctcaaagtgtccattattgggtagctaactgacaattatttctctgtgtaagaaatattttaaaaaagttcttcgagaataatgcctaattattctttgtgagctggccaaattttgtgaaataatgaggtttagggattacatttttcaaagccagcaataaaatatacaaagattaaagcacatttctttaagttggaggtgctggagctttttagttgcttctttttgcttttaaaatgggtcatttgacatttatatgcaaatcaataatgtatgagttaaatgcaagcaagcaaggttctgtttcttcagacc

SEQ ID NO: 97569 - DNA, 1031 bp, Homo sapiens
tacagggcagagagaaataagatagaccctctgccaagaaataaaaatctcctataaatgatcccactatccagaaatagataatatttggtgttaaatactcatattttcttctctagtatttatattcctgtaaatcatttattatatttatttttcataaaaatagtcatgcacacatgctgctttataaacctctcccttccccagtgtttccaagttggtagctctatatttattattgtttataatggctgcagagatttggtggacacatacgttgtgtcctatttttttgttgttgccataagcaacactgtgatgaacatctttgtacacaggagtatgtacttgcttgattttatgcttaaaatagcttcttaaagatgttgaagccttgtaagacttgttactagttcactctaaaagtttactctgattctctatcaacctgttatgtgaaaagtgattttacattgtcttaaatcgcatctctattattcagatagagcatttttctgtattgtgttggccatttgaattttgtggttacattccctcctttgtgtttttcccatttttctttaaagatattcctgttttggcttattgttttgtgagagcataatgtattagagacatggatttcttgtctgccttgttgtagatattttcccccactggattcaaatcttgattgagattttgtcaaatgtattgttagttaagtgggtatatgtatatctttcgatattggctcttgtttattaaatacgttttacaattaaggaaattgtaaaaagtaaaaggatatggagtgacgtttcccaggcccttcagtttattctttgccttggggtagaactgtttttaaatcctttgagaaaactgagtatttagtatttacactgactaagtgattggattccatttggttgggttttaaagtgttctttttaatgattttagcacactcacctattgttactcattctcaaatctggtatctttggctctttgaaacagctttg

SEQ ID NO: 97570 - DNA, 1052 bp, Homo sapiens
ggctgattgcacagagactttgcctttaactgtcacagggttggctagtgtgaccttcacatcaggctgcggaaaacacacttgccagtcatcttaggacaatttggattggttgcctgggcaaccttactggcttctaatcaaatgccccaaggatagcccaattcccaaggggaacgccgcatctgaagggaggaactctgtccttggagtagcagtgattttaggacacttggttaatattggggggaagtgaggggatgccatgatctcacaatgaacccgggaagggagacaataaaggaaagggggatcaagagagaagggatgtaagagaggctggaagggaagagaaggttgcattgaagcaaatggtagacactaaatagtgaataagagcaaatgatttgtgaataagaaaactgtctattgcagagtgagcagaagtacaccaagaatgcagattgaaaagttatgtttagaaaaaaaaatccatggccaataaatgactatctagagagggaaaaagaactttggagacttctgaaaatgcaatgaaaatattttttcactgaaacagccttgcatgtgaatgtctttgattgactcctttttaaggaaataacattgtcttcttcctatactctccattgcagcctgagtaaatcctgtgtccagaatcagaatgacaccattcagaattataggacgcatttttatttgtttctttcatgaatcagaactgttatagattagaaactagtgtagttaaagtcagttctggccaggtgtggtggcttaaccctgtaatcccagcactttggcaggctgaactgggaggattgcttgagtccaggagttcaagaccagcctggacaatataatgagaccccatctctacaaggaattaaaaagttagctgaatgtggtagcatgcacctgtagtcccagctactcagggggctgaggcaggaggatcgctcaagcccggatggcagagattgcagtgagctgagattgtaccactgcactccagcttgagcaacagagca

SEQ ID NO: 97571 - DNA, 1050 bp, Homo sapiens
gaaggttgggtgctggggagaggcgacagattggacaagcagttttccttttttaaaggctgttacacaacattgcccacatccttttgctcagatcccattgagtagagctaaatggccctaccctgtttctgaggctggaaattgtagattagttggctgatcatgtgccaagtgaaaacttgtggaggtgagatggtggaggaagttgttctgttcctgacaggaaaaaacagaatggatactgaaggcagtttgcagttttactgcaataggtgggcacagtttgatttattttgcaacctagaccttaaccttgattttattatttcatagtctctgatcttcactggcatactgggttcctcggaaaagtggaagacatgaagtatggatgtatataatacccgaggaagtctcaaaggtactatgaaatatgtctaaacgtgaaaggtgcccgagagaacttgagtcaccaagatcagcctctgaccaacttctttaatgcagagaaggttgtgtgtggtgcattgtgtgggaggcagaatttagccctaggtgtaactgttcaaaggacaagtatgagtatcctaaacctactctacaaaaataataaccattaacattttggtctgtctacctacctagattataaatataaaaaagaaattggattatgcttttgtgtggttttgcagtctgccttttccctataccttatagcacaaataccttccatatcaataaatacatgtctgattgttaacaaatttctgtcatgggatatttcaatagctttcactttctgatttataattagcactatagtgaacatagatatacatttctacccacaacagcatattgaagtagcattgttgtttggggtagatacctggggtttgtcatctcacactgagaagattaacgacagggacacacacacagagtgggttaaggaatggaaagtttaccaggcagaagaaaggagagaggagagcagctctctctcttgtgagagaagggtgtccaaaaatgggaaaaaggctg

SEQ ID NO: 97572 - DNA, 1013 bp, Homo sapiens
ttgatatttcgacaggaagtagcttaatagtctccctctttagggatgtgggatccagtggattaatggtggaagagagaaatctgaatgcttaagtttctaaatcactgtttaaaggtacagtgttagggcataggcaactatattcatcatcctagtgaccagtgtttaatgaaaaattaggagacattaatatatatagatctccttcactttaaactgtttctaagaattaataatttgggtaaatatgggatggagatgaggaatcaaatacagttgaaatttagagttggaaaaagtgcatccaaattccatatagtactcaacagactcttctgatacttcattaattcttgtcttgttagaaattctagactcagtctttcgatgctatagtttcaaatttatcatggaaatgggtggaaaaattagatttaaaaaaaaaacttttgctggatcttatctgttctgaaatgagaattagttccatgatagttttctccaggaacagggtgttagtatgatcttggataaaagcacatatagaatagtctgtcaaggccaggcgcagtggctcacgcctgtaataccaacactttggaaggccgagatgggcggatcagctgaggtcaggagttcaagactagcctgacggacatggtgaaaccccatctctactaaaaatacaaaattagctgggcgtggtgacacatgcctgtaatcccagctacttgggggactgagatgggagcattgcttgaacctggaaggcggaggttgcagtgagctgagattgcaccattgcacttcagcctgggcaacaaaagcgaaactcagtcccaaaaaaaggaatagactgtcagagctggaagaagatttgcaatcctctagcagcctagcatccttggtttataaagagttcaagccccagagatggtaagttacttgtacaaagtgacacacatcaaggcagcagaaccatgactagaaacccagacatctgactcttg

SEQ ID NO: 97573 - DNA, 1037 bp, Homo sapiens
caaaggcttgtgaagatggaatgcaataattcatgtaaagcatagagataggaatgtaaaaaccagtaactattaactgccattgtcatcattatcatcaacactatcctacagaagttactagtaccactgaaatagtgttgctacgttcaaagtagcagctataactagaagagatacatgcgagatagctgaaagcttgaagaacgtactttagaaattcctaaattattttggatatttttctttgaaaatattttgggtaatctgtgaatataaaaatagcttagctaagatagttaggtgaacaatttcaatggagttaacattcagagagcagtggaccaattctctttactactgtcctaaatttatagaaaaagtgagtctgtaaagaaatttgtagcctcagtctaaaacatttccagcaatgtctttatatctttgtaatgaaatttaagtaagtaaatgacaagatccctattcaacagatctcctggactctcattttgagaatcacgtttctctccgcgtgagttgcaccaaaccattcagctattattaagtgtctcattgtctgtctgtttacctatgtctttgataccaagtaaactagactacagtcatgttggcacatttccacttgctgctcaggaggtattgagatcaatgaacactaacctgaggagcatatttttaccaaattaaagagctacagtgaaatatgtgttccaggttcctggttttaagctaaatatgcatcagttatctctgatcaggggaaacagagggcgggtaagtacttccaccttctctgtgtgttctaagttccttaaaaaactgacctggaaattaacttataattttagcatttgagaggaaacttgattttagaagaataattaactggtttacataaccctttatttaacttgcttacataatgtgtgtaacaccttgaaagtagtggcatgtgtttccaattcactctgaaagaatatgaaaacagctatcttgtgaagaaaagtacaaaaatt

SEQ ID NO: 97574 - DNA, 1045 bp, Homo sapiens
cagcttcccaagtagctggaattgcaggcttccatcaccatgccgggctaatttttgtatttttaatagagacagggtttcaccaagttggccaggctggtctcaaactcctgacctcaagtgatccgtctgccccagcctcccaaagtgctgagattacaagcatgagccaccatgcctggccgccactggattttttaaggtagacctttctttttgtctgttgctattcccagttggagagatgagcaaatatttctatgtaagcctgattagtctaagtagaaggtgtgtctttgtcataaagttgtaagttttcttgtgtgtatcataaaatttttcgagagatattcctctgactctccaagactgaaaccggcactgcagcagcagttcagcagcaaatctagaagaggaggggaaaatcctgtgccgacatatttttctgtctgttgctgctatctttggtcttttcaggaacttgccatttttaacatagctcactgttttgactgtgttgtgtatgatttcatccccatgcacattcacatgaaaagtgagttgtctaaccctgggctatgttttcatttattttcagagtattcacatactggagaggactgcttcctctagcaccgagccctctgtaagtcggcaattgctagaaccggagccagtccccctctccaaggtcagtgatgaaatgcggtgctttctctgctggcatgatgcctgctctggggccaattgaactgtgaataacgtttacacctgactcccctaaaatacttgtgatgccacttgtaggcaactctttgcactttttctgcttccaaggagtagagtttctctgccctttataagagagaacagagaatgtatactttgctgggatttgtagggttacattcaaaggtccaaaattctgtttaagggaagaaggaaaaagaagctattgccttccctgttggagataaacaaatatttctatgcccagctaatggaaaagaaaaaaaactgcatccagcaataaaaataataacag

SEQ ID NO: 97575 - DNA, 1064 bp, Homo sapiens
gtttcacctgccagtatcttcatcatataaacatggatctgcctacttatatttgccataatttgcattgacccttttattaccatccccaccgctccctacccaattttaacgtatttttatttctgatttcttattagatcttgcacattgccagtcaaaccttgtggaacttagcaaactcctgcaaaatttggaaatacttcagagaactcagtcggcacctaactttactgacatgcaggtaaacatattcctgctgctggtaaaaggacttagggtattaattaatactctttattgggttgttctatgaatatataaggtaacatttaaagataaataactgcaatacagacattcatttatattctggagttatttttaatatttttgaatctcagtgtcagtgtgttaagatgattattttaaaacattttacatttaaatacacactaaccaaaagaaatacattcagtatctgaattattcttccatgtttgtgtcctattagaaatggtagctttgaagatatgctttagatactctcagaattattattgtcttttcatatagaaatcaaagctagagatttctaatcctgtattcattttgtttatcagtaaaatatattttataattaagttcttatctctgctttttaatgcccactattcgtctaatatgcctttctgtcctggctggtttgcttataggctctaacaatgacctttagtaacttgctgtgctcttgtctatatctgtatcatctgtgtgaacttaataatactttgttgcttttaactatttgtgtaatgtaggctaactgtgtagatatttcaaagaaagacaagcgggtcacaagacgatggagaacaaaaagtgtcagcaaagatacaaaaatacaactgcaggtacagattttacttttccttcattcacgtttctacatatttttaaagtactagtctttatacatcagtttatgggcgttagattgaaagggcaacttaactgctttaaagccagcacttttcaaactgttacattatctaaaatagtgg

SEQ ID NO: 97576 - DNA, 1029 bp, Homo sapiens
aaaaaagaattatgcatttatttgacctatacatctgaaatgtgttccaggatatattcagtccaatagtgaatattttttaaaaatgtactagatcttccacacttaatatttttcccacttacatcttaatctgtttaaaattactgattactatcactcatttttttcttttctgatttgcactcttgaggttttcttcctaagttatgctccctgaactagacttttatatttcaatatatattatagagttgatcttattaatactaatcaaatccctatgtatctatatcaaagttgaaatttctgataaaaatcctttagagctgtgcttatgcttttttcaactgagtagttccttagaagtaagtattttctttagtctataaatgcactgacttaactcctttaagaattcaatgtcgttatgtgattttgtgagaactcggtgtctatataaaatattattcacttcctggtgccttggatcagagtgaaggagcaagcaaatcctgggtaagtggttctccgcgtggagcagatcctgcttgaacagtttccctcggtccctaaaaagtagacttacaccgtgtcaccgtgttttacgtccctgaactgtcggcgtattttcagtgttaagtttcatgtcatggatgttgttatatgggccacactttctgcattatccataaaacactgtcagctgaggggcatatgctgcttccagtataaagccaggggtctcaggagcatgagcgtgaaaatccgctacgattctgccagtcttcagagggctttatttagaagaacattttaatggctttccctggacccttctcatgtcatggatcggtcgaacactcagttgacgttaattggtcttccaaatcattattctgaaagtatcgtgaatcagaaagatcaaaatattggtcaagtaaacattcaaatgtcatcttgtaaacatataaaatacattcttgtccccctaagtgttgcaatgattccttcagatgtatttaatga

SEQ ID NO: 97577 - DNA, 1115 bp, Homo sapiens
ttcagctccttcactctcttcagacccttactcaaaggtcacctccagggaagcctatgctggctgtcctatctacaatttagagttgccatttcttcctttcctctgaccttttggggtttttctatttatttttgagacagagtctcattctgtcacccaggctggagtgcagtggtgcaatcttgcctcactgtaatctccacctcctgggttcaagcaagtctcctgcctcagcctcccgagtagctgggattacaggcatgcaccaccacgcctggctaatttttatatttttagtagaaatgaggtttcaccatgttggccaggttggtcttgaacacctgacctcaagtgattcgcctgcctcagcctcccaaagtgctgggactacaggcatgagccactgcgcctggcctcctctgaccttttgtatccctctttcctcattttttttccttcatgcttatcactgtcttaaatatatatatatttcctatatttcatttgttgtgtgtctgccccactagaacataaatttcatgaaggcagagatttaaccactgtgtctcctgcactaaaacagttctggtgagcccagagcaggtactcaataaatatctgctaactgagcaaaggaagaaatgcttataatgattattctgagaaacatctgggcattagctgtcttacattaacattttccatggcagagggaaaaatcctctttatatgttatttaccaatgcactttactgaatgaatcctctgctcttttaaaaaatgttcttcttgcttccacaataatctatttgcctttacttttaaacttgtttctgcaatgctgcatgcctggtcacatttaggaaaaatatatattttctgaactcttttgaatccctaagtttgtaaagagaaatacttggttccaggacttcttaaccacggggcagaggacaaactgtttgattacaatagtgcagagccttggctctttgtgcagggtagcgtgaattgaccacagcaagatagcccagccttagttactgcacacatgtgacatgtatacatcttactcaaggcccactattattgtagaattcttttacaccagt

SEQ ID NO: 97578 - DNA, 1024 bp, Homo sapiens
aagaaagagagagagagagaaagaaaaacaaagaaagagaaagaaagaaagaaaagaaagaaagaagaaagaaagaaacaggaaggaaggaaggaaaggaagggagggagggagggagggaggggaaggaaggaaagggagggaggaaaaggagaaaggaggcagggagggagggaaagaaagagaaagaaaagaaagagaaagaagagagaaaaggaaggaaggagggaaggagaaaaaaagaaacagaaaaggaaagaagagagaagaaaagaaatcgaggaagaatagactttatagctgtttgtaggataaacatgagtgttttcttaacaaatgttcaaacaataaacatgcatgcaatgtgaatttggtttaggtagacatttgtctcctcaaacataattgtgtatgattagatttttttcagagaaatcaccagaggagtttgatttactttttttcactttcaagcataagaagttggcttttcatgagcctgatggtttaaccttcagctctgctgcagtcagtaggaactgtgggaaccagttgcagcgggaaaatatgaatcagaaaaagattttgttctcaatttgtcatctttatgggcttactctgtatgcaaaaacaaaattaccattattcatccatgtgtgcaatcattctgtccatcactgttctccctaaatatatgaactcttctcaaccctaatttttaaaacattagcaataaatccagaaaccttaaagacaaagaccagttgtttttatgtacaaattcaaaatgtttacatgacaaaagaattggcataaacaaagtttaaaaatgcaagttaagaaaaatgtaatctatatgtcaaactgaaaaatgtgtgaaagataagacaaggagttcataaagggtgaaatttaaactttaaagcaatcttttggccaggtgcaatggctcatacctgtaataccagcactttgagaggctgcagtggaaggattgcttgaagctaggagttcaagcctgggt

SEQ ID NO: 97579 - DNA, 1228 bp, Homo sapiens
cttaatgaacaggcattccccctcccacgccacccccacccctgctaattgttcttttggcagctgattgttcaatacattctattttgtatgatctcttgaggtaaatggttgaaaaaatctgttaggtaaatagttaagagaaaacgtttttcctctttctcaaaccaacagcttgagtccttcttattaaatgtatttaattttttaaaacttagcctgtcttgtcttgaatgatatttgagtgtatctaatgccttatttataaaactatacactgttgttttctgcatttattagcaaccttgcattgaaagaattccatttacttttgaaaagatataatgaagactcatgaaaggtctcaaaatcagatttatttgaaagttatttcccttcttgattttgtgaaatcagaacagcaaagtgtccttcactgtgactctccttcttccagtcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggtaataaataactaacagagcagcgcccctcagggatttgccaaccctagacctgggctaagccagaattcattatgatatatttggcatttgcataatattcttactgcatagtaaaagaggaattgatctgtttgcataaatccggcaaggccaaaacctcccagataccaacacaggaagacacactttttgtgccttatccttggtctagagtgtttctaaagttaaggtgtaaaggtctcatactccttagaggttgaaggcacaccttgcctcactttatcagtttttcctgaatgtcaggatagcccatctgttcaggaacttaggtctgagaaaataacttctgtttatacttcaccctttatcccatatggctgtgggaaacatgccatgccctctgaaaagcacccgcaaccacaatcctcatgcacatgaggctaagatcatgcctgtggcagaaccaataagctgggtttcagaacctttgaactctgtgatactcatgacgttg

SEQ ID NO: 97580 - DNA, 1019 bp, Homo sapiens
attattcacattgccaggctaaattttctggatcattgttactcttctgttttttgtatagttgtaacagagtattctttaaatacatttttatggcatgcctattatgtacaaaacaccacaaagcttatgtaggtaagtgatacataggccctacctcaaggagcttactgtctgaacaggggagaggtgtggtgaaggatggacaaattatatgtatttgtaagagtatataatttatggtaaaacaatttcaagaaaggattaaaccatgtgttataatgtttcaaagaagggagagattataaaccactggggtaaaaggataggcttcttggaggaagtgacatttgagatatatcttggatgaccgatcagattcccatagaagaggtctgagaaaagggcattccatgtagaaggaatgacaagagcaaagacatagagagttaattagaaaatgcttgtcatttatttcataattcgggggaaattattttgttttataacacttttaaaaaatatttagctttgcagttcctgaccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctaccaaaaaaaaaaa

SEQ ID NO: 97581 - DNA, 1060 bp, Homo sapiens
gatccactaaaagtactcttttgggaattctaattttgaagaagcaggcagaggttttcttttattatataatgtataccaaaagaagagaatgttaagtgggatattaattcttgacatatctttctaaagtaagatttttttttttttttttttttttttgagacggagtctcgctctgtcgcccagtctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgccagcctcggcctcccaaagtgctgggatagattttttactactttaggtgtttctagatagaatattggtcctggagcatctcacatattaaagtagtgtccactgggtgcactctggagcttggcatgctttcaagttcttcttgtgcatacacttacatatgcctgaagtacgatctgtgtaatcagcttatagttgacagtagagacccagggaatttgggatgggttttttgttccctagtcatagaaaggcttttggattaggggtgtagttaggttctcatgtagtattcctctctttttgtaaatcattctaaaccgtttgggtagtttagaactaaccagtgacatggcaaccctctagataagcagctgcccaagacaagccttgcatttcacaagatgatgcttgattctctagggtcatgcattataattgatctatgccaggctgggcggggtggctcacgcctgtaatcccagcactttgggaggctgaggtgggtggatcacttgaggccaggagttcaagaccagcctggccaacatggcaaaaccctgtctctactaaaaatacaaaaattagccaggcatggtggcaggcgcctgtaatcccagctacttgggtggctgaggcacaaaaatcgcttgaacccgggaggcggagat

SEQ ID NO: 97582 - DNA, 1033 bp, Homo sapiens
ggccccagatcaaggagctaactgatgaagaggcagagaggctgcagctagagattgaccagaaataggatgcagagaatcatgaggcccagatcaagaatggcagccttgactccccagggaagcagaagactgaggaagatgaggaggaggaagatgagaaggacaaaggaaaactgaagcccaacctaggcaacagggcagacctgcctgattaccgctggaccaagaccctgtcggagctggacctggcggtccctttctgtgtggacttccagctgaaagggaaggacgtggtggtggcatccaacggcggcacctccaggtggggctcaaggggcagccagcgatcatcgatggggagctctacaacgaagtgaaggcggaggagagctcgtggctcattgaggacggcaaggtggtgactgtgcatctggagaagatcaagaagatggagtggtggagccgcttggtgtccagtgaccctgagatcaataccaagaagattaaccctgagaattccaagctgtcagacctggacagtgagactcacatcatggtggaaaagacaatctatgaccagtaacagaagtccatggggctgccaacctcagacgaacagaagaaacaggagattctgaagaagttcatggatcagcatccggagatggatttttccaaggctaaattcaactagcccctgtttttccctccctgaactcttggggctgagctgcaaccacccaactttctttcccactcttctctgggacttgtgggcctcagggcttggggcaggcatgggactggcccaggcacacaggtcccagggcatcaggagaaaggctggggcttggggtcttgtcctccccagttggcctactgttacacattaaaatgatttgcccagctaaaaaaaaaaaaaaaccacttggcttaaacaaaacttttaattgttccacaaaattactttggctctacacacatttgcttaattattagatttaaataatacagcaatctgtctgcaaca

SEQ ID NO: 97583 - DNA, 2947 bp, Homo sapiens
aaagatatattgtatgtctatactctcatggttaataggaaatatctgcagggtgtgatggcccacatctgtaatcctagcactttgggaggccaagatggcaggattacttgagtccaggaatttgagaccagcctgggcaacatgatgagacttcgtctctataaaaaattaaaaaattagccaggcatggtggcacttctgtagtcctaactacttgggaggctgaggtgggagcaccttttgagcctaggaggttgaggctgtggtgagccatgttcatgccactgcacttcagcctgggcagcagagtgagatcctgtctcaaaaaaccaaacaaaacaacagcaacaatccctgaaatatctcacttttggggtattcattcattcatttatttattcagtcacttgagaaatagatttttttggtacctcttatgtgccaggcaccattctagttgctgggaatgcagtgatgaacaagataaagtccatgtaccaaaataacttaccttctaatttgtttaggtctcactagggaatactctgttgtttcataaaaaggaatcttccaggaacctgaaagttgctggtttttagttgctttagatatctctctttctgaactgtattactgcattccctgccttcctaaacagggttacaaagtaaaatttaatctttttgatgactcagtgttgtcatttcaaaagtgttacagataaatccttttggggaattaagtcctggatctgtattaaagtgtaaggatgactgacccatctcccctctcggcactatctgaccctggaaagatcaaattgatcatgtggcaggctatggcaaaagtgaccgggatacgaacatccatggtttaaaatgtacattttagccatgaatatttgtgctgaattgttatttaatagtcatggaaagaacaaggacagtcacactgctcccagcatggtcaccatgttaatagtcagtgaactgttgtaaattagtagcatgcttgataagactccggggaacaccaagtttggcttcaaagaggagtgggaattgggtgccaaggaaagtcatcatccttgtcgtcagctttggcatggagccaagtctgtgatagatgtgagctctagtcactgaataaatatcaatcgaacaattgcagtttctaggatttcaaccctagctgtgcaactgcagacaagggaagagggggtcatatggggaatctgtgttctcaccatagggtatgtagcttctatttaagagactggaattcatttagcactcattgtgtttaagggagtttgcttagaaatatgtattttataagaggcacattgcagaattagagggctaggtggcacctgagaggtcatcttgttcaacctacacattttagggactgggaattttagagatttattgaaatgaaaagatttgtccccagggtatgattatccattaaagaatgatactataggtaaggctagaacccttgtcttctgtggcttttcccataatatcgtaaccccaactctgttcctttttaggaaaagagggcagttatgctatacccggtttagggctattactgaggatgggccttatgggttgttaatgagaacactgtgagctagaattagaagtattactccccgtgtttttgctgctctggagcttgctccagaaacctctcccaataaagtggagactgatgcaaaaacatttttggtaaggcttggtgattgaaaatttcattatcggaatgttatttgagagccaagaaataatgtggatggcaggttttgaaatcacagttttctatgtggtgaaagtaatgtgtttccaattgaccttttgttatttatggtctttttaggctggcagcctcgttggtttgttttagataatggaatcttatcctactatgattcacaagatgatgtttgcaaagggagcaaaggaagcataaagatggcagtttgtgaaattaaaggtaagtgaatatacagaattagaggaattggaggttagatagtcaagggttcttcagcatactccagacgaggaaaaaaagcatttctaaccacgtagggatcatctaataccatttatatccttagcagtcaggagtggcatttcatcacagttaacacaattaaacacagtttttgataattctccctctacaaatgtatttttgaatggaaataacttttgctagtcttccaatttggatttgacaaacaatttcttgtggatactactttagtgtccaccttcagtctataagcattctatttcattattgttgtaattaatagaaagatattgtaaaagttggaggctgaactctaaagatgatggggccagctctgtagggttttgataaggtatgaagttggagtcataaactctggttctttgctgaatttggaggtaagttcctctgggtgatagagatggtttccttttcttccaaaaggggagaaataaagcaataggtcctgctgtaattttcgtgaaggaagattttatggaccattgattcatttgtgtgtgtggttggagtgtgtggggtggaggcgaaatcagataaaatggcagtgaaaaggactgaattcttcaaagagagtgaaggaaaaactagagcaccaggggagtgactgttaaactccttcctggtcgttttcatttctccactctagcttgaatacttgtccttcatgaagtgtgtttcctttgacgtggtgagctctgggtcatagctatcaaacagtcttcctgaaaggtagcgattaatctgactttaattgccatacataagtgttgtcttttaatgttttataaatggaataattcagtattttcttttgtgtctggcttcttttactcaacatcatgtttgtaaaatttatctatattgttctgtgtaa

SEQ ID NO: 97584 - DNA, 1070 bp, Homo sapiens
gatctggataaggtatttgcagtatataagatagaggaaagattactatctttaatttgtaagaacttttacaaactatcagtttatattgttaagagaaaaaccaacatcagaactggaaaaaatgtataaaggacaaaataaaaaagcaattcacaaaagaaaaccaagcactttttaaatggaagatgagtaatggaatggaaatatcctgtataaaacatccagtggtcatcatcctatctctggaaatcacctaaacatggcaggcatataactgtcagctttttcccaattatctgaagagaagatgtttccttagggctcttgtatcctgtttccaaggtctcacatttcttgagctataggtatttatattcattgcttttttaaatgattacattttgttacattgctcaaagaatatgaaaatgatctaactgtatatttatgtatattcttttcagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagaggtagagcgaagaggatctcttcacgtgtggttatgctttggagtactctggggggatcctcagtcattccataagatgacaggcattttcacattgagttattttcagcttttctgggttctgcctactgtatactatctggaaatctgtagcatcttctcgattgtgtctgtgtggccagagaagaacatgaagtagcatatttctccaggggtcaaggcttgtctttgcagccagtctgataatttggaggttggagtggggaagaagcattccaggctttgttctccaggctagcggcataaattcactggacagctgctattctctttttttggtaataaggtccctgcttcaactatgagagttgataacttatctttatgaaataacttaaaacaaatccttctcagaacagtgacttaggaatcaaaactcagattagtaggatcgggctataataggc

SEQ ID NO: 97585 - DNA, 1114 bp, Homo sapiens
caatatgataattaaatgcaaagcttattttttcttagaatctagtttcatacattgtttaggagacaggcatttcttatacatagatgttttaatgttttcttttttctttttttgccccagcttaattttctaaggtactgtattttaaataaatttgaacataacatagtaatgtgtctgttggagatgtcttattatttaatgataaggttgtatatgattccatgtagttgtatgcaaatctgttcaagtctttgtgtaatttttcagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatggtttgaacttcttgttttggttttttccctcagtagtaatgttgcatgtggttttcgtttcattttggtatttatttttaagggtggaagcaggcagttggggggcggggaacagctaacaagttgaatttttttgtttgtactgtttcatattcgagcttcttagctgatgagctgagcacttgtgctagtgtcctcattcccttctccttggaggggctgtgcatggcctgcccacaggctgcttcatccattttccccagtgtctaggaaaatattacaaagtgctgtgacaaagaaaaagttggggagctctattctgcttggtaagaattacacaatggaatgagattttagtcacaatggggtacaattacgtatatctttaaaggagttagaaggaatttgaaacatattccggtgggaacggtattctctactaagcatttggatctgaaccctcagagtagctgatcttcagtttcttcatgtgtaaaaatacagtgtatatcagagagtcactgcaaacgatctgacctgcttactgttaggtgctcagtgttagtttcttacttccttattgctcagaacaagtcctctttttgccaggggtggcagattcgttgtcctttctgagctaataaatttgctctagcatgctgttagaaatttgtag

SEQ ID NO: 97586 - DNA, 1042 bp, Homo sapiens
ctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaatatgtgtttgggtaaactgtatgctacttgaagtgtttgtaattttaaataacacacaggtcatca

SEQ ID NO: 97587 - DNA, 1045 bp, Homo sapiens
aatcccaacactttgggaggccgaggtgggcagatcacgaggtcaggagatccagaccatcctggctaacaaggtgaaactctgtctctactaaaaacaaaaaattagcctggcgtggtggcaggcgcctgtagtcccagctacttgggaggctgaggccagagaatggcgtgaacccgggaggcggagcttgcagtgagccgagattgcgccactgcactccagcctgggtgacgagtgagactccgtctcaaaaaaaaaaaaaaaaaaaaaaaaggaaaaatcatagtatttgtaggattcagtactatccacagtttcaggattccactgggggatcttgggacaggttgcccaagaataaaggtggcctgccgtacatctaatgagtaccagtgagacctaggctaggtcccctctaaagtgctgcttctctagtccctagcttcaatattctgtactgtggtccctaacagaataatgattgctggtatttattgggtgctctgctaagcgctgttctgagttttacaagtagtaacttgtctaatcgtcacaataatactgtgaggttgctgctgttattctcattttatggacgagaatgtcaaagaatggagaagttgggtaacctgccccaggtgaagtaagttagtaaacagcagttcctagatttgagcggggccctcagggttttgaatgcagacatgtaattgcaacatgattcggctgatcatgtagccagggtgtggggtttataaaatagacgtgaataaaaaaaaggggcaggatgacagtgaagcttgctcatgggttttgtggagggcgtagattggaaccaaaaagcacgcctcggcttggtgctccctgtcgccctctgttgacatggggagagaagagcgggtctgactcggaaatgacgccataatgctgaggaaccactcctggcgttgcggaaggtggggtgtggggccggaagaccctccccccgcgtcttcagaggagcgctgtttctggaggagttaggggaaggaggctgcctggt

SEQ ID NO: 97588 - DNA, 1927 bp, Homo sapiens
ggctactgttagaactttgccttcatcaatgctgatatcagatggaagagcttcaattttaggcggaattcctttatggaacaatgacaaaaaaaaggtcttagaatcactgaaaaaaataaagatttgctttctactgaattgtgtgtactaaagactacaccatgttacttggcttgtctacctctaccagtaattttattgctcacctcttatgcctgctttaagcattttactagttgagctttccagttgtgtcatattagatattcccataaagctgctggaactcatttctacaaaggactcttgcatggaggacatgctttgggcagacatgcttgcaaatttcatctcagtcatgctgctagcactgctgctgctgaaactgctgaaggaggcctcctgcttggaggcagacatttggactgactgagacgagaagcttccttgcaagcttgtgtcaccacttgttctcaatactacctctctggaaggttcttcaactagagctgtggagcatagcagatacacagtgaacatcaatgacatctggttaattgatgacatatgacgctgacttacagaaatggaaacttcaacacacacacagcagcataacccaaacaatttgctgttgaagcataagcaaatacatatatacatacatttgtcaagagctagctcaatgtctccaaaacatgaatccttatatttctatcattacattacatgcaggtgctaggaatcactaggagaaaaatgattagtcatatagaaagtaattgacatattgtgcatcctgcaaataaatgttacacggcagttggtagctttactttgaaatgtaatctatccaagtttctgtgtagctataaagaaagtttgactacaagaatgaattcacatcagttggctgtccctctttcacatggaatttaataaggcttcttagagttttctgtgcttgaaagagaggcaaaaaaacgatctaaaggccttaaacatgtaaggaagaagggtgaggagatacttacgaaggaccattaaggaagctgtagctgaacactggccacggaaatttttggccttaattgtgtactttccactgtcgctgactgatgcatttcggatttcaagggagtatacatttctggagcggcttatgctgacatttgaagaaatagaaatctaagacaaaggaaaaagaaaagaaatgttgaagttcttcagatgtggaagacatggtattttagtttttcttcaataatatattcataattaaacttactggcaggttgtttttaaaccattcgatttcaggggatggctcgccactgatttcacaagtaaagagaacattttgtccttcattaatattttgagatctaggctgtgagatgaaggctggagcatctgagagttctttgctcagtgtcaaatcatactgacacttgacgattccttccttggttttgcttatgcaggtgaggattccttcatctctgtgactggcttgcttgatggttagggtctgatcgctgcctgagacaccatatcggtactcctcagagttggtaagctctacgccattcagtacccatttcacatcagtggcaccagcaatgttggcttttaaaaccagtctttgaccttcgtttatgctcatctgagtagaaaatgctttaatctcagcatgagttctgacttcttctgatgcctgtgatgttttagtgatttcctcatggacaatggatttttccagggaggttgctgctgatttcttgacttcttcagaaatcagaacctttgaagcttcctctttgagggctaacttttcttgagattttgcctctgacatcttaatttcttcagaccttagggctttttgggaaatttcctcttggacaacagctttcttctgagg

SEQ ID NO: 97589 - DNA, 1068 bp, Homo sapiens
aatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggtaaccagttcttaaatgtctctttcttttatcttctaaaatattttatcttctaaattcagcttcccaaaaaaagcttaaaatgaaatcactttttaaaacacaaatcatttgcattctacaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaaggtaggttggcttttgtttttacccacatttcttcagaagataatattagggaaatattttcaaacatccccccttatatacacatacaagaaagtattaaaataaaattattttcctaattccagaatacaatttgtacaccaaagcagaaacacacatttgaagttagcatatgcttttctatgagcataaaaagcagttattaagtacctagttatatgtggtattatataagattccatagtgtcagcccctgctcccaggaatatttaagaataaagtcagtgaatatacaaaatggcactacttgcctaaaccttcacagttgctaattttccaaagcagtgcaaagttaattaaagaactatttctattttaccaattaaaattagtttgctttcatttcaatcttctgaaagataatttaatgttttggttactcaaaat

SEQ ID NO: 97590 - DNA, 1010 bp, Homo sapiens
ttttctggttactgttgactcagtggttttctgatctgatttcttagtttctgatatttttgataccttctcatggatactcttaaaggcttgccccataaattgtaagttggttttagacgttccaccttcaccagaaatctcacaaacatattctccttgatcagattcagtgaggttattgattttgagctcataggtaccatctgctgaataatgaaactggaaatgcccattttccttcagtttcttgccatctttataccaggtgacctcttttgcccttaatacactgctttcaaccacacaggtcagttttgcaatctctttagaagcttctgctttcaggaactgagtaatctttggtggggcagagactgggaggtgctgaactttctctgttggtgttggttttgtctctgtgggtgatacggctttcgggtgagaaggttctggagatttcactcgttttggagacttaactgcttctggggatttcacccgaggctctggggatttgactcttggtggtgatgtcacagccttttcagttaccctggccttttgaatagtcagagtgaactctgcttcttgtttcccttcactgttttctaccaccacgctgtaattgccctcatcggaagcctggactgaagagatctcaaaggttgatttgtactttgtggtggtcacttggtggcgggcagaagtacttagcacttgtcctttacgcagccaggtcacagttggtaccggctcaccatcggtgtcacaagaaaaccttgcagactcgccctcgtagacggtcatggaccgtggctttgttagaattcttgctgccaaagtcgtcttgatctttctggttgtggatttttcttccagtgacttttcttctaatgcagcacttttcatttctgcagatgcagagtgttcatatgaggagagactttcccttgtctccgtcatctgtgatttcacttccctgacagaagacgaagcttccatctcag

SEQ ID NO: 97591 - DNA, 1041 bp, Homo sapiens
agtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaggttaaatggtaccacaatggtgtggaactccaagaaagcagtaagattcattacaccaacacgagtggagtcctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgtttcatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcagcaagaattctaacaaagccacggtccatgaccgtctacgagggcgagtctgcaaggttttcttgtgacaccgatggtga

SEQ ID NO: 97592 - DNA, 1045 bp, Homo sapiens
agctcatcattgcaagtgtcacagatgatgatgccacagtttaccaagtcagagctaccaaccaagggggatctgtgtctggcactgcctccttggaagtggaaggtaaaaataaataaattatcatcaagttgaggctaaatgagttattaacttgggggtggaggctattgcacttaaacacatactgttagatgttgctaaattatattctttttttttttttttctgatacagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgtctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggt

SEQ ID NO: 97593 - DNA, 1045 bp, Homo sapiens
acaagttctacaggaaaccattccaagcacacaacctcagcagatgttagatggagtgaactgagcactttccttgagtaattccctctaatgcaatggtttctttttaaaaatatttcccaacaagatttgaaaggtcaacaattgtatgccacttcaatgaacctaagtaagggcaagaatactacagaattatagagagaatttacagtcccttaaaagcctatacattattaatccccttccaatcataaagagaaaaaaacactctacataaaatgtgacgatgtgctcattgaatccctatttaccatatgatcctaggaaaatcacttcaaagagtttttaagaattaggctaatatgtaaatcatggtatgtgtcagtaaataaggtaaattcattcctgatatacaaggacaaaggattacagattgagtattaacagtcacttaatattatctttcatattgttcagctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtgga

SEQ ID NO: 97594 - DNA, 1050 bp, Homo sapiens
ctggccaaagaagtagggaagaaatatctactttcctaaagcaatttaattcttaagataataatattaaattataatgtggcactctgtgctgtcctataatatcaggagcccagttaataaagattatcttggtgagtgtggacaagagcaataatgcctttgtgagtcttgaaaacaaaaaatacaaatctcaacatttccttatttgcctaatatctgcatctcactttttaaattccacagatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaataggtatttatcacagaagcttttaggtgaattattttcttctcacacctgtccatgaattaattaaattttgtcattaactttccagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatggtaagcattttacttaaaattggctatacaatgagtagatcctctaaaacaatatagcttgacctatgattgatcacctctctagaaaggaactatgttgattatatttccccaagaaaaaaaaagctatc

SEQ ID NO: 97595 - DNA, 1027 bp, Homo sapiens
acagatgtaatagttaaaatgttctctgacttaagctatatttatgatcatgcaaataagcatgtgcttttctagaccattcataaattctaaaaattcttagagattgtgtgttggaaaattatctgtcatatagttttgaggagcattgtatttatgtatgattcttggagctcacatgatggttctctgcatgagatgaagttggaagcttcgctgggctcactgttaccagctgcattcactgcggtcacccggaactggtaatcacaaccctccatcaggctggtcaccttcagcctggtatcatacaccacatagtctttgttgacacgtgtccagcgcaggctcttcttctcacgtttgtctactaggtagttgctgatttcattgccaccatcagattcaggttttgtccactgaatgatgatatgctctttgccagtcccaacttcttcaggtatgccgggtggtgatggaatagctgtttatgaaaataaggatgatgagaattgcacaaaattactattgataagactgcccttctcccttctccccctgattctattacatttcaactgtcaaattatttaaaagtgttaatacttactgaatgagtttctggctacaattggctctgattcaacaggcacaccagggccatatttgtttactgccctcactcggaatatgtactcattgttcttgatgagcctggtaacgacataggatagggttgggcattcgccttcaacaatcacccagttgagcctgctagtctcgcgtctttccacgatgtagtgagtgatttctgctcctccgtcttcctgcggaaggctccaggctaaagtgcacttctcctgtgttactctgctgacggtgagctttccacatgggccaggggaatctgaaacaggtgtaatgacaagccatgatgaagatcattctttctgcccacactggaaaatgctatataaatgtgagaacatttgacatgcttaccaagcactttgaccatgacagacac

SEQ ID NO: 97596 - DNA, 1115 bp, Homo sapiens
gcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaaatgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctgaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattacatcgtagaa

SEQ ID NO: 97597 - DNA, 1025 bp, Homo sapiens
tatgtttcttgtatattagtataattgcacttcagccaccggccatctggtagttctctgcgttcaacaatgtatcctgtgatcttagctccaccatcataatgtggtttagaccatttaagtgacactgattttcttgtgatatttgtgacttcaggttgtccaggagggtcacaaggatctcttgcagggactggttcacaagatttactgcatttaccaattccagcaatattttcagcatatacacgatactcatacatcagtccttcatcaaggccggagactttcatttgagtatcagcaatgaggattttatttgcttttgaccaaagaatgctgcttctttctttatactcaagatgatagccaattactcgacttcctccatcattaactggcacttgccaggttacaagcatggtagattttgtggcatgcacaactttaggagtaccaggaggacctgggggactgaatggatactctgcaacaacagctgaagattcactgtaggagctctttccatagcggttttctgcacaaacacggaactgatactcacttcctgttgtcaggcgaactattttaatggatgttcttgcaactgcttgtgaaactatgtgccatgttgtagaggtggtttctttcttttcaacaatgtaattgctaatttggcagccaccatcatattctggaggattccaagaaatggttatgctgtcacaactaacctcatcaatacgtataggacctggaggtcctggtctgtcaaggacaattatagtaataggaactgttatggatccagcactgtttgaaacacataattcataagttccaacatcttcctttgaagcttccttaatagatagtgatgttacagtctttgaagaagaaacattgactctagttgtctctttaagagtctgaccatcttttctccagttcacagtagcttgaggtcttcctttgaatggcacatcaatcttaagttgttctctagcctttacattgaaagtatg

SEQ ID NO: 97598 - DNA, 1286 bp, Homo sapiens
taacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtg

SEQ ID NO: 97599 - DNA, 1032 bp, Homo sapiens
ccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggcctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaa

SEQ ID NO: 97600 - DNA, 1047 bp, Homo sapiens
atgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaa

SEQ ID NO: 97601 - DNA, 1017 bp, Homo sapiens
agcctccttccttttctgattaaaatgtatttttttctttgcagaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtatgtagagcatgtgagggaattgacatggaaacatttatagcagagtttaggaaatcatggatttctaataaatttgcttccttttcaggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaag

SEQ ID NO: 97602 - DNA, 1040 bp, Homo sapiens
tacaaaaacgtgatgcagagaggaaatcctggtctacagtgacaactgagtgctccaaaacaagcttcagagtagctaatttggaggagggaaaatcctacttcttccgagtgtttgctgaaaatgagtatggcattggtgatcccggtgaaactcgtgatgctgtcaaagcttcccgtaagcaaatgaaccatcatcccatcattttgagttatatccttcctttgttatatggggcttacacttatcatttctcctttgctttagaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttggtaaggctctatgcacacatcttcatttttcctttattgtcatcgaaagtgcactcttgtgtcccactcactagcttatctaaaaatccgttaaaagctagaactatttgaaaaagttaatcgcctggccttaaaaataacagtaatttatctctgctattttacagtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatca

SEQ ID NO: 97603 - DNA, 1045 bp, Homo sapiens
aaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacagcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttacca

SEQ ID NO: 97604 - DNA, 1002 bp, Homo sapiens
gattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccgtaagttgctttctctgaatacaaaactattgtttgactgtctttaagaatattactttttcatcataacttcttctttgaaaagatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactaggtaatttttggactagcagtattaccttatttctttttaaaattattcatataggtgaaaatcaaaatctaattttttcatgtttacttttcagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatc

SEQ ID NO: 97605 - DNA, 1050 bp, Homo sapiens
aacttgcacatttgtagatttgtaataagacatcaataaaaatgacttgcctttataattacaaattttagcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttggtaagtcttatttagtggaaagaatagatcttctgttctttcaaaagcagaaatggcaataacattttgtgccatgattttttttttctgcagaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagtatgcattatgtttctttttagtgattcaatgcttgataaaactaatataaagaaataaatttctaacgcattttccaacatttgttacaggggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgt

SEQ ID NO: 97606 - DNA, 1028 bp, Homo sapiens
atttcttataatcaatatgatctttttcacagctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattggtaagcctggaaaccattccttttttttaaatcttattttccaaaagtgccttggaaaagtcaagaatactaacgtatactggctctttgcagcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaaggtaggaaaacttggcactaaggaaatgcactatgaataaactaaaaaatgtcatagttattctcaatcccattaacttctgtctatactttttggattaagaaatcaggaaaatagcataattttaactcacattccaaacatctgttaatgtcagaaatcgaatcaaaagttaagtcatgttattactaatcttttggttataaaccctggaatgtggaataaataaatcaaggtttaatcatttgacaataattttaaagcataactcctgccaagttattccattcagtgttgcctgtaatatctgatccctaaaacctaaaccagcaacaattttcccagagtaaacagttaaataggctgctggtgatgctttaggaagccattaaagcaagaagctacaaagaactattctaattataaaatgtctatgattt

SEQ ID NO: 97607 - DNA, 1025 bp, Homo sapiens
aggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatgtaagctttaaaatctaaatttaaaatatcttctcaaaattgaagtatattattataaacaacgcttaatacttcctttaattatttttacagatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgtaagtaccaatgtactgacaaagaatgtcctccttacagctgccttcctaggtgttcaataatagttcacaattaaaagagctatatctgtaccttaggaagctactatggcttgaatgtagacatgggcacattacttaattactcattccttcaatttccacagaattttcacattcccttacctgttaccttttccctgttcaaaggagatgatgtctgtaatttcctcgctgtaattttcctcgcagtctgttttatttatcagaggctaaagcaatttctctgcatgctcctcaaaagggacagaaagtaaccagtcattttcttagcaactgctgagacccatttatcttcacaatcaagtttttatttctctatatgagaaaagatatatccat

SEQ ID NO: 97608 - DNA, 1044 bp, Homo sapiens
tgagcgatgcgaagaaggaaaagataattggattcgttgcaatatgaaacttgtccctgaactgacttacaaggtaggtcatttgcatataaaaaagaatattcaatgtggatcatggacataactgtatgtgttttttacaaatattaattcataatcgtaggttaccggattggaaaaaggaaataaatatttatatagagtatctgcagaaaataaagctggtgtttcagatccatctgaaattcttggtcctctcaccgctgacgatgcatttggtaaatagatattttatttttagatcggggaatagcacatagctactttggggcaacagggacttaaatatggcactgcaaactcattaacttttcttctttgtagttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattggtaaggaacaaaacatttatcatctaaggtgatttggcagtattaacaaatattagttcagactattaacagtgactcgtgagtgcattttttttcagctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagtgagttttgagcagcactgcatcaatgccaaaaatgagagtaggggaaatcccagaaggttgggatgccatacaaaagtcttatgtgctacaacttcttacctttacctcactgaaaatgtaca

SEQ ID NO: 97609 - DNA, 1042 bp, Homo sapiens
tgtggtgttggcaccaatggacatcattctcatgtgcctaaagaaaagtgccgccgtttatcttcctgcacctcctgcaaagcatctcccaccaagtgtatctccagtctgatcaccatacttgtttggctaataccactgctaggtgaaataatcaaattttctggagcgtttaatatatttgagaagcttggtaaattatctgtagtggataagaacagatttttgtactctagaaacagatgttttcaacataatatgcagcaaaattattctatgcctattccctcctaatttaagggcgtgcagatgaaggctgacatcggcatagaaatgtgctaaatttcaaatatggttgttcaataatatatttttaattgtattttaaaacatccctttgtagggaatatcagtagaactattgaattgatgttgtatttttgcattagctgtcctttaattttgctttccatgtcttgatcttgttaccgaaatgcattctgtgtaatttcaacgtagactacgttcctgagtctgatgatgtcattgtaaataatcattcctcatgttgctctcacgggtttgacattggaggatagatgtgccatcaactttaaatagagtttccatcttttgtcagctctgcatgtcatacagcaagatggaacacaggttgcaagaaagaaccaacgttattcctgacattctattgatgtgttttgagcagcaatgtgtaaccaggtgtttctgcttctaatcttgattctgctgatgaccatttttatactttatggcaaagcctcattgcctcagtttcctgtctggaaaatgagttcatcatctacctcttgggcaattgagagttttcattttgtgtcttttaaacatctggaaaatggaaaacactgagggctaaggataatgatattgtttaatgtaatttgtcatcagaccggcctcctgctcactatttctttttttttagatgctgtttttttagaatattaaattaaaggagtgctgttaatatgtaatcttcaac

SEQ ID NO: 97610 - DNA, 1069 bp, Homo sapiens
ctcctgtctaatgtaactgtcatggaaggttctccagtgactttggaagttgaagtaacaggatttccagagcctacactgacatggtgggtagcctataatgacaagccataaatggaaacaaattcaatcacagagaaaaatcattctgtgagcactaactgaaaggtttagggctagctgattaatattctatgacactgcaactctgcatgattcaatctcacatcagacccctctcattttagtagcagcatagttaatacctttaagaaaaataaaaggtaaccatataaagtactaataatttaacaaatttccaaagcactgtaggttggttgtgcttgttttcttctgtgtttaacattccacatttctaaagattgtgggttgaaattattttttattgtctatttccatataagcatggcatctgcttgctttaactacctttatgcaattgaaaatataagaatttgtttttatttccctttactctcatttacctctttcatctttttcctctttccaacagagtcacacgtgtcatctttgtaacattttgttttactaggatttctttttacaaattttttcaatgtgagaggtggaatataaatatttctgtcacagttcctccaggtgacaggcaataaactcatttttgaaaggtagtataataactgagctgtaaacaatatgatttcactctggagacatcattattttttagcctctttttttcagtaaaagcaaactgtagaatactggttttggatcacctactattggtaacaaaagcagttctttctcaatatgtgggttacttttaaacatttagaaaattctcatccttaagtaaatttatttcaggacaaagttacaaatctgcaaaagccagtttatacttataaactaagattaagtaaaatagcatttattgatcacaatgtttcagtagatattaaatgatcagtttcagttattgtgtgtgcccattgatggtacttgaaatatgaaccagttatctaaggaacttatgagaaaactttggtttctcaaattattt

SEQ ID NO: 97611 - DNA, 1034 bp, Homo sapiens
tatagctatgttaactcagtctgtttattctatggtaaatatagaagagctgaacatgtgaaaagatgggaaaataaaattattcattaaaaatatattttccctaattttctgaagactttgaggaactttaatatgaattataacaccatttcaagatttctaacagggtaaactttttctcaccccaagcttggggtgtttttctccacttatgtgctcaacttgagcagttgtctcagccccatcccgccattccccattgttgacaagttgactaaagttagaaacagctgtgtgaacagtgataccacagcccagcgactatggcactcagttcctttaaaaatatgaccacaagttatgtggggattagatgggaagttaagttttcatattggaaagtgcaggtaagaaaattaagaatggcaagatttttcaatcgctgaaggtagtttcatgcatactgccttccacttgtatctgcagtagtcctgaatttgagttgaaaaaggcacagagatttagttttaaaatggatttccagtgaaaccaaaagagaaaagtgccagcaactttgtcaagggagctcatgtgtcagaaagaacttgatcccatttcacatactcatagtgtcatgaacattctttgaccttataaatcatcttcagtggaagtgcacacgttctgaagcaaacagaaatcaaatcacactcatcatttatcagtcttaaatttcttaatccaaagtagatttaaaatctcatggttgagaattaaagtattaaatctcagcctttctctatcatataggtttcaaatagacattgaactttcccatttaaagcagatgtaatccaatggttatcaggttaatgacagagcccctcttcctttctctagactaaggttttctgatatatgtcacatttcagtagagaaaaatatatgactatattttatatattcttatatataagtagaagaatatataagtttattttccaatggataagtgttagtgacagggcatt

SEQ ID NO: 97612 - DNA, 1021 bp, Homo sapiens
caatttcacatttaaatgacctctgagaactttgagtctttgtcacttctccttttttgtggacatgtagtgcgtgtgcacaccctggactttcccaccacaggcctaagggaaaataatcagaaggaatattttccgtgtcccttaggaaaataaaaatatgtgtgttccagtttatattgtgaacagcagagcccaaacagatggcagtttccacagtggtaataatatttgctatctagacattattatcgttgttatcattattagtctttgggtatagctgcttaaaacttacgtaaaattaaatatgatacgttatactgatttttttctgcataaacaattaaaattagataacatgccagaggactaaaccaagtatagcatttatgtttaaagttgatttttaaacacagtttcactttcaatgtgcttaaagtactgttagaaagttcacagactctgacttgcaatggatttttgagaatgtccagttcagtatgttcatttttcagatgggaaaactgaggagcatatgactttcatgttatgaatatgctacaggacaacagagtttcagctcagggtgttccaggggatcaacttcaggccacagactcatttgttgggcaccaacatgcttatgatttgttaaactcagaattcaccatttacataatatttcagtgccattcaaccactgcatggtctgatgttaaatatcttcttttttttatgctttcctcttctatccctattttctggtatatctaagatgtttgtatgatctgatataatagtacagttcatttggttatttcaaaaaaatttctttcttgactgtgctgtagctaacttacatggtcttaacttcactgaaagcccttagaaaagaactcaatacctcaaggcaaaataaagtgttctaaatgtaatttttaaaaatgtaatgtgatgtgccttagagacaacgaatgatagtttgtgctttatctttgagaaaaaaccatttttttcc

SEQ ID NO: 97613 - DNA, 1066 bp, Homo sapiens
tcccagcactttgacaggccaagacaggaggatctcttgagcccaggagtccgagaccaacctgggcaacatagcaagacctcgtctctaccaaaaaaaaaaaaaaaaaaaattagccaggcctggtgccgggtgcctatagtctgcagtttttagccattaatacttggaagatgaggagagaggattgcttgaccccaagagtttggggctgcagtgcgctatggtggtgccactgcactccagcctgtgtgacagagcaaaggaccttatctcttaaaataaataaaataaataaataaataaataaataaataaatatgtttacaaattaaaaattcagaaaatgtagttttaggttttatataggtttttattggaatctactgttctttttctttaaaaaaatgtgtttaagtgttcttaactctcttttttcttttttaggtagagatgcagtttcagagcttaaaagaattttatgaaaccgaaatccctcagaaggagcaggatgatgctaaagccaagcattgttctgactcggctgagaagcagtggcagctatttttaaagaagagttttataacacaagatctagggcttgagttccttaatttaataaatatggtaagaatggcattaaatggatcacaccttctgcagggatactcatcaaagtcaaaataataatttcaaaggttcagctgtctattaatcagcagttctctcctagggagttctctttagcttcattcaacctagaccagtcctgaagcccaacatttaaatgcttgcttggcctagaactttggttagtttataacaggaaggctgttttaactattaagaagaaagtgactgtaatccaaatgcaacattgttattattaaatagagtcctcagaagtccacccaaaagttctgtgttattttgaaagcatgcaacaaggtcctttcaaaatttctaggggctaaagacaacttctaagatgaatcttcttttgaagagtttcttaccatagcagatctctttgtagtgaagatccattgcatttagaaaaataccc

SEQ ID NO: 97614 - DNA, 1045 bp, Homo sapiens
ccatataactcaagaatctgatatacttcctgttctttttagagtttcctaatgtgtttggtgaatgaacctatttgtcaaatcgcttagcagaatatacaagtaagtgtcagttgtcgacattgactaatagttgattggagaaaagttcctctaattatcagatgttactaagacttatgagaacatggcatgaaatatgaatatagcacctattagaataactcatctcgatcctccaaaatattcatccttcgggattatagattatcttatttattatacttctagtgtgttcacagaaaacaagctaagctatggttgatatttattgatcaccccaaacgtatttatcattgttaagggaatgtagtttgaatcagagataaatatacaatatgtttcaaaaacagaatgaggtgagcctgtatttacaggacagctgcaattgaacccaaaactgtaaaacatgactgattggtcataatgtatcgtgtcctatgccttccatttccaggcacatgatttcattgaagaaagcaagcagaggaaactgaggccaaatccattttatgaacatggtctgatttttgggtggtcagcctgaaagcaaagatgaagcaaaagttggggtggccaaagaaacacacaaaaagtagttcgaaatgtaacaattgtcatagcttccgttgtttctgccatagctattgaaacattaatgtcctttaagaagatgatgttgctttttcaagatatttacagtgatccatagtaatgcttatagcaacatcattgtttcagatgcaaacaaaataattaagcatggaatttgtatacttttttcatttatatatacgtgatatatatgggatattaacattttcaaaataaacacattttaggcccagctgatgaaaaaaaaataattaaaatggtccagttgttgtatagattgaaattttaagaaaacctgcccaagtagagtacctaaaaaaatactatgcagaaggaatttattgaggtaatataaatgaattcaagtaat

SEQ ID NO: 97615 - DNA, 1109 bp, Homo sapiens
ctacaatatttactacaatttcatgatttgaaaatcgaatggcagatttttgatatactcagcatatctaaatattctctgaatcttatcagaaattataaaaagaggtgtctttgtcagtttgagtttctataacaaagtaacatagactgaatggcttgtatacaatagatatttatgtctcattgtcctgggtgtgagaagtttgagatcagggtgccagcacggtagagttgtggtgaaaaccctcttctgggttgcagactgccaacttactgtatcctcacatggtggaaggggcaaggcagccctctcaggcctctttcataaggtcactaatcatctcccaaagccctacttcctaatatcatcaccttgggggttagatttcagcagaggaatttcggggggacacaagcattcggtccataacagaggagatgtataaaataataagaataatctcttgcaggaatggaattctgctgttgagaagctgaagagtgaggcactgagaattctgctgtcaaaggactacgtggagaaagaacacctccagctctctcaccagaaactcagtcagcttcaagaagaatttggtcaactcatggtggaaaggaatacctggttaaagaaggcgaatgaattttttaacagtgctaacaaggtcagtgtgaggtcaagttgataattttcggtaatcaggcagaccagtaaaagacccattacttcaactgactggagcacatcacagaagtcaaaacgccatgtaaaatttcaaaactgatagcagcaaagagagcttttaacatatattcctattatggccattatttgattctcaaaactgaaagactgttttcacatgtaaaaggtgactttaaaaacaacaaacaaacctcgtgagggttttttgtctttttgttttgtttggtttggtttggttcattggatggtttttgttgttgttttgagaaagggcctggctctgtcaccctggctggagtgtagtggcgtgatcatagcttactgcagcctcgacctcctggactcaagtgattgtcccacctcagcctcccacgtagctggaatcataggcacatgccacc

SEQ ID NO: 97616 - DNA, 1747 bp, Homo sapiens
tcagatttaagagcctttttaaaaaagtctatatttgaggtttattgtggataaaacataaacagaccctcccttctattaagttagcctatttcatttagggaaatcaccacaaaaggtaaacatcacaacctaataatttcccctgtagctgagttagatgtgttgagatcctgaaatggatctcaatggattgtgtagacaatgaaaaagtaagtcctccgagaacattaagataaactaggaccacctggtcagtccatggcacaatctgattgtaggcaaattgtgttagatgcaagtattttggccagctagacttttattaaatttaatttaaaatggaaacaccaaccaggctctgttacttaactagaagaaaacgtgattaataggaacaagaaatctaagaaaaacagggacaagacactaaagaagaaaatggttcttggaatacacaaatcttgggaatattttccccagaattcctgtgtaattaaattttcatctatgttgaaccaaggaagaaagaagaaatgcatttgtgctccaatcactattttgaagatttgtttatgagcacagtgtgttgtgatttcattttcaaattgtattttgccacatagccatttgcttcagtatttattagcaacaagcaccctgtgcttcacgctgctaaagtgctgcttagtgggtccactcagtggccaaacaccgaagagaataagggaaacaagagatttccaagtcataggctattttcctgcaactttaaaaatatctgaatgaactaaaataaacgaactaaatatctaacactaaaatatctaaatgaactaagataagaaagcagcagctaatactcagaaattaatttggtgatatctgtcacttctattatagacttgcaattccaattctggtaaggttgatttctggatcaaacagccagtatcccacattttaggagggcatgaaatccaggaacttgaagcacagctaatttgtcactgaattaacagatgagtcactagagaagcagaaatgtaccaactggtggtgactgtcattgcactgaagtaaaagcaaggctcaaaaagcaaaatcttcttcctgaagctacttaacaagcttggaataaaaagtgtaccactctagctggagttctttgctcttacccacaagctctccctggttcagtcgcaatgattttctaccatatgtctgggaggtgaaacagcacacttctttcatctctaggtgaaatgctaaatcacagttcttcctgtttgcaatctgtgcctttgctggactgcatcatagtgagggtgaagtttaaatggcgtgtagacactgaactcagcaagcatgggagactgaggcaagacacttctctccagaatgaccctgacatttgtataggtcagcatagaaatgcccctgaagggagcatgagaagagactaccacccaatttataatccaacttgacataatcagagtttcaacttctaaagggctcaatgccactcttcaaaagcataaacatttctgtaaaaaaaaaaaatcttaagcagactttcaaatattctatgattaaaattgccaggtttgttttaccatctgttaatacaatcatgtaaaattctatgattttgtgtcaatgagttaattctagttgttctgaatggaactgtagacttgagggttaaacaagaaataggctatgtctaatgagatggtctagg

SEQ ID NO: 97617 - DNA, 1175 bp, Homo sapiens
atgtaaaaaaatatcccaataacattagcaaataccactgtgcattgacagggcttccagaataatgataaacaaattaacagcttctacaacaataactatatttttctgaatagttactatgtgccaggcactatagtatgtatatgagatccattatctaaattatcataaaacccctaagggggaggtattattttctccattttatgcatcaaaacaaataaaacaaaaaggcttggaaatgccaagtcacttgaccagtgtaatatatcttgtcagtggcagatttgaaattcagttctaggttttgtctaatacaaaggcccaagctcttaaacattatacattttagctttctaaaaaattttttttctacactgagatgtcactatgagtcatcacttttatgacttccagatataatttgattgctgttccaatttacatgtcttttgctctttaacttgcttcagatttctcagttttacaagaagtaatggctaccagccaggcagccacttataggtatatagaatgcattaaaatgcaagcatgaagtgctgaaagcaagatgagtaaagcaccagtgttttggttgaccttctctccattgtgtcttgttatttgaaaatcagtgcgtttatacatctgggggtctgtaaatactttccaaaattctttacagaggctccatattgatccacaagaaaacagaagtccgtcatagtagatgggatgggaacagtgaataatcactatcaagatttagggaactttgtatattaatattttagattatgatagttgtaagtagagctaagtcataaagctctagaaaacaatgggccaacactactagacagtagttgaatacaggctagacaagtcaaatattcacatgtctgggaggttaggagtaggcaggatgaggatggaggcagtagattgcatttatttagacttaaatcttttcatggggatcatgacacatttgtttcagtttcttgcttctgtttgaacactccagtgtcttgtaggcattcaaagtctttggtttgaatatttgattgataaaaggtgcacttacagaagactgttgactaataatgactgattattttttaatttcttaaaatttttcagcatttggtttatctgtttaggaggttaac

SEQ ID NO: 97618 - DNA, 1053 bp, Homo sapiens
gcatctttgctgactttcctttttctccatctcttttcactctgtgatagatgtcatcccatcactacacacacaccacacacaaagatctgcctcactcctctgctgagttctatctcctctgggcatcaagtacctagaatgccctatcaaattaatgggatgaccatgaacacattgctcagatgaaactggaagatagaaactgggaagaaaggaaaaatattctaattaacccctttaatccatcattgcccagaaccaatttccagtgcatacttcgaatactttttgttttccttcctttgtacatctcctcagcttgtggctcatgttttcatagttttgcagggaccatgttctacataaatgtcctggtgcatcatttactgtacttaccactcaggcttctggacagcagctgacataatttaaaagcttataaaaagtgcacttagaatatctatgcagctgtctgcagtagctactcgctgggcacaatgactgatttactgggtggcagaatattatgattgacatgctcctggttatttagggtgtcttattttgtcatcagaaggactctgagagcctattttgtgtgcatcccacagcatacatggtaaatctgatcgaagagtctgctcctgtgtatgaatacctcataatgagatgtaacaccctcctgatgatctacttacttctgagttttatgccaacttgtttttatgtttctttccagggtgcatctggtagtaaaaatttgtagatctagagagtcagcatgatttaacaggcaggaacgtgaacaggatacactgaacattatcgtatgtctttaactacattctcctaaagggaatagtattgttttacaggaatagtatcttttgggagttgaaatagtatatgccaaatctagaagatgaggtcagtagataccgtttaaaaatcaaaacaactcactctttcccagctttcatcactgctggcatgtgttagatgacaagtctttgactcacaaagtttaataagattatctgaggttccagg

SEQ ID NO: 97619 - DNA, 1085 bp, Homo sapiens
tagttaaatacataaaattattattctaaacaggaaaaaggattgtatgtaaagctgttcataaagtaacaagtttgccttaaaataacatattttagctttcctactgcccatcaacagagaataccgggatttgatactggaatttattgaggagatactgataccttccagttgatttcagtaattcacaaagggctccaaaattcaacagaagaaaattgtgagcattgtcctcctggaatctctaagtccaaataataacaggccaataactagatcagtcccagaatacgtctaaaaatggaaacccgatccacatttttggcagtaattgttttttcctgctctcctcccaagtctgcaggtacaaacatcagcaacacagctttagcatctcttctaatgtgcattagaatcacctaatggaccaaatggatatttcaaatctggtcatcgctagttaagtccagagctcatttgactgtattgtctaatacaaaataaaggcaactggttcccctactgtaaaaaaagaaaaaaaaacccaaagccctatggaaacatgccttcaaaatcaaagcaggcattagaactgtcacctgtgaccatcaactacaattgaaaacatttctgtatatgtgtgtgtttttggtaattgccagagagactgtcaaaaagtcttgggttaaagaagataaataactgatgcctttttcctttatcagttttttgtacttaatagaacctggttattcagcaagttctgcacatggaaaagaaaatgaaagtaatttgatgagattttcatctccccttaagcatttctgttaaggtcgtttgaattgcttattgctagctcacctcctccagcatattttaaataaagataaaagagatctgatttcatattgtagaacaaattgcagaaaaataaactgcagtggcttatggcattctgatgtgttgctttgggctgcagcagaagttcaccttcttgccgcctgagttgtttatccttggccatcagagagcattttctaccgcttgcatgacccatctttcagtcctgtctttggcacatg

SEQ ID NO: 97620 - DNA, 1098 bp, Homo sapiens
aagtacccacaggaagtatagagggagtcaccaacgaatgtgtacatgtcctgctaaactgcaggcttcctgaggaaaatggccacgtactcccctgacacatggccctggatttctcacgaggttatgggttcagaaaacagtgtttaattatgtgttttggattgagggcaaccaggccagtaagtaatccggaaaccatatttgctggaaaagactttaactaactaggtaattttaaccccaaggagagaagtcaggagaaggtatattattccctctctttcaaggattgttatgtggtggagggaaccaacttgttctgaaacattccagggggcagaaatatcaacccattaatcctggttctaacttccgtagtgttaaagaataagtttcttacatattagggagccttagcactgctgaataaggagaaagcataggtgaagctaattgaaataaagtgactattaggggtaagtttgattatagtttttccagcttttgtcatcctaacactcatgttttgtactactcaactgattaacatctcagaaacttactagaatggctagctgcacttatagacatattttatttccttaaatttaaaggtaatagatatgaagcactcaactaaaaaatcagaatttcaccctttaatatgcatttcaaatcagctaatcttaatcatatcccatggaattagttggttaataaattgcatcaacttcatttttttgttttatgaaaacaaaaacccttgaagccaccactgggcatatgaactgggaacaagtatcctgaccagagttctctgtcatctctgtgcttcaagtatcacacagaagggcacaaactctcacaataaatatgtcatcaagatggaagaatattttttcatcataaaaataaactatgtttcctgtcttccactagcatttttatccatctcttcagactaaggacacccagtggactcttgaaggctggtacccctgaaaagcaagacatcagtttcactgtcagctggatgccaaagaagtgcaaacaaagcagcatgtgccccatataaactggcccacagtgccgcag

SEQ ID NO: 97621 - DNA, 1050 bp, Homo sapiens
tgtaatcccaacactttgggaagctgggagggtggatcagttgaggtcaagagttagagaccagcctggccaacatgccgaaaccctgtctctactaaaaatacaaaaattagccaggtgtggtggtgcacacctgtaatcccagctactcaagaggctgaggcaggggaatcacttgaacctgggaggcggaggttgcagtgagccgagatcacaccactcactccagcctgggtgacagagtgagactctgtctcaaaggaaaaaaagaactttgcgttgatcagccacttcagtgaatttctggcagccagtggctgagaaggagatattcatctgcttcaagaagcagctgattgcctccgaggtgccacaaaaaagtggtctccactttcttacatcaaactccgtaatgtcttttgtcttcttggctctgttaatcctgccattcctgcctgtgccccccaaggttctctgatttccagatgctttgctatctagcacagccctccatctctttttacctcctcctctgatctttttagttcaactttatgattttttttccacctcaagctgctattctcttcttaccttccacaaatgctgcaaccataagcctggaaaggcagaagtggtttctagccagttggagtatattgactccacagttcattggcatagattatctctggtgttggttgctgacactgcagctgcacatcagcacatttaggtgatactcccaagactacactcctttcttcgtttcctctattaagctgtttctcaaattgtgcttctcatgtccctaagagttcacaaatatactgtgagagatgcgtaagtatctaaaataatctcaaattttgatttaaaaatatttaatatatgctaccaaatttcaatgcttacacttgtgcttgtattttcatttcactggtgctaaaggaatggcagtgtttgacttttttcatattttctcaaactggggatccatagcttattctctgagttcttgtgttctcaagattgagaaacactgctctg

SEQ ID NO: 97622 - DNA, 1047 bp, Homo sapiens
tacaagaactttccccatggtgaaatttgcatcctacctgcccaagtggaatttcactatttttattgagttcagttttgtgagtgagagaggatacagttgtgtaaattattctgtaactttataatattcaataatacgtaatccattgtatgttttcctcacttgggaatttttaactcaaatccaatatgccaagagagaataatttatgctaagaataaaaaataaaagacagggcatggatttatattagatctgttgtgtttcaatttaagtaaaccccatctctatggaaagaatggaaaaaaatagaaaatagaaaaaagtgtttacagtataactggaaatttaaacgatatattaaaaatgagaagggtgaagaggaaggaacaagaggaactaaaagtgcattttatttaatttttatttttagtgtggcaaatgggtacaacttcaactggctgaatcacagcccaatcttctagaaattggcagcagtcaagatgaaaccaaaaaacttcttcatgatcatgaacttcttttggccaagctcaaggtaagatactaagatgtgaagcagaaacaaaattaaagagacataaaaaactatttcttatacttcttgattcctctgctgttactggcctagggccactttaatatggtaccaggtagataatggaaaaatcagtagttatttatgaacaaacagcatcagagagaagtaacaatatttttaaaaattttccctaatgtgatagaaactatggaaggataatattttcactgtggagaaatgagtaatttttttttcctggctgcctcagtgggaaaaaaactccatcattttttcatttcatgcattacaccatcaagtcacaaaaacagatccacaatttctattgttaatgatacctgctggtaaaaataatttagaagacttttcccccgttggactattgaaaatatctgattctgtgcttagtattaagagttcttgaaaccaaataatacttctggtaaaaccagacatactattttata

SEQ ID NO: 97623 - DNA, 1309 bp, Homo sapiens
tcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatcca

SEQ ID NO: 97624 - DNA, 1511 bp, Homo sapiens
attatttatttcagtcttcatgatggtgctatcacattctacagttgtttatgtctgtacccagtaagctcttttgagggaaggaatcttgtcttctcctattcccagtcttgctcatgcataacagatgcccattcctcctaaatatgaatgctgtattataggcattagtaataatccctgttacattgcagtctgaagtatgttttaaacatacttttttaaagttagaactgacttacaagtgaatctattcttagattcttagatactaactactttagatatttagttatactcaataactaaatatcaatactcaatatctgtttcttctgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgactcattggtgatgttgatgaaactgctcagcctgccagctgggatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctc

SEQ ID NO: 97625 - DNA, 1046 bp, Homo sapiens
tcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttccaatgcaaaaaaaaaacccctcccttttaacctgctagtttttccagccttcttcactgactgacagacttcttggagaaatccacatccagtgcccctacatcctcatcactcactactcagcaccttgcagtctggttttacacagcactctactgaaactgttcttttgaaagtcagcaatggcctcccagttaccaaactgaatggtttttttctccgtctgaatcccttacccttttctctgcaacatttacaccattgagcaacctttcctagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatactt

SEQ ID NO: 97626 - DNA, 1102 bp, Homo sapiens
taactacacatgatataacctttataccatcaatatatttttctcatcatgtcttaatgtattttatgccattttaaaaaatgtttttcctgctgaatttcctgctcaaacagtatgatcaccgatgaactgatatttacacataggctatctcatgtagattttttatggtaaatttttgcttctatttgtattcactgcagttaatagatttgtattaatctgaggtttttctgtgtgttttgatttttagaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacagga

SEQ ID NO: 97627 - DNA, 2849 bp, Homo sapiens
tcttcttggaataatgtaggagacccttcataatccaattcttgcataattttatcttctataacattcccataaaatcacacagttgtttttatctccctgaaagcatcatgctgtttcatgcatccatgactaagaatacttgtttccttgttttctgctcagtgaattcctacttactcttcaagactcagggatacttactttactttaggaagcctttttggacttctaaggcaagttagtcacttgctcctccctactctcataaaacattttaaatagctttataatagtacttataacatctctgcaaatgggagcatcttgatagtagagaccatatcttatattttccccagcacacattatctaatacctgaatacagtatatgtatgataccatcttcatcaaagtggcctacattgttttttagtttcatatttaaaaaataattatcacttcccttcagtccattgtagaattactttaaccaagttgaattttaatgtcatgttatagcttttattcagagcatctttatttttttttaaaaaaaagccttgtgatacctacttctatattgttattaagctttctttaaggacatcaagtatagtagagcacagtgtctggtaacatattatcggtatttgagactgcagtgggagtcccccatcccacctgcagtacgcagaatttcatggaaatgaaggaaatggaccagagttaagttaggttaagttgccttaaaaatttaaatggttatattatccaaaaagaccacaatgagattaaaaaaataatttgaattgtgtttctctacacccagaggtcagtagagtttttttgtttttttaagccctccatctagtttttaagaatgtagatggagggttttaaaaaaaatcagaattaaatattattttaggtactataatataatgaaaagcgttaatgtttaaatgtttctttagctgggcatagtgatgcacacctgtagtcttagctacttgggaggctgggatgtgaagatcatttaagcccaggagtttgaggttatagtgagctatgatggtaccactgcactccagcctaggtgcttgagtgagaccttgtctcaaaaaaatatcatcctgtatttgagaaacattacacttttatccttgaaacttgtttgatgctaaacagcaatggagattttttttgggttttagtgtactattgtccttacattttgctttaatattttgcagaatccatgctatctttaagagggtttgtcattgagtatcatttgggtattttgatgttttgatgtaacattgatataaatatccctaaaattcttacaaatcaatacaaaatacttgcattctccattgtttaggactaagtattttagtgtactataaaatacatgtaccaaatgatgatgttacaatagtaatcaataaaacagaaatgatgagttaaatttatgtttgggttcattagatgtgaagacatggtagatgtgcgaaggttaaagatgcttcagatggtgcagttgtttaaatgtgaagaagatgctgcccaggtaaggagcagtcagctacattatgtagttaacttttcttagaagattgattttatctaactacaaacaaaagtgtacttttcatggtcctaaaaaagtaaattcttgaagtcaggttctagtttatctatcttgttgaagaatacactttggtattcccagctagttgattgatctcatttaacttaattttctcaatgaaatcctctataatcctctattgagctagagattgggatcgtttattatttattattgttgattaggttgtcagttacatccaggataaaatctggtggagcacactgcattttgctctcttgcatctgcaagagaaatttcaataccagataaacaatttgatatattttgtcgttatcatcagagaacatcatttcagttagatatagataaaatttttgattttatgtagtaacacaaatctgtaatgcaatcctgatggatctacatacagaaatacatgatcttttattatgtgatattaattttaaaagaatgcttttcttcagtatgtcttgccttcagatttaaagaattttgaggagtaggacaggtcattaattcatgtagcttatcattgaatgaaataagcttttaagactttaggttataattaacggatttattaatcacatgatagtaatctctgtataaatgacattttgatacaataagtaaagagttctgaatccagcttcattgttatgtctttttgtttaggcagtagaatggctaagtgaacttctggatgctctgcttaagactcacatcagattgggcgatgatgctcaagaaacgaaagttttgctggaaaagcatagaaaatttgttgatgttgcacaggtgcaaaactggttatcttccttttccacaagctcagtgtttgaatagctttctgcatgattataatgtaactttaccttccaagtacaagaaggttagttttgttattccagaagtgtcacagaattaagaaaatgtcagctggtgcatcaaaactagcctgcataaacttgagagggtttacgtttccctgaatacatgttctgcatggtccctctgatttatgctatgtattacggcatttttaaggcaatccaactgttcatccacagaagttaatatgaaatggatgttaatatcagtaaataagaaacctcactttctgcatcacactagtgttagcataataatacagaacttttttgtggtgaaaagtgtctttttttttttttttaagacacagtc

SEQ ID NO: 97628 - DNA, 3799 bp, Homo sapiens
tttatctggagaaattataaaatgtaatctcttccaggaactaatttgagccttagtttactttgtaacatcttgattacaggaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatgtaagtgtctattctgattcttttcttttcttcaaattatctgaacacttacctacacgtaatttttttcaggtttgcatgcctcctaaattatttttctgaaccaataaaatgaattactggtgggggtaatgagataaaattctttgattttttttaaaaacaagtattttttaagtcattctgcatgcaattcaaccttttattgtctaactagagtgttccaatctagtagaatattttattttgactccttctcaatgtttatgctttataacttagatggaaatggaagtctcaatacttttttgcattctgctgacctgaatgtacttctttgtcttcctggtgcatgcatctgtgtgttctgtcttccagataatgcatattctaatgattcgtccttgtcttgtaacagtgtagtcttttcaagtgtaattgtgataacctcattagatataaacctcattaatcattaaacactttagatgctgattacatcagggttatctctttggtgtccctctgctttagttgtctcagcagttggatggcttattagggatgttgtgcgtagatgtagcaccagctgatggagcatcgattcagcaaactttaaaactgcttgaagagaagctgaaaagtgttggtaagcagattttaaaaatgctgaaacataaggtttttttttttttaaatatcattaccatggttagacaattaagtcaacttacactgaactaattagtattattttcaggaaacagaaaaatagtataaaaagattttattcccttgaggggttataatttatgctgaaaattttatttttcatcgttagttagtcactcctcccttcactgggcctttacccttgcctgtttacccagctatatctacaggtgctgtgtcttgcatatactatgaacaattatttgtagtgcatgcatgaactgtaattagctgtgaaatgttctgtggtaaatcctgtatgcccaaaattgtgttttatgcaatgatttttgttgttgctttatcctaaccttgtgaaaaaatagttggtttggttttttggttcttgtctcaccaaactgggaatattgtcagattacccattctccaaggagtggggtacatttacattaaggggtccagttacattaagctgatgtaggcttgatgtcatttgacatcaaggcctttagaatttttctacagcaggaagcacagtgaactttcctaaaaggtcaggatgtgacaatgggaaggtggggagtcgtatcaaggggggacaaaaggggaaatggcaatggaagagaggaaacaggaacttaaggcagagaactagtaaaaagtggttgcacatgactaaaccaaattattgaaaactgccttagggaattggtttgaaaaatcacacttgtactgacattttacttgcttacagcctttgttattttatttttttgagatggagtcttgctgtgttgcccaggctggagtgcagtggtgccatcttggctcactgcaacctctgcctccccgattcaagtgattctcctgcctcagcttcctaagtagctgggattacaggcacctgccaccacgcccggctaatttttgtattggtagttatagtagacatggggttttgccatgttggccaggctggtctcgagctcctgacctctggtgatctgcccacctcagcctcccaaagtgctgggattacaggcatgagccagcgcacctggccagcctctgttattttaacagatggtatgcataatacatatttagtgtttaatatgacaaatgaattttcttttaaaatattagttttcttgagccacagtctttgtttaaaaaaaaaaagttcctttacacatgtaatttggagaattgtaaatataccctaattgttgcttcctatggtatagaagctagactgtatctttagtcacaatgttcaacatcctttgacattgatgatacattgctggagtgtcttaaaattttgcaaggcttatgcgcttttttaaacaacatgtttgccttgttctcctataagttggacagcataaaagcaggaagaaaaaacagaaaattgttttctattagaaataggaattttcatatttttcttctgctttcattttttaaaagtaattattgtctatggaaacccatgttttcaaaattccctttagggagaatttggcatgagagagagctccaattcgagttacatttaaagggttttattgcttgaaatgttcataggatggagtcttgggattccatcccaaggtggtttactgtacaaagctcctatacttgggatccaggtacaatatctgatgagacgatttgtttgagggagggaaagcgccttagttgtgtaagagattaaatctagtaacttttgttttagatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaaggcaaagtttgaccgttaattactttttactaaaataataacaatattagttaaaatgaagttatataacattttatatacagacaaaacgttcttaactgttatatagaagacatgtagtaggtttttggtgaatgtgataattactgtatataattttactaacatagtaataatttattcaattattaggtaccattttcctttttattgggttgtaaaaatttcaattatactcaactatttcaaattccatatccccagtgtagtctatgactcttctgctttaaaaaaaacttactgaagaataattttgctttttaaatttcatttagtttagagttgccattaaacttgtcatctacattgatctgtttcttcatctaaacttacagaatgtcacacattcattgttctcatatttgctgtaggaggattaaacagtggactagtgatgtttagtttcattttctataaaactaggaattcaaaagattctttgaaaactcagtttgcaatagcaactacaaagtattgcaaagtaaaggattaaaattatgcaatatacacaatctagcatggttatatgaaattttgcacacttaaaaattttatgatcatcaacaaaacttcacagaaagcttccttctgcatcacagagaaaacagtcatgaggcagaaatttcttccctcatatctgcaaacttacttttattctgtcaccacagaggatgatagagctctccgtttatatcaaaaaatatcaaagctgagcttccatttaggctctgattctgatcaccctcctgactcctaactccatcaaatcccattctctactctggttcctgccctcacttaaatgcttaaatttctcctgttttaaaaataataatcacacatatgggtacgtcttcctcttcaactct

SEQ ID NO: 97629 - DNA, 1162 bp, Homo sapiens
ttacagctctgagggcagagcatagggctgtagaagaacggagggttggggatttgttggtgggaagatgaaagagttttccgattacttcccagtgaattaagatctttggctgagaatgaagaagtgaaaagggaattggagactgatagtgaaaaaaacataaatgatcatgagaatgagaaagtgaatttactagagaaacataaaaggattgccaaagactcatttgagattatttagtcataactttaaaaagagatctgtcaatccttttgtagtttataagcatgatgatgggtgctcacactcatctgagatgtgtctccctctaagccttgtaacaacatcagcacgttacccttctgatgtgagggaaaagagagagagcgctatccacctagttgtttttagtctacccatgttcggctactctggtacaggcacacattaggcagagaaaacagatctcaggtttcaacaggtcattctgatggaaggaaagaaagccaggcaggggcatgggttatatgctgggaggtggttatagcctttgatcaaggatggaagtgaggacagaggttctcatgtgctggatggtagagaggtcagtagattggtggattccatgggattgtaggtgtgagcctacaaacagaggtgaatgggagagtcaataggtggtcagaaaatgggtttcatgaaacagatttttggagctacatagtagtatatgatgacacgtttttatggccagtggaagaggtagctgagttgaggtgaggacaagttagttggaggtgagggagggagtcaaggaactggaggttcaggatggtggtgggtgcctatgtagtggaagtcactaagaaggctgatgctgagaggaaggcagtgtgacctttgctaaacccttctgtggatgaggtgataccacacagaaagctgaaaagatgtaatctaacagcatgcacttcaaaggggatacggttttttgaaagaagagggaaaataaatggtctgcaagtagtgaggaacgaggcacccaaacccaccttcaggcttgcagtatgtcagacatggaaacagtaatcagttgagaaggctgcaggggtgactgagggcggacaggtttcacttagagcaaggaagagaagagaac

SEQ ID NO: 97630 - DNA, 1123 bp, Homo sapiens
gactcttgagactttgggccagataaatgtctgtcgtaagggctgtcctgcacatggtagggtattttgcagcatcactggcttctacttactgcatgcagtggcatccccattcctcagttgtgataacccaaaatgtttccagacactgccacatgttccctgagtgacaaaatcaccctctgttacctacttaatgtaatgtcagtaaatctacagtgattaatgttttataccttcaatcaatgaatgttaattgagcacatactatgtgtcatgtgttgttctaggcttttgccatataatactgtcttactatatggaatttacattcaagttggggagcggaaagcaatataggtatagattttaggaaaggcctctctgaggagatgacatttaatcagaaaccttgaaatgatgtcgagaagtaatccaaacaaagggcaattcagatagaggacacagcagtagaaacaccccagcacaggaagatgattgaggaacagcaagaatgttggtgtggctagagtacagggagcaaaggagagtcacagaaaataaagttttagaggaagtcaggagccaaaacatgtaatgtcttttagcccatgaaaagaaacttgaaatttattttaaatgttatgtgaagttatttgaaacttttggacagataattaatttatgttttaagcaaatcaccggctattgtgtggaaaatagggaacagagactagcaatgaaaatggaaggcggggggctgatagatggaggcattagaagtaatgagaattgatagaagttgatgaggttgagccagcaagacttgctgatgaaagaatcaggcttttggccttagcagctactaaggcagggaggactgcgagaggaacaggttgggaggatagtgaatcagtgtctttggtggcaggttagattttagatatctagtagtcatccagatgaaggtggctagtgggcagttgggtatcagtatctggggttcatgggaggggtcagtgttgatgattaatttggtaattcttagcctatagatgtatttagagcctatattaacttggtagttcttagcctatagatatatttaaagcctatattaatt

SEQ ID NO: 97631 - DNA, 1112 bp, Homo sapiens
cctcatattgctttctttgtaatgttctgtaaatcaggtatagcaattactggtattggcagaaaatctactactataccctaaagcagttgtaatctagctgaaggaataataagagatattacaagatttggaattgtctaaaggcactacatatatattccttgcaatttttctaattagtacttgtaaaaaacttgaaaatgaaatctcataattgaaaatcgatttattttatgcatttcacaggttccaacataatggttcttccttttatactaaaataatcatattacaaaccctgttcctgaggatataatcttttaattctcttggtacttttaaaataatgttttgattttttttttaacatggattgtgatttgtttgaacctggtagactgttctagaacatgttactatagttagagtctacaatttgttcctctctttagttcctaaaaaactgtatttactctagaacattctagacttcacctaaggggatttagttatgaaagtattccaaaagttctttttaggaaggacacatggcacatgaggattctaaagacaggatttatctatattttattattttttttaaatgccaagataaataattacagttagaaattggattgtatacatactgtactgtactctaagtttacaaaaagacttcaaaagcaaatttcatattgcgtatagtatggatgaaattgcagatgatgtacatagaaattgctatgttcagatgttggttttgtatttttaatatatttataaggttttcaaaatcagcttaaagaaacatcgcttaagggtggcccttcccatgtgcttaagcttacttataatgtggaaccaatatataaaacttttgaattgcaaaataccttatagattattctaatatcttcatcttactttatagatgaaaaaactgggaagctacgttttttgatcagtgaatagttggactattgttaagacacagatctcttgatacccaggggggatcctttctctagctgtctcttagagaaagctactaaattttacagatatggttaagctacagtagtttttcattcttgtacttttaatac

SEQ ID NO: 97632 - DNA, 1082 bp, Homo sapiens
ttctcctaacaagcctttgagataattagtattattttatctattttgtactgcaggaagccaaaatgacttgccgaagatcaagtaactattaagctctctctccatagctaaatccaaagccaaagctctactgttttataatcatcgatgtaaaaacacttatcaccttgcaaagccttgcacatagtgcaagcacatagtgctgcctgatatgtatattccaacccaaatatctctagtagcagtttcacaaactctaagagaatcaaattgtaattttttccaattgaaatacctcaattttatttctgatcttttttttaataatagctcataattctaatcctactgtgtgccacatactgtctgagcactttacatatgttaactcatttcagtcctgtgaaatagatactattgtcattccaattttaagatgggaaagctgaagcataaaaacgttaagtaacttatataggttacacagctagtaaatgctggagctgggacttgaacctaggcagtttgatttcaaggcatgctctttgaaatcattatgctatgctgcttctctaatgaaaatgatatcgacaagaaaaataatcaagggtgacaattgtcaaagtagaaaaaaataaatgtattctgatattcatagcttttatgaatatatataaaaagactttgcacaaacctttaaaacaattatttttccaattataaaatgtaataaataataaagaagtaaattctgaatatatttgttgtattgattcaggtgtcctaagttcttccagtatgatatacagcttattttgttagagaacaaagaaatacttgtaatctctgaattattatatatttagcaggtacaatagactgtcagtaaaaatactgctctagatttaaaacttaattccatatatatgtttagcagcttgaaagctttttattttaattcattgaattaagaagcttttacaatttctattgtaaatttaattttatatgctactaggtcctattttatatgctattaacttttaaagtaagtattgaaagagagtataaaacaaaaa

SEQ ID NO: 97633 - DNA, 1060 bp, Homo sapiens
tgctgccctctaatggcagctcattgatggcacccactgatgtccatcttaaccaccaagaacttgctgttcttggcatccagcaacttatgtagctgcgggatcttgggtggctctcccagtagatagacagctggaaggaaaagcatgcacatgtgaatcctgtgatttcccgtcaaggtgttggcattcaggtagttgtgacaatgttaggattcttagagtaagtgttttgctttaccatttgttcattttattgttcatttatccattaattcatcagatgtttgggaatgccagaaatgtccactgcctggacttctgtcaatctgttaggttctaagtatagatttgttgagtgagcaaataaatacaaaaataaatgacgtggtctctgcccttggggagacaaaatacaaacttaaatacaccttggttgcctttattttcctctttaaatctccacaatactgggaaagatagttaaactaggaaatggatacaaatatccatggaaacctagtctccctgtatttctagttctcagaattcattgtccctaactgtagaagggctttgttctaagaagtacttattttgcacctagaaatgatattagttttttttggtgcttcttgcttttggttgaaggtaacacaaaatcatggttgcattttcctttatatttaccagtctctaaggcatttaatttgtcatgaagtgtggctttccgcctcttttctatttaatgaactatgacttaaaataggtgctgctttaaatgaccatataaataggataagtgaagtgctgtgtattttttttgttacgaatgttgtgaattccttaattctttcatttcttagcctgctttacaagacaagttttttttttaaggtatttttctttctactctttattatttcatattaggtgaatgtctgttattggcttcattccttgtttgagagtataatccactcagatgtatttaggtcagatatcccattgtagaagaatgtggactagtatgtttatgttattttttaaatttattttt

SEQ ID NO: 97634 - DNA, 1371 bp, Homo sapiens
gttttcttttaaacatttttctgatagaagattatataatcagtttggttttagatcaagaaaatacgattaagacctaattagatatttttatagacttgattttaaatcagtaattactgcttttaaaacgctttgaccaaaaagatgatccttgtaattaaatattaccaagtaaaactacttggtaaaatatggttttatattattctatttacatacatttattttggtcccaactcatgattgtaaagcctgtgaaccacaaagtgttctggatcatcaaacgatagcaaataaaaattaaaaaaaaaaaaaaaaaactacatcagattttttttcaaacatgagtgtaaaataattaagtctaggacttgttcttacatattaaattacaagtaagagcacgggtcatctcccctatttaaatatttttcagactgaaatttattttttcattttcttagattttacttgtcaacatacagattgaggctttcttaacatctaccctttgctatatgctcaggtcatgtgtatgtatatgtacatataatttaaaaaaattactttttagatacaggatctctctgtgttgcccgggttagagtgcagtggcacgattgtagctcattgtaacctcaaactcctgggctcaagtggtcctcccacctcagcctcgcaagtagctagggctgtagacatgtgctaccatgcccagctttttttttttttttttttttttttttaagagatgaggtctcactatgttgcccaggctggtcttgaactcttggggtcaagcaatcctcctgtcttagcttcccaaagtgctgggattacaggtgtgagccaccacacctggctacatataattactcattgtaataaacgctatttgagttcatattaagtaattcaacaagtaaaaatgacatggttccttctgtcagtgagctcttgttagaaggggagatggataatgatgaatgataatcataatagagtggaaggtaaatggtagcactgaggagggagagaatgggtactcatcctcaccttgagtgttgtgtcagggaaggtttcacagagaaggtgaatctaagatagggttaaagcatgagtaggaatttcatggacaaaggattgtagtaatgttatttcagcgaagatgacatcataggccagggctcaaaccgtgaaacagtattgcaagttcagagagttgcacttggtttcttgctaatgagaaaaacatgaagtggagagagaggcaggaggatgatctggaaaagacttaagtcttgtaaaagaattggctgtggagtaccattcgggattttcaaatggagtgaaagaattaattttgca

SEQ ID NO: 97635 - DNA, 1120 bp, Homo sapiens
tgtgtctctgttacaccatttgatgttctatagaattctattctataggattctgcgtttctactgtctgtataccatgaccttgatcaatttgttcttctgtctgaaatgcaccaatcgttcatctcaaggccatgtgtctcatcaccttgtaatctgcaagctgttaggtatttgactggatcatcagttgtttcagaagatgtgaagctggaactattgaaaaatgtcaaaataatatgttctgcaccagaatagtttgattgtccttctaaagtaaggtaatgattgtaaattggttgttaatatatcagtatcaccagtcactgattgtggagcatctactctttgttgagtattggacttaaacattggaatagtagataatttaaggtttgcatgtagttaaatggcatttctttaagaataaagcgttagtagtgctaaatgatgccttattgttttaatctatcttaataatgataaagacttggccagtggttttgaatcctagctgcatatgttgtttacctggggggctctgaaataattcctgtgcctaggtctaaacccagagattgtcattcagttgatttgaactggggctctcacatttatattttttaaaagctccccacatgattctaatgtgtagctgggttaaaatataagtgaataccagtggtttcagtcacttttaaagttctttcccagaatgcttccagctgtgcagcttttaactttatacttcaaagtctttaccttagcagattcaaaaaaaaaaccttgtacttcctgcagatgactcatccaggagagtcattatatgaactatgagctggtttgcaaaaggaagaaaacattttgtggcagtaattaaatttctgtagacaatatgaaataacagaattcaggattattctctcaaagatttaaaaaaaaattctctattcatttttttaaaaggtggttgcaggaacagtacagagcttatagcatcctatataatccattgatactgtagacttttgttgaattaatagtcttaatctcacttcaagtgtttacttttgtcagatactaagatacatagttggcacaaatatagataataaataat

SEQ ID NO: 97636 - DNA, 1051 bp, Homo sapiens
gtggttcatttgtcaaaactaagaaaccagcatcagtatgttactgttaactggagacttgctttggatatcaccagggtttccattaaagttcttttctgtttcaggaaccatctagaaaacaagattgcatttagttgtcatttctccttagtctcctctgacagtttctcagaggtgttttttttttgtttgtttgttttaaatgatagttttaagaagtactggtgatttattttaagacacaaacactaaaaaacaaaagtgttgaaccttactttttgtcagctggatgggggtagtagtggtggtggtcctttgctcttttcccatgtttgagttttatgtttggaagtctgtgaggtcagcctagccacctatgtattttatgcctctcttctccccagacttttataattcatttacttctcacaggatggaggctgtatgaactttgggatggagaacagattcctgggggttggaagggaggaagatatgcaaaaatggtcaccacactgaaagaaagaaaggggtatcaaaccaggagaggaaaggagacactatgaaaataacatctggatctttgcagcttgagtcttgggttctgaataattaagtttaaaaggtggcagggacaaaagagaggtcaagtcacctattaactttttgggccagattctcccaggtgtggtatctgtactaaaacaatttttctagtggacccagcaaaataaaaagcaaagcccctacttcctcaatttaaccaagtcaaaccaaaaggtaaaaatacctcttagctgcctcgaagtgcaagacaagcatttaaaaagacagttcagtccttgtttaaatctttttctgttttgatagaggaaggtggaagatggtggactcctgaggcagcagataggaaggatactatagagaacttaagacaagagaaaagagagcttacaggcagctcagaagacaaacagcgatttttatagtttttactagatcttgaattacctttactcacagccagatgaaagctcaataccacaga

SEQ ID NO: 97637 - DNA, 1128 bp, Homo sapiens
agctagagaactaacactaggcactttacaaccttatctcatttaatctttccaataatcctatcagatagagatgatttccatttccctttctaatagataaagaaacaaaggtgcaggaattggattttccaaggtctacttggtggactcccccagtcctgggaatattctttggctcattacaagtattcactcctgggatgatagggcatgcccctatgtacagggaataccaaggggggaacctactataaactgaaatactaagtgtatgaatgaactaagccagtgttggatgagactacttatttattaatgacttccattaataaaatacaaatagaggattgttaatgtgtcccaatgccagtgcttaagagtagtaatttaagatgatacttcattttcccataatcaccttatctaaataatttattacctactcctaatttcattttcagtttgaccaggtaaagcacagaagtaaattgtaagttagtggtcagagctggtttgatagtggtgtgtgtgtgtgtgcatgcatgcacgtgcgtgtgcatgtgtgtgtgagagctgagaagtacagttcttcagcagcttggcatatgcagaaactgcacattcttggaaagaagtaatctgcgttataatttaattgccttctagtagatttgcagaatcatttagaaaatgaacctgcctttgtcaattggtttgtaaagacctattgattatattcttgaaagatagtaatattgtctttcctttagtgggtattgccagagcttttgcttatgagtttcattttatttgatcaggttcagtgatattgatttggtatccttgcatgctttgtgctagggatgtatgaaacaaaatgcttttgagaggtcatgaattgtgattcagtaatagtttagaaagtttaggaattctatctattggggcttcagttagcatgtttttgtagtagaagtgggaattactgagtttaggttagataatttttatcagaaaagtcttgaattgcactgtgtaaattctcactgacgttgcatcttttctgcagaatacaaaatactttggagctatatataagaattagaaaacatggttctgttttca

SEQ ID NO: 97638 - DNA, 1078 bp, Homo sapiens
ggtctgagtgtaaactcaggtcttctgactctacttcctgcactcaatgaggcatacagaaattaaattgtgtttgtgaatgtctggttgattagtgacaaagtgagggaaaaataaaaaaaatcaaaccaaacaataacaaaccataaggtgttgtggcaacactgccacatattcatcagattttattacgcattttcaaataaattccttttcttctgtcataataaggtaggtctgctttccacatttccaatggggaaacagagtcagagtgattcaacctagtaacagcttcttaatagcatagccgatcctagaacccactgtttcagaatttgaatagtatgtatgtgtatatatatagagagagtaaaagctgaaaatctcccttcactttttgtctttttccccttcttcactcctaagaccacttccatcttggagaaactgctgttgacagtttgaggtttatatttccaaacctgtatctttgcatttatgtgtgtatttatctataaatacacatttccatattttaccatacatacagacatgtttcttttcataatgttttttcttttacaaatgggattatactacacatattcctttgtttttcacttaaatatgttaaacttttccatctgtaattacaaaggataaatctaatattatgttttcatttaagtttgctatccatgcctggcttcggtgtcaagatgaagtcaggattaagaatgattaggaaacttttcacttttttctgtgctctggaacagtttaaaatatctgccctttaaacgtttactagaaatcatctgacaactgtgggggcagagagagatctgagatgacctttctaatttttttttttcttttgagacagggtctcactctgtggcccaggctgaagtgcagtggtgtgatcacacctcactgcaacctcaactgcctgggctcaagtcattcacccacctcagcctcccaggtggctgagagtacaggcatgtgccaccatgcccagctaatttttgcattttttgtagagatgaagtttctcaatgttgccaaggct

SEQ ID NO: 97639 - DNA, 1024 bp, Homo sapiens
cgccgtctgccgggtgcggccgcggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcgggtgggtggaggacacgggctcgaggccccagggctgcgccgaggctcctggacgcctcctcaggtcgcggggcttggcttccacgggcctgccagaggttaacatccctccagcgtttgggagagtcacaaaggggaggagagagagggttggccagggtctgtggttgtgtttatttttctattttaggtagactcatattagaaaagagccgcagtctgaccagctcttgagggtacgggtgggatttcaccctgggatgcacggtttggacttggctgttgctctgacagcccccgtggttttcttggtgctttgacatctttctcttacacacagacatcgcgggagaagttgggagtgctgccgagggagtaactagatagcagctgtttgacaggtcgtctcttacttcacgttttgcttgtgtcaagcatgcccactatgtatcccagcatagcttggcaaaccgtcaaatttaaattgccactcaaaatcctaatccttatacatacctacatacacagacacacatatatctatatactttttctgttttggctggctaaatcttattaatgtgagaatttttcctcccaaggaagaatgcataataaggtacaatttatctttggttacataccttggttaagttatgccaatacctagctggtttcattggtatgctattttagtttaacaatactaattcctttagctttgagcagtaaaatacgtctttgttctaggaccaggaagcttttatacgtaata

SEQ ID NO: 97640 - DNA, 1041 bp, Homo sapiens
agatcaaatcctgcctacagggaaagctgaaacaccaaacttaaatgctaaatggaaacaataacaacaataacaacaacaacaacaacaacaaacgaccaacagatgatgaaaaccccgtgaagcaaggtaaagaagggaagagcagaagttctcctaggtatgaacagggcaggttctgaaaagctgtgtgtaaatctctcagtatccatgagcaaagaggccctaatcaggtgatcacactgctgtggctggtaggtagagcctactctcccttgttctgatgcctgctttatcctcacttttctgaagttggaagtttgtgtgtaaagatgcagtatagaatttgaacttagaaaattgcaaaggaaccaaggaaaaatcactcttcactgcctctctcacttgttcatttggatccaatgcacctggcctatttcctaagaaaatagtctgttttaggttgtttctatggtcacagtgggtcttgtcagagctgtatgtgtacttgggacttggacactgtcattcttcttgaagccaagtagtagagaaaaatcttccatttgtcatgtttgcctcagggcagctcctcctgaatcactgtagattgttctagaaacacagacaaagcaataaaaccctctttcatattgcgttgacttgaaatcataaccataagttcccaccacaaatttctttcttcattaattcatttatttcctcccttcctccttcttcttgtacaaaggctttgaaggagcatagtaaaatcttaaagaggagaaaatgagtgctagggggaaatctgggcctagcacaccatgcatacacctggacatttgctagaggagcacctcacatttggtccagagctttgcagcagctaatacagatttgtgtgcgagatctctaatttgtaaatggataatacaattgaagtgtccataagaagaaaacaaatctattttttagaagaatcataacagtttttgacctgagaggaattccctcctaaagtgtaatgatgtggtggacaac

SEQ ID NO: 97641 - DNA, 1135 bp, Homo sapiens
cagaattctttgtatcaccatagcactagagagtaggttagaaatttctgaatataatgaatagacagaagaatcgtaggaagtcttagagtccttgtaagactcaaccaggagacggaagtagccaaaagacttttctgtgaagatgacactgagaacctgtgaatttgtgatgctgggcttcataacaaggaggaaaaaaacacagcagcagatataatgtggaacccatgactagaggactaatgaaaactcagacactgctggattttccagtgtagaagagtgatgataactgaaatatttcaagataggcccatgacaatcaggaatgagacactcaacctaggggagaaaatgaagagcaagaaaataatgaattcactggatttacccaaaattgactagattaacttttctactactaaacagaaaagaattcaaaataggtgttgaatgcaaacaaaactgtataccttatgatctagagcagaggggttgtaacaataatgcagggccagatcatgaagagcatcgttaactgtgctatggggagtcattgaagggcttcaaagacagggacttacaggatcagctctgtgatttagtgtttctctctaagcaatgtgcaggctggattaaagaacaggcatattagaggaaggtgcctaagtgacagagtaggtggtggggagtcattgggagagagatgattcattgttgagggacttgcttaggataaggtttaattacactagatctaatttctatgataggacacaaaacttctattatattgaaagtaactttatcaagaaaagattgagaatctctaggatcaaatccaagttaatgtaatcataatcctgcctggatataggagaaataacataaatttatctgaagaacttaattttgtataggaagatttaagagatagtcttatgttatttgaatatgtatactagctcctttgcatccacttagggtgtagaatatagaaagtcacaaggaaacattgctcctaccctaataagaatgaaaggggataacaaattcataggtttgattcagcaaaagagctgaggatgcaagaaaagactaatgaactaaatcaaagtgagagaagaaatcc

SEQ ID NO: 97642 - DNA, 1186 bp, Homo sapiens
tgacagcaaatattgcctggaaatttttgttaacatttcctattctacttaacttgtgttttgtcttgtgtgtgtgctcctcactatgttctatactcttatacaagcaattaatacctaactacctctagcagaagtattttgagtataagtgagttatatcagaagcagagactagaagctggattgaggaactattctgttctgctttgaaaatgcatttctgcagcatcaactatgatgtattcacatgtactgtctgccgctcaggcagatttttcaccttcactcttttaatgtgtaaacaagaaacatgttgcctatgtttgctatttctatatttttacactatttcagagttagtattttttaaggatcaactgaattctagatactttgcatgctcattccttttcaggttctcaatttccttgcttccaaagttctaattctacatccctagctacctactcccattgtcatccccgttaggttggctttcaaatcataccacctctgaaatccctccttgaagcatcatactttggccacttcccaaccagttcacctgctttagtaccactattctagaaatccttcacctcagcaaaccttctgatccattgactttgttacaatcagttaccaatccccaccccagcacttctttacttccctcattccgtgatctatcattcgaatagataaatgaacaaataacgaatttaattctttcaaaacaaccccatgagaattggtattgtcttcctacatcacagaagaggagactggagtccaaagagactaattaggctcaggccacaaagttgataagtagcagtatttaactcagatcatcttcattccaaagcacaactggaggatgaataaaagccagagagaaggatttgagaatcagctctgtctcctagcagctgtgtgaacttaggcaaattatttcacttttctgaccttctgattcacctttaaaatacttttgtctaccttacacagttgtagtgattattatatgaaataatgaagtcaaaggccctagaataccatgtaacacagtgggcatttagcagagttctttttcatagcatacagcaaagatgtggaagaaaattcaggctcatcaactggttcattgattgcttcattccatctgtaatgccatttatag

SEQ ID NO: 97643 - DNA, 1627 bp, Homo sapiens
ggctttgcacctagtttatctgagttagtaaacctacactgtatcagtaaatgtgattgttataattatgaaattaagattgaaataaaagctaactgtcttttattttacacacgcagctaatgatgtaagaaagaagggacatgggaagaccagaagtaaagaggtagataaattgatcagaaaccagcaaacaaatgataggaaacaaaaagaaagaagacaagaacacgggcaccaggaaacaaggactgagagagaaagaaggtcagaaaaacacagagatcaaaattcaagtggttcaaattggagagatcctataacaaagtacacatcagacaaagatgttccttctgaacgaaataactacagtagagttgcgaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatactctgaacaatccagagaatcaaagaaaaatcaggaccggcgaagagaaaagtctccagcaaaacaaaaataattctacaaaatgacataaactggacatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctcattgattcagtgatgttttttcaattgacaaaatatttttttagttgtttaagaagctgttatagtgaattatcagtgcttttttgtttgtaactgaagaccaaaacaggtgaaccttttcagtttaacagttttgctttgttaatgagatgttatgaatctttttcaggtagtcacttttttttttttcagtagaggatttgttacaattttcatattaggctttgaacaaagtatgtaatgtgtaatttttttcacaagtgttggtaaagctaggtgtatgttactctttaaaccaatacgcagttatttataattagaacttctcccacaggaaatatttcttctctctggactccttgatatcatttaattgaaattctttgtgattagtgcatttttctcagccttgaagttatatcactgttgatgaattaatgtgtatttaatttttagtttaggttaatagatcattggaaaacatatagttgtgaaatatgcaagcagcctaaatgtaatttcagttttttatatgaattttaagggtttccatcattgtaactgttaactgattaattaatatgaccacattagttattacttttgaaataaatatttcctctaagatattagacttgctgacaaacattttaacttccttgctaaata

SEQ ID NO: 97644 - DNA, 1059 bp, Homo sapiens
agatgtatcaattataaaacatgttaaaatgaaaacattttttaaatttacaaatacaaaccaatactttatacaagaattctctataaagttcgtcaaagtaaaaaataatttgtttcaactgaatataaggcatgtccagtttatgtcattttgtagaattatttttgttttgctggagacttttctcttcgccggtcctgatttttctttgattctctggattgttcagagtatctgctagatttttcccatcgtctctcggcaccattttgatatctatcttcatcacttcttgagcctgagtgctttctattcatttcctttgactttgatctatcttttcttctgaaattttcactgtctttaattcggtgtgtatgcttctcattttcagaaaaagaatttcttctctctcctctcttctttttgggatcaccatgcttattttccaaatctatatgcatttcttggtctctgtcattcgcaactctactgtagttatttcgttcagaaggaacatctttgtctgatgtgtactttgttataggatctctccaatttgaaccacttgaattttgatctctgtgtttttctgaccttctttctctctcagtccttgtttcctggtgcccgtgttcttgtcttctttctttttgtttcctatcatttgtttgctggtttctgatcaatttatctacctctttacttctggtcttcccatgtcccttctttcttacatcattagctgcgtgtgtaaaataaaagacagttagcttttatttcaatcttaatttcataattataacaatcacatttactgatacagtgtaggtttactaactcagataaactaggtgcaaagccaaattgattgaatagaaagtctgatgacacagagtcttaccaaatgcttaattttattttattttttgagacagttttgctcttgttgcccaggctggagtgcagtggcgcaatctcggctcactgcaacctccgcctcctgggttcaagtgattctcctgcctcagcctcccgaatagatgagattacagg

SEQ ID NO: 97645 - DNA, 1029 bp, Homo sapiens
acattcaccatttttatattctacagaatttgttatttcatggtatccattttgagaacagatgataacacagcatgaattgctgcaataaggaagcttgctgattcaaaattaatttgccttctcatataatttcagtagagaactttgttttattaataaaatactaaatagcataaaagcagcatgaactgccccaaaattaggaaattataatgcaaacatagcaaacggagaagagattgcctcttgttacatggctgggttttaatatcagtaaagcccgacagtggtgtacagtaggatcaaggggacgctggtttagcacagagccagatggtttctgcttgggtagctgcagctcagctgagctgtttgataggaaccagagaaataggtccttagtggcaaaccaactgactgtaccatgtgccaaagatatgcatttagcggaagaaatagaggctggtacagtgagatttaggtagaattagggtgacaagaggcacttttctatcatattttctctttcttgcctatgtatgaatttgagagaaatttttgttatcttagcatctttgatttgtgcacccaaattaaataacagataaactgattaagtttgttttattgcttaaagtggttatttcagtataaccattttgtatttatagttgtgattacatcagcaaaatcaaattgtttgaggtcttttcagaagagtttctacagaaactaagcctttgtggctctaataaagcccatgagtgtaaatcttaacatatctgctcttgttggtgcagttagtgcctctctgatagtaacagaggggagaactattgtttttgcaggaagagacctttcattgagaaatatatgttcatgctgttaagcaaacccagttgttctactcctcctatgtttaggaagtgaatgctagtttgggtgatcattgtattttgatctgacttaatagtcctatgaataacactctatgggctggaatttcagcttttggattcaatttgt

SEQ ID NO: 97646 - DNA, 1045 bp, Homo sapiens
tgatagaaatcaagtttggtacattattacttgaccctactcatttcatttagatagcacgtagcctaacctaataaatgacatcaactagttacttggttgtatttcatttagtaatttaatatatgaaaaatctgaaaaatgactaaggattttacctttttatctttaagcaatgtgttctcttttgtttatttttttcctttttagaactctgcagccattctttgaaggattattaccccgagataatccaagaaacactcggtttgccatcaacttctttacttctataggtcttggaggtttaacgtaaggattattctcagaatttatgttcagattataaaattatctcataattgtctttgaaatagaatctaacagattatattttaaattagggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcaggtattgaagcttatgtgtaatttggcttgctcttttctaataaatatgttgctgatatatatgaaggaagaaaataatttgattgtttatttgtcttagagatcagttgtttaaaagccacaattaatacaaatggtcccatctatcattcttgcagtctgtaatacaacatttataatgctgggattaccttttgacatcctcatcatagaaatgaaaatatttcattcgcagatacttatctgagtgatgactgatatgaaccatccattcataatgtttgtaatctagtttataggagctatcctgatgtttttattttaaataaattttagttttttacttttaatattaaagctgtttgtaattgagatatatcatacattcattgtggatctcagatgctatatgaatttttat

SEQ ID NO: 97647 - DNA, 1002 bp, Homo sapiens
atcttccctgctataaaaagcacattactcaaaacagagaatgaaatctatttctgtcgcatcttaacattttgaaagttagtatagagaagtagttttaaactttatgtcagcataaggggagatattcagagataactctggttgaagatgggaataaatagtaattttgagaaacacttaaacctacaaatattggtcactatgtcctgtcttttataaattaaaatatacttgtctttttttattttaattttcaggttcttgaatgtataaaactgagtgaagaaaccactacatcatccagtagaatttttgtcaaaatatttttccaggaactgtgtgaatacatgggtcttcctaaacttaatgcaagattaaaggatgagtaagtttgccattaagcactttttattcttattgacctctggttttctcccattgtagcagacataagcccatccgagactgtaaaaacaagagctaagccccctgagactttcttcatccattaatcactgtgaatttcatgttatgtcacacaggacaacatgcaacttttagtggtggtttttagtttaagtggagttcaaattaatgcctttttagattttcttagaaaatacagaattgtttttgtatgctcacttgaattctccagtgatatttataattttattttctttttaccctaattttaagccttagaatgataactaatattatcagtggacagttttgagtatatatttcatctattaataattgttcaaaatattacatagaactagagccttatttcaggattattatgtaatcccctctcacctttcttatttcctgtttgttcagattgccacttaggttgacttctactccattgacactactgaaatcatcctttcagatttctcagtgaccacctgccatattcagttgtctttctcaggctgcatgcctcttcacttctctgcctcacttatgcagttgactacctactca

SEQ ID NO: 97648 - DNA, 1109 bp, Homo sapiens
aaagcggtgctgtccaatacaacttcctgtactgatggaagtatttatattctgcactttctagtacagtagtcgctagtcacatgtggcttttgagtacttgaaatatgactagtaatgtggctgaagaactaaaattttaattttatgtataatttaacataatttaaatttaaatagccactagccataatggctagcggctaccatgttgaacagcataattctagagtatctgttctgtgcttctccaaggttcccttcctacctcttgctctaagtcctcctctggagtctctgacaatactgttaacatatgcagtaaatacttaattatataattttttaaaatatttactatttttagttaggttatatcctgtgttagtaaatatgacaaaatgtcaaaattgttcattgaaaatataaaggtaaaaattaaaaagcaacacgtttttatatgcttgctttctgtttgcacaaagcaagtatattacagttactctatttggaaaattgttttaagtttctggtaaatctttatagaaaagattacactgatcgtagatgaattaacaccttttttcattttgtctctattcaccttatgttgcttgagttttttcatctatgacattgctataatcaatacatatttcatttgaattatttcaggaattaatatattaattaagaaactaatttgttaagtagaaatcatctgtgatgatagtatttcttgactgggcatttatccattagtttaacagaattttcagagaggtttacatggcgcctgaatagctaattggaataatatactagcagttatggaatgattccatttatttgtatagatccatatagataggtctatatgaataacatttattttgaggtgagaaaattcatccacagaggtgttttttgatgtttctttatcaacgttaactttatgttaacgttgaagttgtacctacttatgcctctgtaaagactaataatgatctgccttttccatgctaaatatattccttagcaattgaattcatatccttgggacatatgtaactgaattgttagatgttgtgttggtgagtctatattta

SEQ ID NO: 97649 - DNA, 1385 bp, Homo sapiens
tgacaaaacagaaattaacctggtctcatttcgtcgtacaatttatcttgctattcagtcaaggtaaggcatcatatctcagttcatcctttttttgtttttgataagggatgggtaaagagatcagggatacattttagggtctcataacagaaaactggacaccatttcagcattcttagactctctcccccatcccatgcccaagctcatagtacctttctgttggttctttgctttataggcaaattgtttttacttaatgggaaggtctaattgtgttacctaattaaatggttttttagctatatcatttcttatagttaagtgccactaataaaaacttgaaaataattctgttttacaagatagcagagtacctaattttataatgaaaatgtaatatttaacatttttaaaatttggtttctagttctgattctaggcaaagaagcactgttgtgatgactgttggacagtgatttgctctgcagatgtcaatgagtataaacagaaataggaattagacttaggaagattttgaggactctttgaagtaatgctaagtaagaagtagtgtgatgtgatgtcatgaaaacaaaacctattccctttgaaggatgtgaatttggttttgaagagaaataaatgaggatgttaaatcttagtgcatctggtagtttgtatgtgaatcaacctattgatttaataggcacactgtttacattttacactggaggagaaatgttttctcagttttctttcattactaggtttagtatatttccatttaggatgatgtaatagcagtaatgattcataagtaggagtcatctgttttcagtctgaacattttttggctttaggtttatcttcaaatagaggaacgttaaacagcaaaacattggttgggaatttttttgctttatccttacttattttctcttcacataaaaagtattaaatatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctgggaggcggagcttgcagtgagccgagatggcgccactgcactccagcctgggcgacagagcgagactccgtctcaaaaaaaaaaaaaaaaaaaaaaaaagtattaaatattttttcatataaacttaaagtgaaaagtgagaaatattttctcagaggtgaatattctttgggtttgacctttcatttgtttgtccttttagaaatccaa

SEQ ID NO: 97650 - DNA, 1218 bp, Homo sapiens
attattttctctcccttctttgtctttccaagtacattcttagcctaaattcttgttttctgtatctagccttaactttttgtaatggactgtcttctttctgatgatgaaacaatattttgactcccatatactaacttctattcctaatatttgccagtgctcttgctcttttcaaaaaccatcgtctactttttctttgtttttttcatctccttgtttcatggacactttttatgtggcagaagagtgatacatacagctctctttagtcaaatcagttataatgctttttgacaacctaggcaataacacgaggcttggtggttatctttgttggctagcaaactgttacaccacagtggatttcaacgaactgagaatttatcttcttagaatgaaatacatgtatatgacttgcacatttttttcctaaacttactttgtactttacagaaattcttgatgagggagatactgactcgaacacagaccaggatgctgggagtagtgaagaggacgaggaagaagaagaggaagagggagaagaagatgaagaaggtaaacatgtagcatattcaaataatattataagatactctaaaattaattctaatgtaatcttctaaaacaatagttctcaatctttggggagagcaaggacagctgctgatggcgtctaggaggtgaagactagggctgctgttaaacagcctacaaaccacaagactgccccctacaacaagatatgatctagcccaaaatgccagtattgccaagactgagaaactgctcaaaaagtattaaacaaattcattttttaacatcagcacaattttaatttagtatattatgcctttgattatattctagacaatgaaaaacatgttttcttattgagttcatgtgatttatgtagccctggcaggaatgtgacaaatgagagtgactgcatatttgctgttcattttggcaaaatagagtgaagatgccaaaagctatatttacacagaagtagtatgttcttcctcttcagctttgattaccttatttcacagaaataagctcggaactttactttggttaaggcacagttaataaatacatcagaacataaataaactggtcattatttacatgtattgcatgtgtgaagatattaaaagtatacatttgccttttagggcataataaatactctgtcttatagtacaattc

SEQ ID NO: 97651 - DNA, 1813 bp, Homo sapiens
gttttttacttcattctgaattacttaccccattgttctttcctctttccctctaaactatgcaacacttacgtctcacccatcttaagaaatattcatagattagtggtggcctttatttagcttctctaccatttacattctgtgccacccagtttagtattcaattaagtggtatactttattgtaaagtgctatactttattgtttcttgaggtcaggttaatatccttctggtaggatgaatcatagtattggtgcctctctgataaaataaattgatcattttcatttgtacatcattggtatattgtaagtactaactttggacaggttttgatgtgtaatttatctttgacattactagctgagtgacctgtagcaagttacttgtttgttggaagactaaatgttacctttctatggaaggatatataaaacacagtgttgtgtattatcacctacaatgatagctattattagttactattttcacatttgtattattttcctcctaaagctaacactcaggcctacttacataataattttatgggcttatttctcttgagttgtaattttactggagaagtatttattgctgtggaagcaataaaatttacctttgtattaaaccccaaaagtttgtattaaaagctctctgattataatagaaatgtaaagagttggttagctttgcaaaatcttttatcaggctaacagcaccattgggcaaaatgtaattttagtttttgtcatttgtttgcttttaacataaagaccagccttatgtagtctcatatacagagaaagcagaaacctagaactctgtctctgtctgcattccattgttcagtagtgcttagaagtagaaggttgaaatgaaaagtaaaattgggagaaatcttccattcctctgcattatcctaaaaacctgttataataatgagtttctcttcttagatgctgatttcctaggagcttttcactgtaatatgccagattctttttttctgttataatttcatttccaaacagagaactccatagatccattttgccttcttttcttatgaacctcttttcctacagtctccctgaaaaatgccaaatgttttttgtgaaattcttagatacacctgatttgatttctttcttttttaaacttgagaattctctatccatttctttagcatctaggcaattggccaatgcctggaaagtagtactttcttttattatagcagttctcaaattctttcgtctcaggatccctttacactcttgaaaattattggcaactccaaagagcttctttttatgtgggttgtatctattgctatttactatattaaaggttaaaacaatataaaagaatatttattaaattatttcagaataatagcaaacctagtatatgttaacataaattacatatttttatgaaaatcgttattttacgggccgggcatggtggctcatgcctgtaattccagcattttgggaggcggaggtgggcggatcacgaggtcaggagttcgagactagtctgaccaacatggtgaaatcctgtctctactaaaaatataaaaattagctgggtgtggtggtgcatgcctataatcccaacgagtcaggaggctgaggcaggagaatcgcttgaactggggaggtggaggttgcagtgagccaagatcacgccactgcactccagcctgggcgacagagcgagactccgtctcaaaaaaaaaaagaaaaattgttattttacaaaacaaatttagtgagaatggtgttttttatattttgtatt

SEQ ID NO: 97652 - DNA, 1051 bp, Homo sapiens
agagatttttggcattgccatgaaacactcgatatgataaattttttgcatcttccagctgtggtacagggcagtattttcttgtcactgacctaagactgtttgacacccctcctcccctagtaaaaagaagtagtgggtgtctttgatgttgtgcacagctggaagaagatatctcctgagttgagatttagacttctttcctcaccatcttaaatcactgtctgactttagaaaggcatatgtatggtgttttaaacattctttgttgttcgttttcttctcttagcaaacttctcaatagaattttattcccactcttcctggcattgtttataaatgtcagtttttgaacgtggccagtaatagtttgatttaattttttaaaaaaagatagactattcaaaactgttgtgttccagaagttgttaagatattttgtgataaaattagtattcatgtaacttaaggactatttgtgtctaatagagttgctgatagaatgaattgggaaatgtatataaagaattgtgatcatggagaagggtattataaatcatattactatttcttatgtagtaattatgaaaataattaccttattagaaagtagtatatgatttttaacatattttatctatgacactttccgtacataatggctaagaatatttcttctgaagataattcaaatagttgtattcagcatagaaaattaagatttttgaaacagtcatctgaaaattcttagtagacagataataaaagtgatagaaaaattgtatcccatatttggagtatttccatgtgctttataaaactttgcccatcatatgtgcaatataattattgtaaacagatttactaatttttagaaattataaaaataatttaatgtatgtaaaagcattttgtttcttccttgtatatgtattttatttaaggcacacgaagtattatgcttagagatgctcactttgctcctggaaagaccaacagatgatagcgttgaagtagctattggttttcttaaggaatgtggcctcaaatt

SEQ ID NO: 97653 - DNA, 1172 bp, Homo sapiens
tacagttgaagtctgttcgtaggctgtaaagggtacaaggagaagtagacatctgtaagagaaggccatagtctttgctttcagtagatacgtgaattgtgggcttcctaattaggatgtataattgtatttgatgtagccgtttgattagtttaataagataggttgtgattgtatatgagcaacatcttattaatcaggccacttgttaagccatgcatcttgtgtctagagatagtggaataccaaaaggttggagttatgaaacagtggaatagtccaccttgggtacaggcagtaagggggtacataatttatagagaatttagaaacaaaataaaattaaccgcaaagtgagtctgttttttatcctcaccatgctagcaatactaaacaatatcagtgatacaatactcgttcccaccaagaactgctctcaccaaccttccttgtaccactccagaacagggattcttaacctacaagcccctcaagaggtccatgaatagaattcaagcaatcagtccatgaatgtgtttggggaaaaaattgaatctttatttttactcatctctaaagtttagcttttgtttttttcttttgagaatgtaggcaatagatcagagtattgacagtctgttacaggtatttcatgatacggattatggccatgctacttagaaatttaagtagttattaagcatactgccagttcttgtttaatgtgttatgaagcacatagaatattatatcaaacttttgttcttctcatgtttcaaaaactgaattttagtatgattagtatcctttgtaatcctattcattgtatatatcatcccaaaaagtctactgatttcaccagacttcccgagagagacatgtatggaagaaaaaaggttaagacttcctgcagctgaaatcagattccacagaaaagcagttacaaaacccatagaactgtagagcattgaaagatcttagacattgtccaattcaacctaaagaaactcaatgaggccaagtaatttccccaaaatctagggtaaaaagcagtacagctatctaacattcaactggtatagctgtaggactactacatcaacatagagattgtctttaaaatacactgaatggtaggtaattcagccccatgatttcatgtgactcccttt

SEQ ID NO: 97654 - DNA, 1390 bp, Homo sapiens
gagattaactctggtttcttctcctttatacaatttgtcatatacaccacaggctaatttgtcttcttaaaacactcttttcatgccactctcctactgagaaacttttaatgattccccatcacctccagtataaaaaccttaaagtctttacatatgttttaagattttagtctaactctaattcatctttccaacaaccatgacacataatcctttgtttcctgattgtcctactcattctgaccttaacacccctgctcagtctttcaataattattccctcttctactagttgcaaaatgtcatccttcgtctccccttcctcctgccgacttgcccccagtctaaatcctgtcaagccttcaggacctaatttgttgaattttctctgtgaaacactttgtcaccattctaaaccacttttcctagtctgaatttgtgggacccacttatggtctcactcatttgtgtgcagttaattgctaagagtgtgttttatattgtcttttctgctcttcaaaaaatttatattacagaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacaggcatgtttatatcaatcagtatacaaagccatgaaattgtcattgaaaaataagtcaactgtggtttaattaaccctggttcttgagaatttacgttagtctatagtgatagagacctcaaattagagacctctttactttatagctccattggagagccacacactacgtgcccttatattagcacattacttcttttttcttttttttgcatgaatgaattaaaaagtttgaggaaaagattgcttaccctttttatagtatgttcaaactattgttcctttcatagtttcatggatgcattcctattgataatgtctgttttttgtagaaaagagtaatactgacattttagttctaaaattgacttttcctgttgtaaaccaggagtcagcaaactttttctgtaaaagcccacactgtaaatattttacactgtgagtcattttgtctctgttgttgctacttaactccgctcttgaaatgtgaaaatagtcataggcattgtgtagaaaattataagcatggctgtgttccaataaagcattatttacaaaagcaggtggtcagctgcatttggctcatgggtgtagtttgccaacctc

SEQ ID NO: 97655 - DNA, 1097 bp, Homo sapiens
ggttctgcaaagccgtaagaatgatacaatgggttttagggactcagcggaaagggtcagggagagtaggggggtggttagggataaaagactacacattggggtacagtgttcattattcatgtgatgggtgcagcacagtctcagaaatcaccactaaagaacttatccatgtaaccaaacaccacctgttccacataaaactattgaaataaaaaataaaataaaaagaaataaaaaataaaaataaacagaaaaaaaaagaagtttttggtccataatgaaaacaggtgcctgccacagacaggcctatctgggatggtctgaagattttgttttatcttatagactgtttaggttacatgaattattcttaatgatttaaaaaatgttttgatacaatttctaaagtacttccaactttctaagccatgtatttcagtctgtgttattaacataaataatttttgaaatgttttccccttttcctcttttaaagccttcttctggtcatgacagaagggaaaaccttaattcatatcagaggaactcctctccagaagacaggtaaatagtttaatatgctctgaatgcaatgtaaatttttatagtaaggtttatgtaataatttagctcttagatttctaattttagggtggataacttctttttaatggttttataaccaatattacttgaatgggctgtaggaggaatcatccttaaatgactcttctaggagtttctagtaaataattccagatattatgtaatttttatgtgaaagggagtaatttttaatgtttcaaagactaatggaatgaaagtgtaaaatggaaaactgagttgaaattacagtattcagaagtgctgcttttgctactgttagtattatctcttacatgtacatagctctgtattgtctttaaaatatttttatatagattataacaggggtccccaacccccagagccatggaccaggccacacagcaggtgagcagcaggcctgccagcattcccgcctgagctccacctcctggcagatcacctgtggcattccattctcataggagcacaaaccctcttgtgaactg

SEQ ID NO: 97656 - DNA, 1135 bp, Homo sapiens
gagactatgagttactacatgatgtcaccatatttgttttgcttcatgaacaatttcgaaaaattttaaaaggtaattctgactgtatagtattttcaactactgcactgacttacaatctaaactctgtgataaaagaaatagggaaattcaggttcttaatatttgattcatacctgaaagtgattcttaacttggtgaaatcctattcatctaccaaagccaaattcaagtccccgttttcccactttcatccgttagcactgtatgccacagtgattgtttcctactcaagatctcctgttagcacttactatgtgtgccagtcatttgttacttgatcatatttatgaaatccttcttcacaacttcaatatttttggtctcttcctcttgctcacaacagatgttgcggagatgtgttaaaaatcattagtacagaattggggccttctccttaatgtaatcaaaataactttctttgccttgtaaaagaaaaaggagataatgcagttttattgtcctctgtcttctcctctctcctctccctgccccctccttcttctttctctctctctctctctctctctctctctctctgtctgtctcactcactcactctcattctggggaacatataatctaatgtgtttaatcatagaaatctttataagcctgtctgtcttctacaagatcataagctccttggcctttcttatctattgtatctttcagaatgtctacacaggaaggactatgtcttataataagtgatcagtataaatattgtattttatgttaccattgaattgaatgaatcttgtgctttgtatttgacctaagatctttatgtgaagttttatagaaacctatgtcatatatattgaacatttctatttcactgtgttgatgagtgaaataatttttaaaactttcttatattagatacagaattttaaaatggttgaatttaatgcaaagtaacagctaaactatggttactttaagttatcaattttgattacatgcttattcacctatataaattagttagtggatactattcaaaaaattcagtaatgagactattttgcattgtacttgtgattatgttagactcaaactgctgttaatt

SEQ ID NO: 97657 - DNA, 1050 bp, Homo sapiens
tttctatgtggattaaatttatttcttaatgatcattattgcaaggatattgggtatttcattcttagtctgtgtagaaacattggatttttatactcagtttatatagagtttctcttctatcgtttcctcaggttttttttaataatatcacactactattttatgatgtaggtatgtatctccctcactatgagaacatttttaataaagttataggacatccctttttaaattaacttttgttccgcttggtccttagaataaaaccttctatttgctctcttgttcatggattttttttctacttgtatgtgttaggtatacattattatgtgtaactacttaaggatttttacaatttttattatatttgtttatggattaagaaaaataaagcggtcaaatgtccattgtatagaaaaaatatatcatcatttttcacactttgttagtgttaataaagctttctttggtatattttataggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaagtaagtgtttgaaacttaaaatggaggatgtaaacttatagtcaattacctattctttaaatataaatgcatttatgtaattaggacatcagagccagacagtagaatggcacttaggttggtgcaaaagtaattgcagtttttgcaattttaaaaaccacaattactgtttgcaccaacctaatacatccatctaacttaaacaattttaaatgtagatacttagctatatggaagtattagtgtgcaagagggcagttgagaacatacagaagtgtgtgtacgtgtgtgtgcgcgtgtgtgtgtgtgtatacacatggatgcatgcgtcaggggcctgcatatatcatgtgaatgatcacatgtaaaagaaaaacaagtaacaaacagtgcagggaaatttctgcatatctgtttacaac

SEQ ID NO: 97658 - DNA, 1116 bp, Homo sapiens
tttaaatgaatcattaaaaagttcaacatgtagaatttttctttaaaaccaacttaaatagaaatcaatactgtactgtaaatcaagagacagcttattgaaatgttgaaactaacaaaaatagacaaatttctattctcatagatcctgcattctgttgaaaagaagcacattggggaatcttcctatgcgtaaaaaaattaatagtatttccaaatgattggatcacttaactctttatttggttacttaaacagcctaaaatagactagcttcatgatacaggaaatgaatgggggtaatactacctcccaatttataatgtgaggttttcagtatagataatggtgtcactgggttcattaaaatgtcttttttttttttcactcctctgtgtcttactgtcttaaagtgtctgaaaatttgggctgtctactctccacacagagttgcagaccagtcaaatgcttttatattacttacttcttacagaaaacaatgtccagaactgtctgcacaacttctagccctgtacttgaacctggcaatctagtcattcaaatggttatgagtcagcacacctggcatatgcaatgactatgaagcaaaagggaggacagctctgcaactctttatttgtaatttttggagccagaagtgttttgatttcagtatcttgtagattttagaaaactgcagtgcctatactacatattaagtaatccccccttttggggtctggagtaacatcctctagtcaaaacacattaatatttctgcactgtatcaagtcacattaagtatcaagtcagtatatgctaagttttgctctcaagtgagttgccacatgcttaagaataatctttgtattttcagagctttacagattttagaactgcagataaaggattttcaacctgtacctggtgacttttctagaaagagacaggagtattttgacccttttattttcttgaaattgtgattctatgctgacatcaaattataattttttggccttatgaggtatatcatgaggcaattttttcactaatatgtaaattaagacaggaaaaaatagcaagaaacggtttttctaaaacaagtaagttttcc

SEQ ID NO: 97659 - DNA, 1022 bp, Homo sapiens
ttttcccctttcgatatggataattcctacttgttctttaagactcagcttcaagacctacttctttctgtatgtcccaaaccctcttttccagtaacacttgtttatgacattgttgtagcacttagacatttcttctttacccaaggacagagtcctcaatgccttgtctgttgtgtaatgtatatatctccccaccgtacatagacactgcctttagtaaagaccatgactgtactttttctcttagcttcatacttcctcattttctctgtaagcatttttcttttttcatcttcttttactattgttttgagatgggatctcactatgttgcccaggctgggactctaggcacatgccactgcacccagcttttctcagccactgaatataaatatcaattatggccctagcctaaatggaaccttcccccagcctcctatatacagtgacagaatgagggggaaacatgggcagatttggtagaatcagtaggatttggtgacttacagggagtaaggaaaaggaaattgccacctgggaagctttgtaagtcatatcttagaagaagagctggtttaagatggggagaaggaaataattagttccactgtggatttctttagttcagatggcctttggcacatccacttagaggtttcctgtagcaaattggacatcatgatttggaactctagagaagattggctggagtaaaaagttgttttcgcatgttaattaaagctatggggatggagatgatcttccacagataatatggagaaagaaaagataaggactattcattcatccatttaacaaatatgtattgagagcctctagtgttgggaatgtagcaatgaacaaaacataaattcatgagcaaatactaaactctcaggcatagtaaatattaaagggatggacaaatgaaggtggtgtccctgtaagttgacaagtgagaacttcaagaaggggattaggtgccaaatgctagagcaatgtcccataaaagaagg

SEQ ID NO: 97660 - DNA, 1034 bp, Homo sapiens
ttttccctccccccccttcccccccccacagctgcctccatttccttaaggaagggtttttttctctctccctcccccacaccgtagcggcgcgcgagcgggccgggcgggcggccgaggtaaggcggcggggccggggggccgcgtggggggcggccggggcggcggcggcggtgggggagggggcgggggcgggcagctttgttcgcgccgggcgcccgcgtcgccggtgtccgcgagccgcggcggggccggctgggctgctcgcatcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaaggtgcagtttgaattctgcttttcccagggtggcagctcggtcttggccggatgaatcttcgctgctggccgtggaaacagctagagcagctcgttagttgatttttaaatttccaagtgttgtgtttaaaggctttacgtgcactgaggaggaatcgccaccttaaataagcatatgggcgattaacagggtgtgttttcctctcggaaagggaatttggtagctttgaccaatgtcagtgtgtaaatatttagacgttattagtgacttttaaacatttttcagcgagatctgttatttacagtgtgtcatatgttattaatgcttgttgcctaagttccttggcaaatctgtttcatgccttctgagaaagtagacaattgatagattgtccaagagacggaaaaaaatgtgagtgggttttctaacttgagttcggcaaatcccttaacgctggcgttgtgtgacacatcacctcccttgtacgtacccctgttgtacga

SEQ ID NO: 97661 - DNA, 2457 bp, Homo sapiens
gagggcagtgtaattccctggttattctgtagactatatcaaatcctttttgtctcttctcatttcactaacagaattcagaaggagctagctgaaataacccttgatcctcctcctaattgcaggtaagaaatgaattttgttgttttggtttcaaattgtggaaaaataccaagagattgatgtattgtctggatatgtgtgcagcagaggagacaacatttgcttctttacagctttgcaagtgcattaaacaaaaattgtagaaggtgaactagataaaattgggagaaaaaatactttttagcataagtatacattgtggatttatgaatatactgattttgtgcttctgatattcatatgaatggtgctgatttttgttctgatgtatttctgtagagggtgttttttcagaagtatactgaagaaacttctaaaattttgctaagctttaaagttactgcttgtgtgtgcaatctgaactgaccttccacatttagaaattgctgaatgtggtgttacaaaatgtaaatgcagtaaataagcatatagttggttctgtttgatttattcagttactagccttaaggacaaattttatgggctaagctaatggttttagtggtcgttttctacagaatgcattgttggaattatttacgttttaagcaaatgtcctaattgcttgggaacatttttagtaattttggtggttggaatatgtgtatgaaaagcagtaaatgaattggaattgtgggaattcattttagtggaactcaggtagatgaatttaagattattggttggtataagatacattaaaagtagctggttgattattttttctctaataatttttttcatttcatttgtatagcgctctattctttttttaatgactatggcttacaaaattgaacacgcatagaaaacaatattgtagatagtttgtgaagagatatgtgctcaataatgcgagtggctgcaaggaattaggcagttttatggtttgataggacaatgttttcatgtttaacctgtatttttgctacaagttgtattcacttgggatgatcagaccctgtctctgaagtctgcttgtgatataatagggtataatccagttgcttcttattgtgtatgttaactggatcctcagataaggtgatttgatcctgatttatccgatgaatgaacagtttgcttgtatttgtaatttcagttcaaacaggaaacatgaatgtaaactaattttaaggagatggtggtatgtgagatctcaaagtattacttaagagctatgctgtccggtaatgtagccacttgccacatgtggctattggcctcttcagttgtggctagtccaaaatgagatgtgctataagggtaaaatttatacacattggattttaaaaacttagtacaacaaaaggatgtataatactgcattgacttaaaaaaagttcattaatattaaaataatattttggatatatttggctatataaaatgttaaaattaatttcacttttttactatgttaatatgttattagaatatttaaaattacgtatgtgacttgcattgtatttctattgaacagtgccgctttagagaacaagtaaatgaaagtattttccctccagccttctaaatggtgtgtcaaatctgtagccatttagggaggtcaagttaaatttgctccctggaagaatcacttaacttgcagagtgtattctgatatttcccattatgaaaaatgtaaagatctatcaattcagaactcttaaatgttttaaaattgcatgtagggtcaaacatttttaaaggtttctgttgattgtctgcaaatgaaacaaactaatgtacgtgcataaatctagagagcctagtagacatgtattaagtgccctcagagcaatagcctagtgttgcagttgccaaagaaatctactttacatgtttaactccggaatgtttcctcaaggtcactgaggattattttagagggagtagaatctttcaatgagataggaggtttcacttgtctttctctttatataccagatttcatttaagtccttgaaataatgcttcctcatttagtgatcagactagtgaaacatcaaaactttgggctttctgtgaacagtaacatggaacacctcatccctgctttcccttgtcacaacctgtgatgactatcaactgctgcaaatgacatctttcagttctcaggttcttttaatagatgagtttatgtgtggctgtggtatgtgaaaaacagacatacagtatgtcttagtagggaaccaggataagtggtttcttattatttggaggcagtgttttaccatatgcctcacatgtaaaatatccagatactttgtcttcaaattcttgtgggtggaagaagacctagtttttgtccttgagtaggaattggaatactga

SEQ ID NO: 97662 - DNA, 1328 bp, Homo sapiens
tacatgacagatttaattcttcctcagggaagaaatgtaaagtatatctgtgtacattcaggaaaaagttgaatgaaacacaagaaaactcagcaaaaccaaaattattcagactgggatgatttctctaaaatcccttcctgtgttttaattaatgaaatattctttaattagtatatagttatgtctagtacatacatacccagggtgatcttaagatagatttaattgaattgtgtatggctttatacatgttttaatatattttgatagcattgatatttcttttcccgatagtgtaaaagtttgataatgacgttatttccagtgatttgatgttattttaaatggttttaggtattggagggccatgggccatagtgtactaaacatagggatatgtttatttattggtttcagtttatgctgtttacataaagtataaataatttatacatcaatgagagtcaagggaaattgtgttatgggcatttccctatttgtatttattgagaattgttgactagaattgtttagtgatgtgttattaagacatttactttccatctgtttcccagagggtgtccttgtcctctcctagtcaccacttgtgcaaacagcgaaagtttagaaaggtactggatttctaacttaacccctaatttctttccatataggaagaagcacaaatatactgacgaatattttaagagtgtatgttcagattgaatctatactggagatatttgggggtatttgtattaataaatagtttcttgatgtgggaaaggccatattgggggatatgtattacagtttcaagttaatagtattaatatattgactagcaaaacctgagatcaggtgatttcgttgactttcttctttaaaaataaaaaaataatgaaatcataaaagaagcagttgtttctaaaccagtagttgataatctctagattcctcattagcctaattgtctgaggataaattctgctttcttctgagggttgctaccactttccatcattttctagggcggactagaactttgctacttaaaagagtgagctgctgactgtcagcatctgcgtcacagatgaggttgttagaaatgcagactcttgcttcccccaacccccaacccagaatttgaatttaacaagattcctggtgaattgtatatataagtaggtttgaaaagtgctggtactggagcaagactgtctggtttcagatccatgctctgtcactaacttgctatgttattaccttagatacattttggaatatttcggttcttctcctcagttgtaaagtggggattaaaa

SEQ ID NO: 97663 - DNA, 1581 bp, Homo sapiens
acatggtgctttgcatgtgaaggtctgttaataaataaattgaagtctctcaaattgacatagaaatagcaattccaggcaaaacaatgacttcagagaaaatttattaaatatcctatacattctttacctttttcataattatgatacttaatatttaataacctattcaaagtttacctagctactgtttttgcttataagaggaaattgatactcacagtaggcctagttatttcctccatacgtgccagtgtagcagaaatactcagtactctgtgtgactggaaacattttccaaaagagtgaccaactgaaaataatattcttcccactaaacttcacatttttattaaggatctattaagttcaatgcagataatgtaattagaaggtgggtaaaacagcatgtgcttttaaaaaaagttatatgtttacttcgcagctacatgctcacataaccagtcatattcctctcataaccaattagtactttatgctctccttaaatgagttgctgtaacaacagatggatatgtttacttttcaggaaaatcagcaagtcttgcatagagtgtaaggacattcagattgagaatgaagaacttgtcctttcagtctcttcttccctatcaatatgagataaaaacataataaaatcacttgtaaatctagagaaatagaaagtgatttttttttccacataccaattttgacaggtaagtatatttgggcattttaattggaatctggaagctgaaacatcttcaaacttttaacctttcttttgccttttgatcagtggttctcaactgaggcaatttttgtcctccccttccccagccaccaggctaggcgacaattggtaatgcccagagatattttttgcttttcataactgaaggagaagggggctaccactgacattagtaggtagacgtcagtggtactgctgaataccctgtaatacataggacagacccccacaataaagaattatctgggccaaaatgtctagtgctgaagttgagagaccctcctatagatatttgttcctgtactttgcctcttgaatttttgaatagtttgcttttgactgttttcctgtcttattagtgatgcatccttaatatattcacctacaccttcctcagctgattcttcacttcctgctacttctatgcgtagtttacatatgtcttatattatttgtcatacgtgtgtgttattttttatgtgaaaccacaggaatgactaccttgagtacttgctaaattatggtcttctgaggccagaaatgcttacagcagtattttatttcttttaggtcttgtgccagttaattatatccctgcgtgatctagctttaggctggttatatctattatgttctactaggagtactaaagtaacatcatggagaaataacattggacagtcatcaaaattcagtttgacattgaattacacacaggttagaaatgtgtgctcttcatttgggttttattttcatcattatgacaatacacaagttacttcaatttttacaagttcacaatcctttatttgaaacccttgggg

SEQ ID NO: 97664 - DNA, 1002 bp, Homo sapiens
aaactcataaactttcttaaaacatgagattttttttgcgattttgtttgtttgtttttttagctcatcagctattgttagtgttagtgtattttatgtgtggcccaagagagttctgctgctgctgctgtggcccagggaaaccaaaagattggacactcctggactagagcatatacagtatggataaactggacaaaagtatgattcaagcccaagtggatggagcagggcaatgtgagatttcatcgtgctacttagaatgaggtacgatttaaaacttaagaattatttctggaatttttccatttaatatttttggactgtggttgacctagagtagctggaactgtggaaagtggaactgcacagataggtagggactgctctgctacttctgttacgtgaccatgactgaaattacttactactcatgatgaaagggtattttcatttgctttgctttcttttttacctgtttcctaatagctgattttggtttctcagttgttgtttttggtttgttgggttttttgtcttgtaacttgtatgcttaagagttcttttctcttaaggtgaaactatcagtgtctactcgtttttaagttgttctttgtttactgggttgtttttccactttgctttcaaatactcttttaatcattccattcattctagatacacagtattacacagaaaggaagataatctttaattcttaaacacaagtattaagtaatacttaatactttggatgtattttgccttgcattatttaagtgcaattagactataaaaggagatgttaaatttttctggttgtgttgtgattacaaacaaacctagaaggctcagtggctcaatgtataaagatttatttctcactcatgtgaagaccactgtgggtccagggactatcttgggcagctcttctctgtgttgacttatatctgtgtatcttgtagctctgacatttggaacatatgcctcaagcaatcctcc

SEQ ID NO: 97665 - DNA, 1095 bp, Homo sapiens
tgccttttttggaagcttttggactagttatgccattccaaagtttttttgctgctttagtgttccagagcaaatatactctgtcattctgtttaacttccagcttgtctggggaaaaataaagacatctctagtccaaaattgcttttgggagtatagttccacatcttttggtctgaatgaaaggcctagggaaacatgaattttgttacctttttattttattttccttcacttataaatcatcatcatgatccccctttacatccatgcgtctcactttttataaacactgtttattccctttctgaggatggttatttgtagttagttttgccatttacagtcttataggtcctttacaaatggatcattttctcacattaaattctagtaggtcaagaatccatttattcagggtcccgaagagaatcgatctcagaagattgtggctacatattttttatggcttcctattgctttctgtagtcttcttaatttaaacagtagcaacagcaaaatatagagggtaccataaggcattggctttatgatttattcttgcctcatacttgtttcttagggtattggtgttatttgttagatttgtgatatatatgcttgtactaaatttacctggtatcacaatgagaagaaacctggcatttgaaggctttgaacgcaaactcagagacatgtaatttatatggaattcaatggcagttttaactagtgtgcctttaatttttcttcattttatgtttacaccagtgtccttgtaaaattttaaaagacatttttctcatcttcccaggtgcttactatccacatttccattagaagatgccaaatactcattttcttcttttgaaaaccctaaaataagcacgttgcaattatcacttttcccttctgccgaggtttcttaattttggagaacttgaaacatatgcaaaagtaaacaggctggtatgatgaacccccatatatataacctttatccagtttcagtagttacctaatcatggctaatctggcttcatctatgcctccgtccatttcaccctcccattattacattaaaaaaatctcaga

SEQ ID NO: 97666 - DNA, 1903 bp, Homo sapiens
ggaggcggaggttgcagtgagccgagattgtgccaccgcaccccagtctggcgaagagcgagactccatctcaaaaaaaaaaaagaattgcgttaagtaacttttgatttgggactaaatatgtttaatacaaggaatacttgtcagtttatgtatatgtcctttgcacatgcttacagcatgtttctttttaagaaggctaaggcatcatagcctcctatattgtgaaaaaagtaatatatatatacgtagtaggtgacaactaaggcctttattgtttcttggccttttgccaaatgtaattttgaatgctagtgtttgtatgataaatcttcagacagacaatgtcttacgaagaaaatattttggaaggattttaagtaaaacccaaaacttttatttgcatatacttgcatactgtcagcctataagacaaactcagcactgtgtgtaagttacttttaaaaattgactttgaatgcctgtatcagaacttatttggttgcagcggcatacaactcaaaccaaaccagcttaagtaaaacataaatttgttggctcacataactgataaagtcagagtagatttggcatttggcatgctgtcagcatctgatttacctttccatttgcttgctttccttcctcttagttgactccatgattagacagactttctccttgtgatcataagataactgatagtacctcccagctgtgttcttcagattgagatgcagtgtgaaatagcgtgaatcttggccccagttttttcatcagaagtctaatgcatttcattaactccagctgagtatattatatccatatggttcatgcctaggccactgctctatccccaggataggaatggcattaattccattggaagcatgtagactgtgagaaggggtgcaaaggtgaactgggttaccacaagttaagtaaatgaagctgatgctgagtagcaaaattagtatgtatctttttggactgataggcattatctatttctccatagtccttacctcttcctattatgatggttcacttaactaatttatattacctgtgtggcaccttactgacatttgggtttgattcttctggtttataatttcctgttatctattgaataatttgttacggttatatagttatatattttttctatttaacagacctacatttttagctttaatcttttgtatatgtatttaatatttttgtgaatctgaagttacctttgtttgagttgtgaaatggcaaggatgtttataaagggtcaggttaattagtttttcaaatggctttaccaaacacaggtttatgtgttggttaaagctcagctggtagtcttgaactgcttctggcaatttcttagaagaggctgtagcccagattttggctcatgtgtataattatagctaagccaagagctgctgatgtaaacaccagtttatgggctaaggactgggaggctgtcatagttggaaccaaggaggtccaagcctagtccttctgaagaacagaattgggaggcatttccagagtctcttactctgacagcaaggcagaactggagagggtaaggaggcagaagtctgtagggtcagaattcgtatcaccaggataaaataaacagtgagagctagaattgagcacaaatagtacagaaaaaattccccagtcaagattcccttgagctggcattaggtttaaggccatagagtttgcttaaatagacatactttcacttgttttaaagtaaaggcacacctccctgttcaatgtatatgcattctgttcatattgtttgtgatttcagatttttgttgccttccaccttttgccgttccagattccatgaaggatactacttctggatctaggatggccagataaa

SEQ ID NO: 97667 - DNA, 1122 bp, Homo sapiens
cctaaaaatttatatacttaaattggggaggaaaatatgtttgcgttcttcttagtggataaatggaagattgcgttatagtcatatattcatagagctttctgatatacccagttaagcaattttgatacatccttcttcgtccttccacgggacattgacctgtctctagttctgcacatgttacactgtattgcatttagccttttcataacaataaattcaattagatgtcatttatttcttttatccctactacagtgcctggcttatgatgtacataaaataaatattagtggataggaaaatttttttataaagaatcaattttttgccacagtgcattttttcatggttgacatttattcaagaagcatttattgagcaactcttatgtggaaagcattatactggctgctttgagatatataaaagaactataacatctaaacatttaatgttagaatgaaatgtaatttctatttagtataaggtatactacaaattataggatgaaggtgggtaatcactagaggtttcagatggatcataggtaaaaaatactggaaaaacagtttagtctgatgacaaaggaaatcactttttagtagctatggtattcaaaataatcatagtttaaaatgtcatttaacagtttctggaatttttataaaatcattctccttgctgtcatattgttagatccagagagttagactgtgcagtaaatgagctatttttttaccttagaaaagcagaagacttgaattttcataagtagactcttagaggttccttctgatgcttcagcacatttccttttctccaaagaaatgcttcagggccgagtgcagtggctgacgcctgtaatcccagcactttgggagacccaggcgggcgaatcacgaggtcaggagatcaaaaccatcctggccagcatgatgaaacccagtctctaccaaaaataaaaaaattagacgggtgtggcagcacgtgcctgtagtcccagctacttgggtggctgaggcaggagaattgcttgaacccgggaggcagaggctgcagtgagccgagatcatgccactaacgacagagcaagactccgtctcaaaaaaaaaaaaa

SEQ ID NO: 97668 - DNA, 1046 bp, Homo sapiens
ttcctgctccttccatgctgctgtatgcttttaggcaactactttaataatagaaggcttcttgttctcccttccttttttaattaattagttatataaagtgtagtagtaatggatattaaaatgatagccaatgagaattgaactagattatgattatataacctcagataaaatcatttgtgtataattcataactttaaaaaatgcctgccacatgtgaacttcagaaacttgggtagctgacttgataaagtgatgtttagacctgaaatttcacacattttgtttcgttatgtgaccttttttttttttttaagttgacttacttctaaatatttgataagtcactaaagactgttactgttgttaccttatgctcggcagagatacatatgcaatagatagtgacagatggatattcattgtggtatcctttattagagtattggaaacaacctcaatgcccattaatagatgtaacgtttaaaaagaatgtgacaactctatatgaactaatagggaaatatcttcaagatatattaagtataaaaggcactggaaaaaaatacatatacacaacataatattctaaatgcttgtcagtgcatgtaagaactctgggaagtaatgttgtaaatgggtaacaattgtttgccagggaaagaaacttctgagcagttggagtcaggaaggaagatagtttttttttactggctatggtttggtacaattcaaatattgtaccatatgtacatatttttttgtttttaaacatcaaaataaaaatttatatcaggttcactctctagttcagaattctacttaaaacaaaatggcaagtaagttttcaagtgtaaatattgatagtgattagagtcatatcaggcacagaatgaaggaagcattttatttgaaatagcatggtattgtaagactggggttttattttaaaattaaccatttttgaactattcataagcagaaatataaccacctagtatacttccattttgaatgaaaggccaaaattacaaaatagtttt

SEQ ID NO: 97669 - DNA, 1174 bp, Homo sapiens
gcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaatattttaagtcagtcttgttagaaagtgtgtctgagatgattgttgatgaagtaaaaatgtggctatgaagattactaaagactagcacaaataaacccattcttaaattgaaaacatttaaaatcctattaaatgcatagagtttttttcctttgttattgaaagaatgaccttaaataatcaaaagtggattttgacccattggtctcaaacacataaagttgtacttcggtaatatgatgtttaagccaaaaagaatatgaaatcctggctcgctcactcaggaatctggtaatgtcttatggaacatgttgcttccaaattgatgatttttgttcagcactgggcaatattgtcagatggtaactgtgatgtggtagctagtctgtgatgcactttttacttctaatcctggtcttgaatgttcatgttgtgtattaccattcttactatggcaagtggccagcaaatacagccagaggcagagatgaacacagaaatctttgtctgccttgaaggtagactagaactgtgttagtgtacagatgtgatattatttctcaattggtaaaataccaaattgtaaggtttttagaaggttaaatttcttctttctagttgtaattctgaagtgttagatttcttgaaagttagaatttctttgcaatatttag

SEQ ID NO: 97670 - DNA, 1055 bp, Homo sapiens
aggtcactaaaagcaacttttttccccaaatcctccaatctctaatccctaaagtttatctcaagtccagctcctttgatggaaacctttctgttacactgctctcacatacctgttggtctgtttctctgagatgccgtcttcacaaacaccagaaataataaaagggaatcaagtatatgcatatttccaagtgccaacaacaagccaggtgccttcctcaacaatgtgtgccctaaagccaggaattctttttcctttttcttttttctctttggaaggaggtagggggagatgaaaggtggttatgctatataactccttagctgatcttcactttgagtttatctgctctacaaattttatgtgtttgctaattacaaggttctttctggcactgtgatacatacagagatgaatacattttcacatccttaaacagtttatcatttccctgtccagatagacttttccctttgctaatgtatatccatttttattgaatgacaaactgaacagatgttcctgatgatttagcaatgaaaatattagtataatatttagtaagttttactctctatatattaaatatgcttaatactatttgatgcttttaaaataattatcttaaactacacttagtaccctatgtttctagcatgcgttttggcattttattcagttttattccatatccatatttctggataatgagcttttggaggataatatctatgctttgtgtctccttatttcagtatctagcccaatatgtaacatgatgtatgtttgctgagtgaatgataattatatcatgggtgtaagtcttctccataaggttatccagagaccatgtgaagcatatctgtcatgtctcctttaattccccatgttgattcagtgctttgtatgtggttggtgccatatatatttaaattgttaaatttgaaactgttaaattgaaatatgggaaatagcaatgggttgttcatataacctacttaatgacaatgtgtttaaaatagagactgacttaatcttgtaattttaaactt

SEQ ID NO: 97671 - DNA, 1033 bp, Homo sapiens
gaacatttccttaattcaccaactcttcttcaaggttttctgttcataggactacaactctttgatgccctgacgtttttataattttactactagcagttgaatgtattgatgcatgtaaccttgttgctagccatgttaagtttcaatcaagcatcagaaaatggtttgcttaagatacttggctaggcacaccagtattttaaatgtgaattgatatacttggtgcttcaagacagatggtgcattgcttctgtgcctaagagcatttggcagtgctgaaattgagccttctgttcgttcaaaataattcactgatgagtgggcaactttatacttttttgagggtttttttttttttttttgctgaattcgagtattggaagtgttttagcttacatgttagctatatgtaagtaccttcaaaaaatgacactacaggcataggcaagtacataatcgggataagtactgtatatcagtttgacatatggtgccacatgtttttatttttattatagtgatatgtttctagtaagatttacaagatatttgacccttcaacaacacgggtttgaactgcacaggtccacttaataatgcagattttttttcaaaatgtatcagaaaacttttggaaatttgtaacaatttgaaaaaacttgcaaaccatgtaccctagaaatattttttaaaatagttatgtcatgaatgcataaaatatatgtagatattagtctatttatgtgttaacctacttcgttatcagactcctggtccactgtaggctactacttttggggagtcaaaagccatgtgtgggattttccactgtgtggcatcacccccctgtgttgctcttcaagggtcacctgtttggccactttggccacatttaaacatgggcccaaacttttcagatttaaagttaacagactgatgttagttaagctcagagggaaggcttttcaatgaagtgagtttaagagatcagagaattttaaatctcatgttggtcacctttcctgtttca

SEQ ID NO: 97672 - DNA, 1739 bp, Homo sapiens
tttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatgtctaatagaaatatttaatttcagattaaataatggaagtatggctcttataattgcccgaaacacttctcggccagaatttataaaacacctgaaaagatatgccagtgtaaaaaatcaggtatagtaaattctttttgttacttatttgcaaagctattaatcatgtagaaaaagatgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaacttt

SEQ ID NO: 97673 - DNA, 1037 bp, Homo sapiens
taagatcaatacaattgagcagctgttagcatgtattggtttccttatattttaagtatgttttcatgttttgaaggtgtaaagggatgacagtatgttttgttgtggttttcatcatacagataaaaacttattacagttgaaatcttggtgaacataatacattttaaaatttccattcctcacccatttatctagatatttagacacagtaaaataaataacatggatacatttttgtcatgtgatttatgttttttaaaaagtagaaataaatttctctaaaagttatttttattttttaaatttagcatttttcatatttgaggaaaaaacaatatgtcttggtaccctagcttctgaactaataacacacctgtcattttacaggttattttaatgtttttcattgggatcaaacctactctggaaatatctcatgggtgagctttatttttatgaaatgttcttggcacttgaagacctttgtaggtacatgccagactcatcttacatccagttcttctgcatggaaaatatgtgcattgaaattctaagtgccttttcaaatttgaccttcttagagaataatatgagtcccaacaattaggaaaactatggaatgccttttggcctttacttttcaaagattttcagtcagtaatgtttaattagcattcattgtgtacattgtccttttttgtgtgatatggctagttccaaaggaatattctagaagatctcagccttctgctattgaaggtgataatacactactaagttatgtgttgctttacattaaaataatgttgcagcagttacttattgcttaactagcgggtataggacatcaggttgaaataactgattttgaagtgaagagttcttgtttatatcttaaactaaccaagtatgttcattaactttgagaataacaatgatctttttcattattcttgagtagactggataaatcagaaaacccatgttagaggtccctgtaaaaacttcagtcttatttggtaagtccctttata

SEQ ID NO: 97674 - DNA, 1032 bp, Homo sapiens
cttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaa

SEQ ID NO: 97675 - DNA, 1121 bp, Homo sapiens
ttgaaaggaatcagtaattacaaggagaccgaagataaatgtttccctgacagtgaaggcagattttagtgttttagaaactggcatgacttcacagtgtttgaattgaacattaatgggattttggaagaaatagctgactgggaatgttgacacttgctattcaaaagactctaggctggcagccacaggaacttcattaaggcaaatgtatagacttaaaagagtaaagtggttgtgacaaaaaggatgacaatatcccagaggaagtaaccacagtaaagaaaaacaggcgggccgtaggaggaagatggcggtggggtcgcgcgttacccgggaggagattaagacggagccagagaacccgatcaaccgtgagaaaacatgcctgctgctgctgcgcatcttcaccaccaataatggccaccaccaccgaacggacgagttttcccggggaaacgtacagtccagagagttgcagatctacgcttggatggatgcaaccttgaaagaactgacaagcttggtaaaagaagtctacccagaagctagaaagaagggcactctcttcaattttgcagtcgtttttacagatgttaaaagacctggctatcgagttaaggaagttggtagcaccaagtctggcagaaaggggactgatgattccatgaccctgccgtcgcagaagttccaggtagattacttggacatagcaattacccctccgcatcgggcaccacctccttcagggcacatgagaccacattaaattctatttactatttcttgtgtttattttttggtcagttatgtaaaataaacttactctttttcctccccagattattgtcattaagcctttgaattctaagcaaattataatccatcatctatttaggaattagatttggatgtgctattgtataattactaatacaaagtccatatgtttccagcctttttgtaaaatatgaagaaatgctcttagcattctatgtaaaactgtactgttaaatatatgtgtgtaataaaaaaagcaacagaaaaacagacaaaaacccttcaaattaaaggaaatctcagagatattttacagcattgaaagggcaaaaagtaaaatg

SEQ ID NO: 97676 - DNA, 1052 bp, Homo sapiens
acaccaactgcaaatatacattgcgaagctctacataaagagtattgtctgggccaggcatggtggctcacacctgtaatcccagcactttgggaggctgaggcggggcagatcacctgaggtcaggagtttgagaccagcctgaccaacatggagaaaccctgtctctactaaaaatacaaaattagccatgcatggtggcgaatgcctgtaattccaccaacttgggaggctaaggcaggagaatagcttgaacccaggaggcagaggttgcggtgagctgagattgtgccattgcactccagcctgggcaaaaagagtgaaacgctgtctcaaaaaaaaaaaaaaaaaagagtattgtctgaatcaatgatgtttgcaaggtggaaaaagaaagaaatgtatattaaatgtggataattccatccagcatgacatagtggaagcaacgtggtctttggtgttagactgaagtttgaaatgtttccctctttttctagctgtatggtataaggcaagacagctaatatcccaaggccatgacttttctcatctttgaaatagcaatcatgataactaccttcccaaattgatgtgaatctcacaagaaataatgtaggtgctcagtatagctattagaatgattatattgcagaaagcaaaaaataaatcaatttcatatgggggaataattctcatattagcaaatggcatctatcatcatgcttatgcagctgtattttaaaattggcataagttcaggcaaagatagaaaacgtatactttggttaaatcaggcagttttatatgggaaagcatgaatcataagggaaacattgttcttggtttaattagatatttaaaattgcaaaacaagatttactattgggtaggctaagccattttggttgtagttatggtattgtttctttaataatatttatatgctcaaaaattgtattttgtgcatcaaaatcttaattatttagaatctgattagagagtggtagagttgcagttatttcttcaaattctcatcttttgttaagaca

SEQ ID NO: 97677 - DNA, 1038 bp, Homo sapiens
cttacatttactgaaattgccacacctaaaattttaccacctgttcaagacagaattctaaagttcaaagtacaacaagcatgtgcaggcagtggcaaggcatataaaaaaacatttacagtgtcaggaaaatccagctcctgacttaatatgagatggataagaagaatatttgctccaggatctggttttccatgaaactcttggtatgtagtctgattgaacatcttcaaaaatataagtttaaaacagcctataggttggcttctgagaactttatgttgctggaaaagtggtttctttacgttaaagtaaaagcttatacctgcttcttgaagttatataatcagaataatgtctgagtacattcaagtctgaaagattttactgtataagatattttgctgggtgaatttaactaaaacagtgattttatatgagggtggagaggaacagaacaccaggatgagttttcaaatgtgtctttcaggtgtgcttgtgagaaatggaggaagttttgaagatgatttgtcattgggagctgaaggtatgtttgtttggaagaactgtatttttgtgtagttttcaaatttaaaaaaaatgagaaagctgaatggtttcaggtttatgatcctcaagctaaatttaaaggtcttgaaaatggctcaggcatattttacattacctttctttgttaataatctagtcatagtctgtaggatacatgtagggatgactctgaaaaactatgtgaagtgtccatctgtctttcttggactaaatgcttaaaggaacagtttgtaacaaaccgtggtaatataactgagggaagaattgtcctgaaaaaggaaggacacttaaatatttatacatgggaaaacaaaattgaagcttatttttagcgcaaaatagacttatgtcatacttacagctgcagcttgtctttctctttgcatttaagtgtctcctgtcttttccccattttcctgatttttagaaaattaaaggggaaagacaaaatagcagagctaatagaat

SEQ ID NO: 97678 - DNA, 1010 bp, Homo sapiens
ctggttccctatacgtttttttattttaagcactcaagtgagagtagttagtttcatgttgccacaacacaaaaacacccttcaaaagctcctggccctgttcttatctatctgtatatcacttttaataatgcagatttaatggaccaagataagtgtttaatatatttggcatttaattctaatattgtaggtaattagatttcttgataattgtatcatagtagttatagtcctactaacaattgtgctctacgtttattgtttttacctgtagccaaccacctccatgaaagtgatgctcaaattgaaaactggtatgtagctgttttgttctatttcttttaaaaaatgaagacctttaatgaaaataaagttataaagttttatataatctgattttgttcgtagcaataatatcttggccaaagagagaagattacagtttcatcagaaagggagaagtatgaattccactggatctgggaaaagtagtgggacagtttcaaggtaacttattctgaaattgtgttggaattacattgtgctatagatgacctactcttatcattttttcaatcttggatttgaccttgatcatatgaaatcagaaagaacacaaaaagagcgtttcctgtaccagcacaactgataggagctttttgttttgttttgttttgttttgttttactttgagattaaataaaatgcaataaataggcttatactgctgctggaacccataaatgagtattttgagccctctcaacagcctgaaagaggaactccatagcggagtaacttgtagttgtagagaaccaaaattcattgttaaggacttgagttaactctgacacaaaaatcagaataaatttttctaagttacagcttgatatttaagcatactttttttcaacacattaaaccaaagatctttcaaatatatagtatagccaggcccagtggctgacaccggtaatcccagtgctttggagtgtcaaagtgggtgg

SEQ ID NO: 97679 - DNA, 1141 bp, Homo sapiens
ggatactaaatatttaattcccaataggattagagtagttacctttgtgtaacccacactctctgtaccttactcctcctacttcctgagtggaagtggttggagagaagttgaaagtaagctcctccctcgcttctctgaaatcagcttgttatctttattgttcctcctaggacaattgccactcctaggacaaggataacagaaaagctcaaatttcacaaaatgtccctcagttccttttaatttctgctttaatctgttcattccttattcttcatcatctgtcttctacttgttttagctgctttacagggaatctcttaaaatgacaaaacaaataaggtgaggaatcacgtagggaatctctgactgtgttcgttggggttagctcttttctgcaactctagcaacttgagacaatgaaccctttataagggctatttattccccagtacacatgtgtaaacatggtaaaataaataatggtttccagagcagaagctgagaaaaaagattttatcacaggaaatcagtaatatgtattcatttataatgtggtgtggactatcaatttattttatattttcatgtttccttttttgccccctttttttgtagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagtaagatttttaagtgttaggcatattattttcttaaattatagcatctacagcaagatggtcttattttaaagccttaattttcaggaatagcactggaaagtaaagagattgattaacgcaaaagccatttttacatgttaaaattaagctattttattactccatttatagtggttaatttgcctatttttcccctcctccccaattcctgacttaagtgctaccataacttatttgcagaaccttattgttgtctacagattgcttttattcaagaagaaaagaagtaggagaggagccttgttaat

SEQ ID NO: 97680 - DNA, 1133 bp, Homo sapiens
ttgttcatggatcagttttaagagatcaataaatccctcaccctgcaaattaggtataaaatatatgcttacatgcattttcttaggagaattttgaaagagtcttaatggagttcaagacttcagaatagaatcacaactgtagattcaatagctagttctttctgttttattcaatgttgccattatgctttgtgcttatttctgattttttaaaaatacaaattctagtgcttagagtaaaaatcttgctccttcccacccagtgaatgtagagaaggtttaagtgttagatgaggaaaaaatagggttttataatctttgtgatctaagtgtagtttttggaattctaaacaataatatgcatttaatatatgtgtatgtatatatataaatataaacatatcattaatattgtttcttttggtaggccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggt

SEQ ID NO: 97681 - DNA, 1947 bp, Homo sapiens
tgttaactattagcgctttgattttttttttcaaggttgaaaacccatatgttcagctaggtaccacactttactaggatgttctttatgatttaagaaccaatcattacagagtaaagtgacagaaattaccgtgcatcttgcccattccctatgtatttaatgttgacatagagttaattatgttagaatagacagagtgtttgtggggtggaggtggtgatttaggaatctgaaaatttctaaattatgtacttgtgcagatagaaaaataaacacaaaaagacaactaagtttgatatgttctttgaacagtgttttcagggaagatttatggttaatatctttcattattttagttctgtaatgaaacctgcttttccacatacagctcccaagttatgtcttgaaagaatttcaggacaaagcagtcttaaacctgagcaatttttgatacctgaaagtttgggggagtttagaaattctgcagtggtagcactgtgttctattttcaaagatgcgagacttataattacctcaactgtgtgttggtcataatgtgctgtagtgagtgtattagtgtttctcctgggatttaccctactttgaagtttaacgtatagagaacttttccttatggatctgtttttcatataatagcaacattttttttgaatgaagcagttattaaaatttattcaaggttgaaaacccatatgttgggctagtttgcacacttgactacgatgttctttactatttaagaactaaccgttacagggtaaaatgatggaagctagtgcacgtctgatgcactaatttccatcagttatttttctttgctacaaacttgagtgctgttgttaactggaaaatagatcagaaaatttagttgtggagcattctaataattttgaggtcagatttcttaaagtttgaatatatatataatgttttggtgcacttgagttaggttgatttgtttaatagatatttattcaagaagttatacttgtttgccttagattcatttggttttaactacttaaaactcttcttaaggttcaaagtacggagggagaagctcctcatgttccagccacttaccagctaggtcttacgaagtcgaaaagaggtaagtggaccagtatccactagttctgagcacattatcaaatattagttgatttggaaaaggggttttatgtatcagtatttgtagtatttatgagtgtgaaaaggcaaagaacacacacaggtaggcatgattcactattgtttgtagaactttttttgtattttttaaaagactttttaaaaattagtttgctaattagtttgcttattctggaatgacctcattacacaattgtgtgtgctctaagtattttacactattgcataagagctagttgggaagtgatagagcaatggattaagactaccttttacattgttatgactgaaaaatatactggtattatctatctttggtgtttcactatataaatatagctcctaggtataacacatgaatattcctctagcaaaacccaccaattttttagcaatagttaaagctagttaaattcaaactatgggtcgaaggtgagtggttgtagatactgttcctctcttaaattattaattattgaccaaagaacctttgaatccatccctttcacttttaacttgcaacaacaacaacaacaaaaatgtgtgatctttggatttacaaaacttttgagctttagagaaagggaaagaggaagaagtgaaaatgaccactgaaggtaggactgtttatttttgaaactttacacatgctgaaccaccctgttttttttttaaacaaagattcgtatgtatgttcctagaataggaaattacatgtttgttgtctcctgatctctgaaattacttcacaggagacaatttgcataaatt

SEQ ID NO: 97682 - DNA, 1071 bp, Homo sapiens
acaatcttggctcactgcaacctccacctcccaggtttactccattctcctgcctcagcctctcgagtagctgggactacaggcacccgctaccacgcctggctaattttttgtatttttagtacagacgggcttttaccgtgttagccaggatggtctcgatctcctaacctcgtgatccgcccgcctcagcctcccaaagtgctgggattacaggcatgagccaccgcgcccagccctaactgtgttttttaaattgggaagataatagaaatctttacacactatgctctctatatgaacttctaaatttacctcctaaatatctttacatatttacataatggaaatggtttactttgggacttctgtttttattagagccatcttttacttcagttttcctccaaggataaaacattgattggatttaccaaaatagattataattagagcttaattaatgagcgaataccgagagattctaatagaagatctgatacagtttttgtttgaatttgagttacctcctgtactttgaagacataattttgcataagtaatgcatatttttctaagaagcagtcaaatattgtgtatcttatatctgctgggaatcatatctctgtagtaatattgctctcagtaatttcttatagccactttttttatttatagatcatctgtttcttatagccacatttttttattcatagatcatctgttacgtactgcaagtcagcattccgatagcagtggttttgctgaagattctacagactgcctatcccttaatcatcttcaggtaaaattttctgttctaataggcactatgattaacttcctcattttaaggtggtttttgtattactatatattttaatattgagtctgtataatctttatttttcaagtgacagaacaaaactcctggcatgtagatgttatctaagcatttgactataaattttagatttcattaattcttctctctgaatatgtttttaaaaatatctatcttccccttaatttttggaccaccagtaaacagagattattgtgatcattaac

SEQ ID NO: 97683 - DNA, 1025 bp, Homo sapiens
tgagtcagtgtgttgtattgaaaggaaagggggaggttgttggaaagggaattttaggaaaacagtgaagttctgaaataatctttgtgagaaagtgagaggaaggagggatgtggttgctgctcaggagcaataaaacaattttgagcaacagcagggccacaactgcagtggagacagtgaaattatagaagcaccatgttggtttggtattttgttagtgactcttcttacatatattcttcatctttccacctattttcttttcacaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacaca

SEQ ID NO: 97684 - DNA, 1040 bp, Homo sapiens
aagatttgtgattaggaatctccaaactgcatttttccaattttgtgcccttcaccataccaataggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtacgctacctggagggtggtcggagttttcaccaaaggtttatttataatgttccaataatttaggacgtgtgccttcatttcaagtcatttattttaatggtattaaaagcatgcatactgtttaaggagctttcccacaaatcagttgaatgtacaatttgtaataattgtcataaatagtatatttagaaatatgttgaaaatttttaatgataaattttaataacaggaaagaataagggcttatacgaaagttgagggtttttaaaggaaaaatgctagtgaattaacatatgactaatgtaaattttaattgttgcatgtaactgcagagaacacagatgcatattttgctgtttttttttctttcatgcctttaaataaaaaagtgttccttttaaactttttctttattttggattcttttccatttgtttttaaaggaatcaaatgatacctgtatattttcatacatatatatacatacacatacatatatgtattttcctaaatatatagatatatatccaagagaataaaaagaaacatgtttttgtaccacttttcatacttctaatgtttctttccataacatttgaacttcaacagttgtattatttttgcaaatatctttgaagttgtagaatatgttgctttgaaatgctgaaatagtgaattattctttgttaccttaacaatgtatttgattttgttaaaaagaaatggatgaatatacacacatacaattatgtgtgtatatactataaatgaagtagaataaacaatggtgtataaacacatatatgtatagcatagacta

SEQ ID NO: 97685 - DNA, 1687 bp, Homo sapiens
agcctcaagcgatcctcctgctttagctctaacttcattttatataatatatattaataataattcttggtgaatgcaaaaagaaagaataagttgagtagaatagaactaaaaatattcattgaataagacatgagaaacaaatgtaatttgaaaagtataatatacaatttcagatataggaaattggaaagtattttaataaattatgtcacaaagcaattaataggaattattttttttaaagccagggatataagaattaactctcaggaagatgtatagagattacaggataatcatgtttctgtgtatatatatttgcataaaattctcatcttcctttaaagaagcttttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaagtgttttagtggtttcttaaactgcaacatgaagattttgaattagatttgataggtaacaaatgaggtccaaaagaattgcagcatataacccaatag

SEQ ID NO: 97686 - DNA, 1001 bp, Homo sapiens
tggaacccaaacatcatactgtcaggaagaccaagaagcctgggaagaggcctacatggaggaagacagaagcttctggcctttggccctggaggaactcccagccaacagacagcaccaaatcgccaatcatatgagaaagttatcatgaacgtggattctccaccgctagtcaagccaccccaggtgatatcacaatgaattgaaacaagttgtccctgttaagccctgcctgaattgtgaattcatgaacgaaatgaatgattgctgttgcttcaagacactaagctttcaggatactttatgtgcgcatagatatctgtgacaaattttggtatctagaagtaggatgctgccataacaaaaccctatatttgggcattggctttgggcctggactgtgggaagcagctggaagggctttgaagagatgcttagtgaaaaccaaaggctctcaagtagactgctagtggaaacctgaaagaccttgaggaggctctcagtgaaggtttaaaggaaagtgaggacaatggtattggaagctaaaggaatgggaagccttgttggatgacggcacagagtttgccaacataatcatctgtgttaatgtggcaaagtggaaatatacctgctaaactcaatgatctagttaagatttccaggcagaatattcaaaatgccacctgatttttttttcatcacctatgataaaatgtgagacaagagagatgagctaaaaataacctttaaatataaaagagtcagaacttgccaggtttgaaataaaattgtgtcttatgccctgatcctctaaaaacaattactaaattaaaaatggctctggaaaagataaaatcaagggtggatccataagattctttgttagtacttaagaaagatttaagagagtggctcacaaaacatttcaaacagaaaaaggtatttttatggatcttaaggcctgcctggccatctcttctctgttaaataattgggtgctc

SEQ ID NO: 97687 - DNA, 1061 bp, Homo sapiens
gccacatccccaccccaccttcagcctccattctgggaatgaggaaagcttgacactgaataagaatttagatattctatttctttactgaactgaactctagcttgggtattattagagtagctgatatgtttaatgccaaaacattacctaagaatgaatacaccaactatggactttatctatagttttatctttaatagtgagaaataatacatcattttcttttcacattttatcactgatggaggtatcacataatcatattaatgtatctgcaggatagatgttatcttagtaggaattattttcttccctctgtaattaaggaaactgaagctcacagagtttaagtaagtttcctaaggtcccacaaccaacagtcaaaagaacaaggctatgaaacatgaatgtttcagtcaaacagtcattcccttcctgcacgctgcactgaacctcaaggaccaacaaagaacttgagaattcaaagtgggcaagattttatctaatttggggaaacaaggagtgttcatgcaaggggaatggttcatgaaatggactttcaggatgaataggtttttagcaaacagagatgagaggaaaataattctaggacagaagtgactaaactaagaaactgaggctggatagggtgtagtctacaaactgtggtagtctaatctggatacgtataaggtcgaggaagggttagggaaagagaagtctggaaacactgtggggcaatagaatggtaattctttactttttaccttactccctcttctgcaactgcctcttattctttgagaaaaaaaggaagatatacttttcatatgatttggaaagcagagattatgtgctaacatctcacttggtatagggaaaaactgcaagaattttttagagaggtggacctagtttcaaatccattactactataagaatatactatttctgaaactcaatttccttgtctgtagagcaaaaaaattactccatagtaccacagtggaggataaataaaataagatgaatatgatacacaattataaaataactgt

SEQ ID NO: 97688 - DNA, 1068 bp, Homo sapiens
ggaaaacattggtaactaaattaaaatatcaatgctgtctaccatttttgttttcttttattgagcttcttctaaattgtcttcatataatatttgagacaccatataaagttatgtgccaagaaatctctttttcttttgtgacaagaaaggtgaaacagtttcttactcccattctgatgtagacttctctgcattagtctattaattttcttcttatattacaatctttttatttatctttttccatattcaaccactaatttgttactcagtacaacaatttagattctacactacaagtcatcatctatgatggtggaaatatgggcaaataactatggcatcaggtctttcataaattagatttaaaaagaattatatacttggccataagttatcaatcgtttagggctggaaaacacttcctatttcttatgccatctcaacaccaaatgaaatttctgattcagaagtttcttatgaatttgggacctagacttcttcctacatactaagaaaacatagctattgatagtctttcaaagattgtcaatttcattgatttccatgtggaaagttggtttgaagattttacagtatttcacctatgcattgtgtttcttttccatttgaaagataaatgcctttttgtgtcatgtactgttgctttttttttctctaaacatacaaagagttccacacctgtggattttattaaaaaattaaacatttaaaaaacactggtgttgctctttccagttagtgacattgctataagaattcaatctaagaggtgacagcattttcagaaaactgaaaatgagcatttttcaggtagaaaattcagtgaaaacgacatgaaattatagggaaaaatctaaaacaaagtattatcttactcaggcattcaagagaagagaagaaagtatgaactgccagaaaccataaactactgacaaaaatgtaatactcaccacttcatagtacttactgccccagttccttcagtttttataaacatagtactagaatctatcacaatttcagttagaagctaactttata

SEQ ID NO: 97689 - DNA, 1070 bp, Homo sapiens
agacaaatcctccaaagctccgtcttccctttaaaagactctcagggaactcaaccccaaaacccaccctctgggtttccccgtcaccctggcaacggaagcaggaagaggcgggcttcgccatccaccctccccgcccgcggcaggcgccggccgcattggtgagggggcgcgggctgcttggccagggcagttccctcagctccgggttggagccggagccggagccggatcccgcgcacaccgccacgtcaacctaaacctacaccgccctctccaccccaccgccgcagcgcccgctgggcccgcagcgggtctccccaggcagcgtcctccacgcctttcccacaatgctccgcgccaggccccgccccggctcgccgtggagaccggcgcgtgaggaacctaccggtaccggccgcgcgctggtagtcgccggtgtggctgcacctcaccaatcccgtgcgccgcggctgggccgtcggagagtgcgtgtgcttctctcctgcacgcggtgcttgggctcggccaggcggggtccgccgccagggtttgaggatgggggagtagctacaggaagcgaccccgcgatggcaaggtgggcatgggcccggggctagggctttgctggagccggtggtggcctgggccctccggtcagggaggggcggaatggctgagcgcctgaacctcccttcctgtgcgctcttaagacctggatattgtgttctcgctccccaccttcctcctccctgttattcacaccacccttcctctgcccagcgattccctctcagttacttacactttctccctaagtccgacctgagacttcagacaccagcaacacttaacagccctgttcccccgtgtcttcatctttacccctctcccctctcccactctgcagtgatggcaatgcgaaagcttgcgccttgcatttacctggcgcttccacctgcccggtagctcgggccacgggcagttcggccacacccacgctgagaacaacccctgggcgagaaacatcttatcccaaagtgttgattgagactatgccctctcttttt

SEQ ID NO: 97690 - DNA, 1024 bp, Homo sapiens
gacatttcctacaagtgaattctgctgaaaatgaaaattagacagctttaggaggtaaagaagtagctaaaaggaagaggtattacaggcaacgctataactgggtagaaagaggaagcacctgtagctcattgccacctttgtgttctgatgctcgtcagaggtcttttctcagtgtataaattgctgagggtgtgtgtgcaagctacttactaccactcatgaccttttttctgctatcttcagtgatttcacaaatctagctacatggatgtagaaagagtgaaaaatagaacctggggcattcacactgatttgccatttaatggagattgtattgctgaccatgttctgtgataaataaattgtgctattattgtttagttcaaaatgtattttaactgcctgcttttctttcttagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccggtaggtaaacgtttgtttttaaaaatatttgattatatttttggtacattttgatatttatttaaattgctttaaatgatcaaatgcttaagaataatcatatgtcaaaattataattcaacttgtatgctagaaacaaaagcaccaaaatgttctggattatttaggatcccgtgaaggaatgtcagtaccaaaaattcagttccctcttaatttgtagacgattttccaacaattctattaaagacatta

SEQ ID NO: 97691 - DNA, 1023 bp, Homo sapiens
tttttaattaagttgattttacctcaaatagaaaaataacctacaaatgtattgatttataattgttataggagtaaaaaatatttatgaaattaagagtttcaacaggcttattattttcagctgcattttttaggaagaataactcatggtctgataacgtctgtcaaccttttgaagagtcaattatttcattacttttcttacttttttttttttttttttgaagattatagtttcttaaaaaatacttcatttcaacccatggtaactcatgtcatgttgtattacccctccttatgttggtatatggtctcccagaagttactagattaattaaacctacatatatgttttgaagaaacttggattgtgtatctgaaataattgtattatatctaatattttttaacagaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtaaggtgatacgatattacttatgaaatgtgttttatctgagtaaaagaaaagtgaattctgtttcaccacttagcttatatatttaagatgcgtcactttgattagctccttttaatttgctgtgggagtgaaatttaaaaggaatgtcagttggtatacagagatgatctgtacagatatgaagttgtattggttaaatcttgttaaatacttttaaaataaggattgctatttaataaaaaatatgcattcatggactgcataatgacatttcacttaacaatggattgtatgtaggacattggtcccatgaaattataataccatatttttactgtaccttttctatatttaaatacaaagatacttagcattgtgttacagttgcctatggtattcagcagtaacatgctgtacagatttgtagactaggtgtgtagta

SEQ ID NO: 97692 - DNA, 1026 bp, Homo sapiens
ttatgtaggtctcttattttattctttcagagtttacagtagctgtcagaattgactaaacctacttaacctgtgctgcatgtaatagaagagcttaaatctcagtcactcttactatttgtcttctttatttctctcatgcacacaaactcttacgtgaggtttggctgctatttcttgtgccgtcactttttacaactttatggccatatttatcttgcagtttgaggctgcttctttttcaagtatgggcgtaggagagtttttttaaaaagctattgttggtttgacatttgaaatgtttcttgtggaaaaaaaatttttaattttttaaaaatgtcatttatgtagaagatatagaaaaacatcacacagaaaatgagaaagacaatatgaaaattgcatgactttttaaaattctgatctccacaaaaagtttttaactaaaatatgcatgaacctttaataaataattctaagttgtttgcattttatgtatttttagatgctgctgttaattctggagaactgtggtttgtaaatttttactccccaggctgttcacactgccatgatttagctcccacagtatgtatttttcacatcctcattactagttttatttctaattgatctgcaatttatatgttagaatttttttttctatgaatagtaatcaaaaataattatcaaatactttaaatgtctggtttaaaaatatatagcttggagtgtgttcaagggaagaaaagtggtcttatcagagaaatatgttttctttttctgtcatagtggagagactttgctaaagaagtggatgggttacttcgaattggagctgttaactgtggtgatgatagaatgctttgccgaatgaaaggagtcaacagctatcccagcctcttcatttttcggtctggaatggtaagggataaagttagcattttttaaatttgtgaaacattatgacaagttaaatagtagagaaaataacagtatgtagaatttgcagaacattttaagtct

SEQ ID NO: 97693 - DNA, 1011 bp, Homo sapiens
tgtaaagaaacacatttagaaattgatttgaaacattttcttcccttatttcttgaacatttaactcacctatttgtaatcttattttctgatgactgtattcatagctatgtgttttttcctgaataattagttacgttcaataaattttaacgtggtatcaattctaagtgtcatttactttgtaagtattctgtaatttataagttcctcttcaactgaagttacatgttagtgtttttgtcatttcccaactttatcttttgttgttttcttttttagtcatttttaaatgtatatagctctcatgttatggctgggaagtagcctgagtgatgttgattttttaacaccattgaaataccctttgtggctttgtggcttgacaaagccacacaaattgtcagttttgaaaattttggaaattctttgtgagcttgaatataataatgttatgttaggtgtaatatatgttaggtgtagtattacatttattagatcagatttattaatcatgttatttgtttttggactacatgatctataatttctaagagggatgtattaaaatctctaccatccatcattgatttatctatttcttatatttctgtcagttcttcctttacatattttgacattatattgttggcagcagtatgatcattatatcctttggcggctatttatttctctttgtgcattatggatttgtttacacaaattctgttttatttgatattaaaatcactaacttagtatgcttttgtttcattccctttcttatttcaccctatgcctaggcctttagtttttcagcactacacattaaaatcacctgaggagcttttaaaaataataaaaaaacaaaaccatgtcccccagaccaattaaatcaaaatattcgagggtgaggactgagcattagtatctttattttttttttaatatttggtgatcagagtgattggcctatatttttcctttccagtaaagtctgtgcacttttag

SEQ ID NO: 97694 - DNA, 1004 bp, Homo sapiens
aatgcacattgtagacacatacagagaatgtctcataaactgtataattactaaaaggatagccacaatgaaaaatcttaaacagtagtttggtttattttctttaacctgaaagactattggacagctcactttctataaaaattgtaaatgtcgttttttgtggattcgtagaaagaattataaaaagtagatttctactattagggaaaaaccatttctcaagttactaagtacaattttttgcacttaatatttctaaatttattaagtaatttataatattagaaatctactttttaactttgctgtagaactaaggcatgaagttttaattttttggtagaaaaattgtgtttttagctaagtaaagctctaaatccctttaactttttgcctcccatttacaacatggtttgttgtttctttccattttaggatggtcttgttaatgtaggatggatggactgtgccacccaggataacctttgtaaaagcttagatattacaacaagtactactgcttattttcctcctggagccactttaaataacaaagagaaaaacagtattttggtatgaatcactttaaactaatttatttacatataatgtgcaaacaccctcaaaaataatacattatttttgtaagcagtgagcaaagaaatgaacaatttatattgtctgattgtggaacccttatttagaacacatacttaatttctgagattctttttaatacatgcttcaaattataaaatttaaggattatttttaaactgacgattacatttcatttaaagtcattacatctttacatttaaaattaccttacatttaaaaccattatatttttaaaccccaaaagtatggagtacattcctgggttatacgaaagagcatttatagcatgagttttcattgttttctatttaattgtttattttgttttttttgagatggaatctcactcttgtcgcccaggctgtagtgcagtggcgtga

SEQ ID NO: 97695 - DNA, 1036 bp, Homo sapiens
tttcttaatggatcttctctcttaaatgccacagatttgttcctggtttatatttggctgttgtgcttacgctcttctttttcacactctttgaaaacatcacttttttcttcattatttctgcttctgaaagtgatctctcctctatctcaagattatataaacattctctacatcttcaaaaagtaggtttctggaataacttcatattttcttgggaattcctcaggttttttttaactctctaggaagcatttttttaactaaattgagtcttaatattaaatgtaaatgaattatttctgtctcttattttcgtagcctattagcttctgtttaaaaactgtgtcattagggcagtgccatttttggattatcatgaatatttacaaatcaaatgggtaagacagtgtttttatcaaatttgacctttttctcctttaggttggcaggtttgactgttcctctgcaccagacatctgtagtaatctgtatgtttttcagccgtctctagcagtatttaaaggacaaggaaccaaagaatatgaaattcatcatggtaagaatggaaaaaaatgataaaaaaaaacttagcttcattttcaaatagaagttttctaattgtgctttttaaacttattttttacggacatgcttattgtaaataacttttctcagtaaatatgaggacagatattttgaattatatgtagtcactttattctctttacccttctttttaacatgaatgccttttctctattcagtattttgatcaggatttctggtgataagtcaagctagtgagaaatttaagtcctgcttgtttgcaaaagtaagcaacacctgcagtttatattccagcttgccatgtgtatcatctcagccattataggcaatttccaaacattcttttggatgtttctcccactagacttccagacttcttcattaactgccttgttatctttcttgcatttataattttatttcagcttatttgggactttagctctgcattcatgtgagtgcagtc

SEQ ID NO: 97696 - DNA, 2223 bp, Homo sapiens
tggtgagaaaaggagcaggtttggaggaaaataacacagcctcaatttgaatatattgccatgtgtcaacgacagagacgtcttctgagaaatgtgtcattaggagatttcatccttgtacaaacatcagagagtgtacttaaaaaaaactagatggtatagtccactacacatctaggctatacagtatagcctattgctcttaggctacatctgtacaatgtgttacaatgtactgaataccataagcaactgtaacacagcggtaagagtttgtgtatctaaatgtatctaaacatagaaaaggggtaatgtgttgcactacagagttacaacagccacaccatcactgagccataggaatttttcagctccattataatcttatgggaccccatcatatatgtggtccaccattgcctgaaatgtcattatgcaggactgtattgtgtttgacgtgtttacgtgatatccaagtacagtttttcactgggcagttggtaatatgggttttgaattcataagagaagtctaggttgtagaaaatgatttaggagttaggccatagtaatcactgaagtaagcataattaatttaaagaaccctataaaaaagtcattattctacctctgaagatgagggaacatttcaaagagattttgactttttttttttttttttttttttttgaaatggagtctcactctcaccaggctggagtgcagtgtcgagatcactgctcactgcaacctccacctcccaggttcaagcagttctcctgcctcagcctcctgagtagctgggactacacacgtggccaccatgcccagctaattttttgtatttttagtagagacgggggtttcaccatgttggccaggatggtctcgatctcttgacctcgtgatctgcccacctcggcctctcaaagtgctaggattacaggcgtgagccactgcacctggccaattttgacatttttaactagtccaggaaacagaagagtgtgcaagaaaagggtgctcctatcagagctaagccctgtatagtatacagcacactaaaacctcaccaaaatcaatttgttcataatttatcttctttagtattctgagtattaaaactttgaaatgtctctgtgcatacaaaaagcagaatttggatttgaatttctctcattcactttgaaaggaaagaagattctatatgatatacttgcctttgccaaagaaagtgtgaattctcatgttaccacgcttggacctcaaaattttcctgccaatgacaaagaaccatggcttgttgatttctttgcccccgtaagttatttttatctgtcagattctaacattgtcagatcttctcctgttatggcaaaaagacattttctagataactctgaatcattagtacaaaaactgtgtcattccattatggccactaatgcatattgcttttaaatgagtgctaatgtaattactcctccagggaaggtttgccgctaagtacagtttgtcttacttagcatattacttgttgcagaaatgatgggggggttttttgtgtcatttggctcggtgcttatgaatattttttctttcctagtggtgtccaccatgtcgagctttactaccagagttacgaagagcatcaaatcttctttatggtcagcttaagtttggtacactagattgtacagttcatgagggactctgtaacatggtaaggcaaagtatcaaaaattattctaattaattttataaaatgaagaccttttggctgtttattattaaaacattaaaataacttagaaataatacatcttctatttagagtagtaacaaattatttaaacaaaataatatttttagaaagtggtatcaaatatgattggattaaaccatgcatagctaatcaatgcattgaatgtaaataaggtcttatttatcaaactcaggcaactattttcattaacttcataaaatgcttatatgattttccaattattgaagattgttatatttctttaatatttttgacattttataatttttttcctttggctttcttcatacttctaagtatatttgctggaaagaagttaaaacaatgaacaagccttttgaaatctttgtttaaatgaaattattttctcaggtaaatattcactcctcagttgcaggaagaactaaaaattatataccgtagaatgaaagtacgtaa

SEQ ID NO: 97697 - DNA, 2275 bp, Homo sapiens
tattcttgctgttttatttcctgatcatcatctatttctagaaaaagtatttattatggtttaaaaaaaagactcaagctagagatatagcctgttgtttatagcctcttcttaccttggttcaggagagtaaaaagggaccattcgtataattacccatgccgatttctcaatgtttcaatgcctatggttctcatggcgaatggagcagctataaataaggatcaggtattcatcagtatttagcagtattcatcaccataagtcctttgctaaatttggtgagactaaaatttttgtcaccagaaatttagaaatgggtttttaaaatcttgttcttgttacttaaaggcaaacttgttataaatttgtaacaaataggtgaaatctataaaatctttaattcatattctccttcctatcagtataacattcaggcttatccaacaacagtggtattcaaccagtccaacattcatgagtatgaaggacatcactctgctgaacaaatcttggagttcatagaggtatttcagattatagactatgtgactagaaatttgtctgtttctatgtaaaccctgtatgaatgtttcatattgtttaataggatttactcttttcatgcccaaactattttcttacaaaatgatttttaaagaatttttctaatgttttactcttcttatatacttgtctgtaaactcaaagtaaatctgtgttttatttgttacctggtatgtacagtgccttataaacaatggacacaattatttattgaacatatgcaatgtattttcaccttgtcacccctttgcactgttttctctgaaaacaagtgtctggcatctacagcatctttttttttttttttctcagtaacactcttgatagaaatacttacaggggactcctagaaaaaaaaaaagaaaatttctagtttattattatccatttgatgaccctccaaccctgtcctactcacctgttcctcctcctctgacgtaatgttttgtcttgttttcccagtgaagctagcctcttcatcagtattacctgactgttgtaggctgaagctttgttaaaatatcatttggaacaaagaatctgtagaaaggtgtagtatctccagtcagaatgtcagaaaaatgagatagtaggctttccactagtaattaaagaatcatttccaaaccagtcattcttggttctagaacagaactttatggcctctgtagacatccaggcagcccttgaaactcttttattatccatgcagaaacttaaagttgcctctttgcctgttatgattttagtgatacatagagataaaggataaatagaccttgattttttacaaaactaatgagcaaaatccaaacttaaaaatctaagttaggtttattttcatattttaagataattcacattggatttcttttagctatccttaagcatcttttggtttctcaaaaatgggaactttctaaaggacatacacagattgagcacccctaatccaaaaatcttaaatctgaaatgctccaaagtctgaatttcatgtttagacttgggtttcattcccaagatatatgcaaatattccaaaattcaaaattctcaatacttccaagtattttggataagagatactcaacctgtaccaacaatttgccaggaatatatgaacagctatgctttatatatatgttataatggaagctatattctcttcaggatcttatgaatccttcagtggtctcccttacacccaccaccttcaacgaactagttacacaaagaaaacacaacgaagtctggatggttgatttctattctccgtggtgtcatccttgccaagtcttaatgccagaatggaaaagaatggcccgggtatagtaaaaatagtttattttaaatcttaacatttactaagaatgtttatttaacagaattattttgaaacggatgtgaatgaacccacaactaaattattacttaataacagtactgatcataccactttgattccagctctgtttctgtctggtgtgtgaatggtatagcctaccatttttgtgtgtatagcatctggtacactttttttttttggtcgggtagcagggggcagagtctcgctctggagtgcagtggcgcaatctcggctcaccgcaacctcaaccaccctagtagctgggattacaggcatgtgccaccacgcctagctaatttttgtatttttagtagaaacagggttttgccatgttggccaggct

SEQ ID NO: 97698 - DNA, 1009 bp, Homo sapiens
cttaaaagtaagaaaaaaaagctttcagcatgtgtatttagaaaatttcctgaaaataggcaccatgttttaagttgtagaagattggaaacaaatcacttaaataccagaatggaaaatgcaattactacttcacatttgtttacaagataaaacactaaatctgagttaaagtgatttctagtatcttaacatttaggattacatatttttgtgctcttttcaataaaatttttaagttcaggtgtgagtcagtataacacattagacacctacaaagcttgttttcattggaaagaatactttgaaatattgcaaagactttcattagtttctagcactttgaattttagaagtatatagttttttctcatgtaacagttaaatgaaataaattgtttaatctgcaataattttagtaagtacttaattacaaaattagattacaaattcattagtataaatggtctattatatgttaaacccttatccatttttattgggtaaaagtcactgataaataatataataactgtttcaccataataatacaatgcttatttctttattgcaaacatatgtaaaaagttatggaggtaatctgttttttcttttacagacattaactggactgatcaacgtgggcagtatagattgccaacagtatcattctttttgtgcccaggaaaacgttcaaagataccctgagataagattttttcccccaaaatcaaataaagcttatcattatcagtaagtattctctcatatttgaagacatttattataattatttaattatacacttaacagttaagttacctgaacaaaataaaagttaacccaacaaatatttattgggagcccactacgtaaagatagtttgttaatgaacatttcagaagatgaaaagggagtattgaacagtctcactgtgcataaagcttatagtctagacaaaaagataaggaaaggaagagctaacatttattaagtccttaaacacctt

SEQ ID NO: 97699 - DNA, 1033 bp, Homo sapiens
ttttctgaatacatccaataatagagaatcctatttacaactaacattttttcttctctcagcagttacaatggttggaatagggatgcttattccctgagaatctggggtctagggtgagtaattaaaatatatatcattgtataaaatagattcaaagccatttaccccccttttatatcaatagttaaatttactgtgggttaaggttctagcattttaaattacttagtaaagtattatattaaccaagatagtactgtactttattacattgcccttccttgacatcatttttaacttagaaagtattacaatattattgcatttcatatgtttgctttggttttatataatgaaaaatgattttgatcatttgccacagatttttacctcaagtatccacagatctaacacctcagactttcagtgaaaaagttctacaagggaaaaatcattgggtgattgatttctatgctccttggtgtggaccttgccagaattttgctccagaatttgagctcttggctagggtaagtcatacctgtcttaaataagttgtagccacattcatgttttagtaattagataaaacattgtaagtatgtaatttttaggtttttttcttaaatgtttcctctgaatttaaaaatagctattatatttctatgactgtaatggttgtagtagatttcctctttctttgttaaagcttttagctaacatcttctctatcttggtagacatcatcatctactagccataaaagccagaaacgtctctttcttctccctcttgtctactttctcctccccaccccagtactctgttgccctccaggcagttactagattgtgtcagttttatcccctaaatgtctttcaaatgtcatttcttattcatctctactgctaacctgtttcttcaaccctttatcatctcttgtctagacttaaccatatttgccttttaagtgcagtcttcccttgatatactcaggggattggttccaggaacccccattccataccaa

SEQ ID NO: 97700 - DNA, 1017 bp, Homo sapiens
gtgagaagcactatgacagaggaaccataatccaggaaggaatcctttcatgattatatacatcttcactggagaatatgtgttctgacagggagggactggagaatacaggtggagtaagtcagccttcacgagacaaagagtgcccaaagagtcctaccacagcacacccccagtgaaaggagaaaaagatagaaacagaaacatgtttatggtatgatgtgccagtagtgggtggcaggaagaagttgagacattgcaggataaagctgctcagttttcttgatgaggcaaaggagggtttatttgctgttggagaggtggtgctaggtgaataggggcttaaagggataatgtggaaataatcttgtttgagtaggaagaattaaagttttttaaataaattcttagattcaaaatgttttatatcctattgctttgttgttgccaaaatagtttatgccaaacagaaaatggcaaactgtatttttctttttcagatgattaaaggaaaagtgaaagctggaaaagtagactgtcaggcttatgctcagacatgccagaaagctgggatcagggcctatccaactgttaaattttatttctacgaaagagcaaaggtatgtccagactttcctctgttccttcccttagtaggccaagctcaaaagatgtgtttcagtctgagtaatgttttttttctgttttctcatccttgtcatttttttatattattacatattactgatacaagtttttaaaatttacatgtataccaagcgatcttaaaaggttttttgtcttgtggttgatacagactcaattgccttaacatttttatactaatgaataggaaaactactagaaagagacaaaaaaagtattattcgtgataatctttgagtgctggaattcaaggtaattttctacttttctgtgaaaggttatggtgactgttgaggtcactaagaatactctataatacacactgctgcttggaataatatttccttagta

SEQ ID NO: 97701 - DNA, 1024 bp, Homo sapiens
attgtttcatgtttccgtgacactattattagtatttattttaggtacattatgggttaactgcttttgcagcattatttccttgaagagaataaatttgaatttcaaacacttcaagttttggaacaaaagaacttgaaagcatatttaatcaagtttcttaggtggaaatgttatgtttttattaaatacttaaaagataacaagtgtttttaattttagagaaattttcaagaagagcagataaataccagagatgcaaaagcaatcgctgccttaataagtgaaaaattggaaactctccgaaatcaaggcaagaggaataaggtatggactaagcctagagttgactttggcaaaagttggcaaaagttagcaaaatctatttttcctatacattacatgcatccagagacaacaaaatgaggcatcaaaaaatagtaagatagctgaaaattctactttgggaaataggacaatcaaaatgtagcctagacactgaaatgcttttaaaaatttggacaagtaaaaccacttaacaaaaaatagtgactgtggtccatgcaaaaacatgtatacaaatatttatagctgtatcattcataatagcaaaaaaaagaaatgtctgtcaactgacagataaatgaaatgtggtgtatccattgaatagaatattttcagccataaaaggaatgaagtactgacctatgctacaacatgtttgaactctggaaaatgtttagtgaatgaagccagtcacaaaggccaaatattatataatactattgatgttaaatatctagaataatccatagggacagaacgtaggttaatggttgcctggggccgaagtggagtgggatagaaaagagcaaaaatggggtaactgctaatgggtagtaaggagtttattttgggaatatggaaaaatgttttaaaattagattgtaatgacagttggacaactctgaatataccaaaaaccactaaactcctttaaatgtgggaattttatggtatgtga

SEQ ID NO: 97702 - DNA, 2059 bp, Homo sapiens
ctgcagaccccaatagacaaagccttacaacctacctcaagaatattttttacgaatctgaaaggtaggaaagagttatgagtctgtattttcttggttccactgaacaaacatgtttttctagtgtttcgctatattagttttctcaagatattttattttgaaaggtgtaacttttatctcattaaatatttgaaatttaaaaattgtcataatctaaaatatcatacctgaaattaagttaaagagaatacccaatatgcttgaaattatgtaaacctatatagttagtaatatctgctgtgagcaggtaagaactaggatattcttttcttttttattgttatattttggcaaagtatatttcatgtcatgatccattaaataagaatattgagtatttctgaaaaagtaaaatgttggtttgtggtatttcaccttatttttaacattaccaactcatactttctcctttctctatcgcctttacattattattataggatgaactttgataatgttgaagatgaagaaaaagtttaaaagaaattctgacagatgacatcagaagacacctatttagaatgttacatttatgatgggaatgaatgaacattatcttagacttgcagttgtactgccagaattatctacagcactggtgtaaaagaagggtctgcaaactttttctgtaaagggccggtttataaatattttagactttgcaggctataatatatggttcacacatgagaacaagaatagagtcatcatgtattctttgttatttgcttttaacaacctttaaaaaatattaaaacgattcttagctcagagccatacaaaagtaggctggattcagtccatggaccatagattgctgtccccctcgacggacttataatgtttcaggtggctggcttgaacatgagtctgctgtgctatctacataaatgtctaagttgtataaagtccactttcccttcacgttttttggctgacctgaaaagaggtaacttagtttttggtcacttgttctcctaaaaatgctatccctaaccatatatttatatttcgttttaaaaacacccatgatgtggcacagtaaacaaaccctgttatgctgtattattatgaggagattcttcattgttttctttccttctcaaaggttgaaaaaatgcttttaatttttcacagccgagaaacagtgcagcagtatatgtgcacacagtaagtacacaaatttgagcaacagtaagtgcacaaattctgtagtttgccgtatcatccaggaaaacctgagggaaaaaaattatagcaattaactgggcattgtagagtatcctaaatatgttatcaagtatttagagttctatattttaaagatatatgtgttcatgtattttctgaaattgctttcatagaaattttcccactgatagttgatttttgaggcatctaatatttacatatttgccttctgaactttgttttgacctgtatcctttatttacattgggtttttctttcgtagttttggtttttcactcctgtccagtctatttattattcaaataggaaaaattactttacaggttgttttactgtagcttataatgatactgtagttattccagttactagtttactgtcagagggctgcctttttcagataaatattgacataataactgaagttatttttataagaaaatcaagtatataaatctaggaaagggatcttctagtttctgtgttgtttagactcaaagaatcacaaatttgtcagtaacatgtagttgtttagttataattcagagtgtacagaatggtaaaaattccaatcagtcaaaagaggtcaatgaattaaaaggcttgcaactttttcaaaaacctgttagaatatgctttattgtgttttgaggagttttcctttttttcttttcaatatcactttatcctgctcaccagtatttcctcataagggttattatagccataattaatgttaaaatagactttgttcttcatattctcccatctttttcgctactat

SEQ ID NO: 97703 - DNA, 3770 bp, Homo sapiens
tttcagttataaatcctgtcagcttttttaaaaaataatttttaaattacaaatgcaaatatagtactaacttgaggagaaaataacttctatttcaaggaaaacactattaaaaattttaagtgtttctttccatttgcaaataattccttcactcagggtttaatgtcttaatcttacagtgtttctgtgaagtcaaatccagtgtgaaactgtcttcttccttgggaactaagaaatatagtcagtatagataatgggatgggataagagaaaataatttgaatcattttaaaaagcagacttgttctgaaaaaatcagttttaaagaccaataagaatatttgattacatttattatgttagtgtctctttgtgccttaattactctctaaattactgcttgaatgtaggctatctaagctcatcttatttaattgctcattattttatatttagcactgaatgattgaaatgtgttggaagttgaaacatacctaaaataagtaaccgatgaaccttttattaacaaactcactttatgtgtatgtatacttttaagcttgcatcctccagtctactgaaaattggccaggagacagataaaactacaacaagaaatagagaatctgtttatttactgctagatatggtaagtctcattttaatttttactaacaataaaaaagttccagtcgttcctgagaatcttttcttggcatcttagtcattgaatactttttttgatcccttttgttcacttcacgtaagccacacctttctaaaatttgcagagaagactgacatcactcatattttatcatttcggtaatatcagaagataacaatcaaaggttagcattaactgtgggtattcttttatgaacagtttttcaacctgttggaaaacactcaggccttgtatttttctagtgtattggtgtcacctctcttccagttttctgagttttctacattctaactctattctgcccatttctcgtaattttctgtaattctctgtgcctagtcacttccctctctgcagtatctgtgaaccagctcttgcttgtttctaccacgtggctctttccccacttagagttattttccttacctgcagaaattggatttatcctaatgacttagcacatcccacagctcaaatctttttccagatagtctttcttgattactttggcctacattaatctttcttctgttttgaattcttacagaatttacagctttccatttcattatagtcggtcttatgtttggttttgcttcctagcttagtctttgattgccaggtagagttgatagtacaaaaaaaaaatatttttgtattgtcttttatttctagtatatcagtgaggaaaatgaaagtgctcaatatattcctgttgattaaataaatttaattgaaaagtagctctttttaaacagtttgatatacattcactgtggcacatttacattttagattaagtaaaaggaaaataatatgtgtctattgctaataagaacaatatagaagttatgccttactggttgtcaataaatgttcccattataaataacttatgatttttgtttataaacaagttataaataacttgttttgatggattttttgaattttacagattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattgatttctttaagatccttggatattcgttcaataataataaagtttttgtttaaacttagtttgaaatataaaaaataatggtttaggaatgtctaagtacagcattcgataccaggtcagctattatatgatttgtttaaatgttttaaaaaacattttattgaaaaaaataccaaaattagaaaataaaattacacaatacttcttaaaaattaagaacttaaagaaaacttgtatgctgtcaacttgctcattttatctgtaaccaaatagagttatttaaaagaatagggaaaaaaaattgagtgatcatgggactagtgagaatgttgagaactgctgcattagtcagtaatgaatgggaaagacataaaagggcctattgcttaatagttggcatggagggcaaagcagctcatttagtttgaaaactaacccaatgttttgctctttgattggcattgttgaggctgtttctcagcagctttgtatatgaatatcataaagagcttctgttcacagcttcttatgtatacactggtaacttgtgttaagataaaagaaggctgctgtgaactcagttataatgtttttctttcttcaaacatagagagtagaatgaaattgaagtactatgagattatgctattattttgtgtatgatttgtccagcctatatttaaagtagggagtagttgtcactatctgtcgaaaaattgtacttgttccataaagattttttaaaaagggaaattttaaaatggcatagttcagacctgaaatagtctgatttacacagtgagcagtcaaaactaagatttaatgccgtttgttttgaaatattaggatcttagagaggtaataactttgttggcagtgatctctggagaggtaaagtaggaatttggatatgtacactttggaatcatatgtgaaagggcataaggatgaaaataaggcattctctaccactgctaggctgagaaaaaaatcgctcctcatagtcacctgaagtttttgtccaaattttttctcatacagcaaaggcgggggaggaggcgtggcaaaggtaacttggaggaaaaagttaaaagtaaattgacaactactatttttaatatcttgtttgttttattttcttctaaacttacacaacaacatactatttttgttgttttct

SEQ ID NO: 97704 - DNA, 1079 bp, Homo sapiens
gggcatggtggctcaagactctaatcccagcactttgggaggccgaggtgggcagatcacctgagcaaggtgggtggatcacttgaggtcaggagttcgagaccagcccgaccaacatgaagaaaccccatctctactaaaaatacaaaattagccaggcgtgacagtgcatgcctataatcccagctactcgggagggtgaggcaggagaatctcttgaacccaggaggtgcaggttgtggtgagctgagattgcgccactgcactccagcctgggcaacaggagcaaaactcccgtctccaaaaaaaaaaaaaaaaaaatgtggtgccactcaaactttttgaggcttatcttctgccacttctttcttccttctctcactctctttcttactctgtccctctttttatatggtattctgtgagctaactagatctttctgttgcattctcacatctatctgttttaccttctaatttattctacttgaaaataccaaccttttctctttctgccttttgaaatcctgcctgtattttaaggcttgattcaattgccattttctaagaaccattcctagattctccaatgataaagaacttcttctttcttagtgttatcagagaacttgtttatctcctgtggagttgaatataatctgccttgtattataattctatttttctacttatatttataccaaatggtatatatcttgaagacccagactttgtttttttggtgttgttgctgttgtttctcttacagtgttttgtgcagaataaacatttgagatcagtgattgtcttgtgattctatgattgaaaactatgtacaaatagctcaaaatgatttcctaagtggaaacactgcagaaaaaataaagttaaggagacaaaaactaatcagttcttgagaagacactgatgtgcagaattataagaattctaattaatattctgagcaaccattcacttttcacctgacataatcatgtttagtttccagcaaactttcaatagaacttaacttttaaaaaaaaaaacaacaaaaaacaaaaacatgtttttaaacagct

SEQ ID NO: 97705 - DNA, 1050 bp, Homo sapiens
ttctcaacaggcattttttgtttcttaactcaagaccttaacaatttaagaatttagcactgctgagttcctgggccgcttgaggatttaactcctgttcactctgatcagcttctttctcatctagtctcgcttcccttctttctgcccctaccttttctgaaatagggtttcagaaggtagtaatataatttatataaagttatattataaatataatttatagttagctacttgtgaaccatctaactcatatgaaagagcacaatatactccatttgatggaaactatagttacttaaaagtttaaccagtttaaatatcagctatcaacatctttctctctttaatcattattgtaatcaaattactgttaattgtgccttttatcatgggaattttattactttaataaatttagatttttttccaagtttaagaaagaatccagttcacacttttttattctcttctccttctgtttctttgaatttagctgttgacagtgtcttgaagaggatgacaataattggtgtaattttatccttccgatcattggcacaagaagcacttagagatgtaagaaaccattacaagtatatactcggtatccaaacaatcccttttaatttctcagaaatttaaagttaagtttcagattcatgcttagcaatgatataattaaaattccagttttagtagttacagaaaataacatacataaaattagttatttaagctcattttttgttttggtactgctgcttgcagagtataacttgcgtggttattgcactactttttcagtgatcttcattatcagtagagtattttcaattttgactatactggctttaatattgaattattttgaatccatttaattttcatatgtcttgaaatttttgaaaaatcactgaaagtagataaagtaaaataatttttatgaaaactaaaattaatcaattggtaatattttgtaaatttaggggttgccatttaaaaataattctgtattcttatttgttatcctgcctaggtcttatccta

SEQ ID NO: 97706 - DNA, 1004 bp, Homo sapiens
tcttttgtgcttccttctccccatgtccatatccagaagtcaatgtgtttttgaaggagtttttcacagtcaacaagcacattctttttaaaagataaagcattatgattaattaaaagtaggtctgaattgggaggcaatctggaatttattagtttatttttattttattttatctatttttatttttaaattttttgagacggagccttgctctggtgcccaggctgaagtgtaatgacacagtctcagctcactgcaacctccacctcctggttcaaccaattctcctgcatcagcctcccaagtaactaggactacaggcatgcactaccacactcggctaatttttgtatttttagtaagatggggtttcacagtgttgtccaggctggtctcgaactcctgacctcaagtgatccatcctcctcgacctcctagagtgttgggattacaagcgtgagccaccgtgcctggccttattatcagttttaagacttctatgtgacttgggcaaatctccttatgtctgtttaatatttttttattctctgacattctgtttcttgggactaggttcatcgctttactgactccctaattccagactaaaaatatttctagttttcctacagcaattttttctttcgaaaactcattctattcacatacctttctgccatcatctacaaacctataagttgcctctgaagatctttactttagcagtactttggatgttattatttcctgaaattgttccaccagtaaaaatcttgaactttgaaattcaactctcagatcacagccatgtcttctagctctcccattcctttacacctattgaactccttgttctggctcattgaaacttttatgcctctcagctttcctgatcacctattcctggctttacatattttatccattctggactatgaaatttggttagtgcattctcccttatgctgtcatacccttgagtttttgctacattcattccc

SEQ ID NO: 97707 - DNA, 1442 bp, Homo sapiens
tgttgggaaacattactattatataatccccatcaagtggtaccataccataacaagtcattctccctctacttgtatgtatccagtaatactcattgtctacaggcatactctagcctgcctttggccaggtttaactttagctagtttttttgtttcagttggaatttgttgctatgtccattttagtgtctactttttattattgatgccgttcagcgtctaagtaagcataagatgattctttatcctactacttacctttgttgcttttcctgaactccttccttcttgaatttgtaaactgaagggaaacactaagcttatataaataattttcagatgcttttattgaaacaacaaaaaaatatatgtagcatagagcgtctggatttcatgaattgtgtttcctacttgccagattgtaatttccaagcatgctcttatctcattaacacaaagaggtctgtgcctgacctaggatctttcttttttttttagaaacttgtggtggagaatgttgatgtgttaacacaaatgaggaccagctttgacaaaccagaccagatggctgcactgtttaaaagattatcatgtgggtaactcatgatactttttataaacataagaagatcttgatactcagtatttagctttggctcaaaatttgtaacataaatacaagtagtaaattatgaaaagtactctttagcttatgaagagaactagaacatttttgcagtcaaaggatcatataagtgtgtgtgtggcttatctgtttcacaatttttcttaaccatactcttagtctactatgtgtcgctagttcatgaatattaccagtatcaatttggttttgaacccattaaatttaatacagtaaatctacattaatttagactaaaaggattagcttctgagcctgttaactttctaaaaatcaactttatacgtataagttacatacaataaaatgtaccatttaagcaaacggtattttggattttgacagatggatgcattcatataaccattgccacagtctagatatagaacagttccatcagtttgaaaaattgtttgctatctctttgtagttggtctcctaccccagtctctggccccaggccaaacaaccactgatcttatttctgtcactatagattaaatttgtgtctggcctctttcacttagcataatgtttttgagatttattcatccatgttgttaagtgatcagtaatttgtttctttttgttattagctaagattgatgaaaacctgaacctacaacttaaaaaaaaattgtaatgtcttcttgacattgattctttgtgggaggtatattgtgaaatcacagtgaatcttaagtattaaagtgtgttcaagcagataactgttttagatatacttgatctaatgttattttcttttgcttttttt

SEQ ID NO: 97708 - DNA, 1015 bp, Homo sapiens
aagataatgacagtaattttacagctttgtaataaattatttttaaagttaattttattgcttgtttaatattagataacagtaggttgagtggtttattttacatgaatggaaaagtcagaggcttttcttattcttctatcccttcttcccaggtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtaaggaatgcatttagaaatttgtagtagcggaaaatttgtaatgaagtacttaggaaaattaatttttttgtgaataagtacttattcatattatcagtcaacttaaaattatatgcaggaatgtatatcatgatacattctgaattaagcagtttcttccggttataagtttacgtttctccttaggtatttggaaactttgttacgacaagtcagcaatggccatatagcatattttcctgcaatgaaagcgtttgtgaacttacctacagaaaatgaattaacattcaatgcagaggaatattctgacatatcaggtgaatagtactataccacagtttagagaatgaagaacacttaattcttttgctagtgtcttgattctttagacttttgattctgttgtgactatttcattcaattatatgcgtaactgcatattgtatcttagaattacttttgcattttgtattctctctttcactctagagacttttatcaggattttacattagtttttataatgagatgttgtattgtgttaatgttcattttcttaaagtatttgctctgtcggaagtataaaattaagtatgttttctttcagaaatgaggtcattatcagaactactaggccc

SEQ ID NO: 97709 - DNA, 6181 bp, Homo sapiens
cacagattttaaatgaaataagattggaaacagtactctaaatctgtttgctttcacattatatgtttaatattttaacatttaagaactggatataggactttgtggaatttgaaaattaaatacatagtttttcatgttaagcaaaatactgatttttcaagactcctcccagttatacattgctttcacaatcaccaaatactttgtcatttatgttcaaatacagtatggtgagttagttgttacaagaggcaaaagcaatttttaacatctcccaccctcactattgcggaatgtacctttagcctaattttccatgtctatttagaagtctttttaattcaacgtactttctttataacttgtattattattattattctgccttcacagcgacatcatattggagatcgcagtctttccttatgtaatatgttcctagatgaaatggccaaacaagctcgaaatctcatcactgatatttgcacagaacagtgtacccttagtgaccaggtaatgatttaagtgtttccaacagataggaaattttgtgtgaaggcaagaaaatgtgcttttagccagttgttgttttactttccattctttagttcccacactattagtaaacctcaaacctctgctgtgaaactccattaacaggtataatttcttagatgtaaactttctggcaagactgtacgtactgtttgtgttctttaatcaggagtcacgtgtagtttttacatgtgtgtagtgttagcacctgattctgctatttcttgaaagttgcaaaagaactggaattaagcatatttggtgattttcaatccactgtacttataattcagattgaagctcagattgccccgtcattggctagtgggagtccttttttttttctttccaactttaagcatctatttatttatttatttattttttattatactttaagttttagggtacatgtgcacaacgtgcaggttagttacataggtatacatacgccatgttggtgtgctgcacccattaactcgtcatttaacattaggtatatctcctaatgctatccctccccaatttccccaccccacaacaggccccagtgtgtgatgttccccttcctgtgtccatgtgttctcattgttcaattcccacctatgagtgagaacatgtggtggttggttttttgtccttgcgatagtttgctgagaatgatggtttccagcttcacccatgtccctacaaaggacatgaactcattttttatggccgcatagtattccatggtgtatatgtgccacattttcttaatccagtctatcattgttggacctttgggttggttccaagtctttgctattgtgaatagtgctgcaatagacatacgtgtgcatgtgtctttatagcagcatgttttataatcctttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcttctccagcacctgttgctttctgactttttaatgatcgccattctaactggtgtaagatggtatctcattgttgtttttgatttgcatttctctgatggccagtgatgatgagcattttttcatgtgtcttttggctgcataaatgtcttcttctgagaagtgtctgtttatatccttcagccactttttgatggggttgtttgtttttcttgtatatttgtttgagttcattgtagattctggatattagccctttgtcagatgagtagattgtaaaaattttctcccattctttaggttgcctgttcactctgatggtagtttcttttgctgtgcagaagctctttagtttaattagatcccatttgtcaattttggcttttgttgctattgcttttggtgttttagacatgaagtctttgcccatgcttatgtcctgaatggtattgcctaggttttcttctagagtttttatggttttaggtctaacatgtaagtctttaatccatcttgaattaacttttgtataaggtgtaaggaagggatccagtttcagctttctacatatggctagccagttttcccagcaccatttattaaatagggaatcatttccccattgcttgtttttctcaggtttgtcaaagatcagatggttgtagatatgcggcattatttctgagggctttgttctgttccattggtctatatctctgttttggtaccagtaccatgctgttttggttactgtagccttgtaatatagtttgaagtcaggtagcgtgatgcctccggctttgttcttttggcttaggattgacttggcaatgcgggctcttttttggttccatatgaactttaaagtagttttttccaattctgtgaagaaagtcattggtagcttgatggggatggcattgaatctataaattaccttgggcagtgtagccattttcacgatattgattcttcctacccatgagcatggaatgttcttccatttgtttgtatcctcttttatttcattgagcagtgatttgtagttctccttgaagaggtccttcacgtcccttgtaagttggattcctaggcattttattctctttgaagcaattgtgaatgggagttcactcatgatttggctctctgtctgttattggtgtataagaatgcttgtgatttttgcacattgattttgtatcctgagactttgctgaagttgcctatcagcttgagattttgggctgagacaatggggttttctagatatacaatcatgtcccctgcaaacagtgacaatttgactttctcttttcctaattgaatgcgctttatttccttctcctgcctgattgccctggccagaacttccaacactgtgttgaataggagtggtgagagagggcatccctgtcttgtgctggttttcaaagggagtgcttccagtttttgcccattcagtataatattggctgtgggtttgtcatagatggctgttattattttgagatacatcctatcaatacctaatttattgagagtttttagcataaagggctgttgaattttgtcaaaggccttttgtgcatctgttgagataatcatgtggtttttgtcgttggttctgtttatatgctggattacatttattgatttgcatatgttgaaccagccttgcatcccagggatgaagcccggcttgtgggagtccttatagtcatttgagagctttcttgttatctggtgtgacaagatgtaccagcctttctagtagctctgtctcttgtgaagagtgttatagagattcaacactctggtctctttaatattgttgaagttgcaaatgtccgtagaaattttcattttaggaaggaactcctttgtcacaatagaaatgcaatgtaatttcttatgcatttttttccccaaataccaatcccatggctttagttactatctaggtataatgactaaataactttccttggcccagctctgtccaatggagatactatgtaaaccacatatgtaatttaaaattttgtagtagccatacacaaaacttagaaagaaacaggtaaagctaattttaaaaacaatgattcaaccctatataccccaaaatgttattatgtcagcatgtaatcatatgaatgaaatattgtatagtttttattatactaaatctttgaaatctggtgtttatcttataacacagctgaatttggactgggcacatttcacatgtggctactgtaatgtacagtgaagctctccttctacctaaaatgttatttcttatttctcatttgcctgctttgttacctgtcaagtgaaatcaattatttctgatttgtacctgtgtggtttttttgttttaattattggtcttaacaatgtgttaggtagaaacctctgtgtcatacttgattcctgcttctctcacacatctaagttactgaatcctttcaattttatctcagaagtctgtctcagatctgcccattaaaatttttttattacacttgcctatttcatatccctttttcatgccttgtctgaactatttctagcagctctgttacaattttcctttttcagtgttttcttctgccaatatcagagttatccttagaaaattacctcttcatggccaggcatggtggctcacgcttgtaatcccagcactttgggaggccgaggcaggtggatctcctgaggtcaggagttcgagaccagcctggccaacatggcgaaaccccatctctactaaaaatatacaaataaaattagctgggtgtggtggcagtcgactgtagtcccagcagctcaggaggctgaggcaggagaacccaggaggcagaggttgcagtgagctgagattgtgccattgcattccagcctgggcaacaagagtgaaactccttctcaaaagaaaagaaaagaaaagaaaatgtctcctcatgctgtggctattttaaaaaattgtcgctgtctttttgcctgcagtttacaatccaacctctagcttggcattcaaggcccttcctaatagttgaaacctctgtactttaccttacacgttatgctccaccacatagtagttctaactacagctctgaaccatcatatctttacacagtttttttccaaaggccatttaatccttccagtgaaatattctttttcattccttgcttgcctggtatgtttttacttgtctttttaatagtaatttaaataagcgtctatgaatttactctatgacgtgtttcttcacacaagatttacccaagatctacccgtttctgttttcaccaagctatgtgcattacccaagctagctaagtaagctctgtatctcacttatatttctgtcttttaatattgttgtgatatttgcaacacagcctggattcagctactgtttgcttgaatagttagtatgctttcagagtaattggtgtaatgtaagatttcattcttttctaaatttagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaagtaagtatccacttatattatacctttttgctccaggtaaaatatttatttcatttttttctattgacattagtactgaggaaatgctaataattgtatattcttcattttccagccattttaaaaaatatttctgagcttaattaacctgttagttgcttatttcatctcaaaatacagattttggcctttagaagaaaatatatgtaatagttgatatttgtctttttatactaagtactgaaggccaattatatgtttaaaaaattttgtgtgttacattataagcaatctgtaatttttaatttatttaaagttagatagtggagactttattttggcatgtttttgatatattagaacatacccaatgtcattattataaaacagaaataacagaccaggtagcattcagggatctttgcttgcttcattgtttggaggggaggtgtaggtgggtaataattcggtaaatattttttgtttaaagtatagttcctactttcttgctaaattgagcaagccattgcccttttatagacaactttccttctctcataacagaaagtacttcaggaattgggcgtgattatctttatgagtgcagaataagctctacctttgtatattaagtcagtatattcattactacctaaaggtagaaacaaatgacgccatctttagaatattgctcttatgtgttagttataaccttaaagattttgaactttctcagtttaggagaataaaaagtcgaattctctaagcattatctccaaataaggttgatatatttataaaattaattttgtattgcctgtgatgacatgtgaacattttaactgtttattaatttttttcagccttgataaattgcacactgcactttctgagttatgcttctctataaattatgtaccaaacatggtggtatgggaacatacctttaccccacgagaatat

SEQ ID NO: 97710 - DNA, 2660 bp, Homo sapiens
acttgggaggcttgaagcaggagaatcgcctgaacctgggaggcggaggttgcagtgagccaagatcacgccactgcactccagtctcggtgacagagtgagactgtctcataaataaataaatacataacagtggggttaggattcaaaatcaagaattctcgcctcaagctatataatatcaactctattttctgcttcttggccctttattttcctttagggaagaggactggaataacctagtatgtctcttgatttctaaaatgctgaaatgatctcagtggatagtgatagtagtttctatgtatgggatagagatcatcatgaaaagcttctcactgcatttattttggaaaatagtataatctgtgttgattttggcagtttgttaggaaagcttgaattagcagtattgcagaagaaattcaaatcaccaggtagagaaaccatgcctcttaaaggaaataatgaaacacattaggaagtatactttttagatttaggcacatcacaggtcaaatttgcaagaatttttaagattatgtggagcccaggactactgtctgtctggcacaaagtctaccttaggtagaacatgaaacattatatgtttagatattttcagctatgcaaaggatcctattccaaaagaagaatacaacaattagaaagtcatatcccctttcttggaactaaaagcactttgaataatgtttgaaatttgtaattttcagtcatacctgaattttatttatattttttcatagttgcattctatttttgcctgtcacatccaaaataaagaaatgtttactacttctgtttgtcttattactctaagatatgtagtgttttattgactcacattcttttacatttagatttaacatctttaaatgtggatgcaaattaaaactgctggcaggctgggtgccatggctcacacccgcaatttcagcaccatgggaggccgagatggaggattgcttgagcccaagaggttaaggatgcagtgaactgtgattgtgccactgcattccagcctgggcaacaaagtgtcccccgtctaaaaaaagttaaaaaaaaaaataaaattgatggcgtgtgattatttaattggcaatgttttttttttcttagtggttcataaaatatttctctctttttttaatttattttttaaaaatagagacagggtttcaccacattgcccaggctggtctcaaactcctgggctccagtgatccacctgccttggcctcccaaagtgctgagattataggtgtgagccaccacacccagccataataatggtattttttcctatttatagtgacttagctttgatgaaatttgattatgtaagaggccatagattatggtttattattttttaaaatgttgttattgttatataaataatatttttattactctgggataattattggtgtgtaaaagatactttgggggaaaaatattctcttcttaaatcagtgctaccagttatcattcattcacttgaatcaaattaactgtaaggtactatatcagaaaacttactttaaatgtaaaaattgtgattctgatttttgtttatatagtttttatagtcgtgcttttgagaagatgtttcaacagtgtttggagttaccctctcaatcaagatactcaattgcatttccactactttgcactcattttatgagttgcacgcatgaactatgtccagaagaggtaattatagtgtactactgtgagttatatggtatgcaaagtaaactagatcaaacctgtagccaaccaaatatttacagtcataattagctaacttagcttcccatcgaatacatctctatgcagaatcagaaaagtgcttgaacagatacataggtttaatatatatatagataaataaacataagtataataagaacataccataaagtcacttggaattaccttttttaagataaatggtgggtcaggtattaatatctgtggaaaagatttatatagtaattgattttgtatacttaattttcctcttaaactgtcatggaaaggactcgaaaattaaatttatggattactgaataagcataaacaagtcaaagagagattcactaacttattattactaaattgttaataaatatattaagcaaaatccagattttgtgatacttgtgggatacatacatgcatgtgcatacacacacacagttgcagagtaattgaactgcttggtagttttgttgatgccaagtatctgtgaaaaatgtactcagtgtttcttctaatctttaaagaagaaatattttctatgtgataaaaatataaagattaaataatgtatttctttattataatttaacttagtgtttagtccctttacttaaaattgcagaacttgtagaaaagaaacttagagatagcaggaacatggtcagtttctttaagcattagacaacatctgttgcagattgtatgccagtattccaggggaagccaactttgagacagaagttagcttacaggaagtttattagggaatactttcagaatttctacctatgaggatattaataccacgaattttaatagatttatgaattttttagatttaatagatttttttctcccaaacttgacac

SEQ ID NO: 97711 - DNA, 1050 bp, Homo sapiens
aacaatgccctttataagaaaaatacttttagaaataagattaagggcatcgaatatattctttaataatgatgaatttattatttgaatatttttcttgaaattttaaaaaaggcacattgctgaattaatattttacatggaagaacttagagcacatgtgaggaaatacggacctgtaatgcagaggtattacgtgcagtacctttctggctttgatgctgttgtcctcaatgaactcgtgcaggtaaaaactatctcatactatttcccttttgttccttccttcccacctttgatagtattttatttgtttgttcaacaagcatttatgaaatatcatgtgccaagtgataaatcatgtttatattttggagatcattacctagaagggaagaaacagttagttgtagtccaatgtgataggtgttatgcattaagtatatataaagctcagaatgaacacaaggaaagacacaattatttatcctgaagatggaggtgtacgctaaccaaattacagagggccttgggaaagaggaggttaatcataaatcaggtgtactacttaaaaagatcaccctggttcagtgtggatggtagattgctgggaaccaaatgaggaggcagagagaccagaagaaaaatgactgcagtaggctagatgagaggtgatgagagtctgaacatgggcagtagctatggagattcagaagagatgatagagacaatataattggtaattaagtattagagggaaagtagaataaaaatctttttgaagaagattgttagaggatggccagtaaataaagatttcatatagacattcccatttaaatgtccaattttttttccttaattggtttttagcctttttttgctttccataatttatttattcaatatttttcatctttatttaaatttaaaaaactttttattccaaataaactgactctaaggaaataatattttattttgcttcactttatagaattacatgtttcaaatgactgtaagctaatacatagtataaagaaaacagtt

SEQ ID NO: 97712 - DNA, 1300 bp, Homo sapiens
tgttgcccaggctggtctcgaactcctgagctcacgcagtctgcccaagttggtctcccaaagtgctgggattacaggcatgggccactgtgcctggtcaccatcaagaacttcatagtctataaagtgcttaaagctacatggtactaaaattggataaattattcataaataaatagctagatgttgggaaatgcttcttgaaggactggtcttgaaggttgggtaggattttgatagatggagaataacaaaagaaacatagtttaaaaagcaacataagaaaggcaggataaatgtaagattagaaactcacttaacgatagacacatagaagatgatttttataggaactttggcttcctaaaaaaagactttggaagttgcacctataatgctagttactttaattgccaataataattttagtagaagcagataaactattatggtgtctttccccatagtggttcaatgcacagagaaagacgcaagtttttaagatctgcactgaaggaattggctactgtcctctctgatcaacctggattgctaggtcccaaggtaattcatttaattattatttcaataattgtgccatattaaaattttaaaaaacgtttctaagtgaaattttactgaaatttgagtcagggactacataaaaggatttttatatttagtggagaatgaatttgctgacttgacattcatacatcgtacctccctgcattcttctcccttatatgcatgctctctctcatacatacttacaggttctcttgtgtcctcttctgttagtctcttcactcttttgaattgatattatcacttcttgccaatgacttttcacatagaaagagattaccagttttgtttttaatctttgaataagaataaacacttacttttttttaaacaggcactttttgtttttatggcattatcctttgcccgtgatgaaatcatctggctacttcgtcatgcagataacatgccaaagaagagtgcagacgactttatagataagtaagttagcaacatttaaaaaaatattttctgtatatagatgcttcttgatttacaatggggttatgtcctgatagacctattgtaagttgaaaatattgttaagttgaaattcatttagtacacctattattactgaacattagagcttagcctagcctaccttcaatgtgctcagaactcttttattagcctacagttgggcaaaattatctggcaacatagtacactgaagagtataggttgtttatctttctgatcacatagttga

SEQ ID NO: 97713 - DNA, 1262 bp, Homo sapiens
cctcagttttctccttcacaaaacctttttatccaaacagtcattacttttgatcactaatatatatcctttcagaattttttcatgcttaaagatagacttgattaaaaagtcagaaatgatagctttgtcagtactttagacttttggaaatcacttctgatgttaattacatcagaagtataatttcagtgtctccattggggcttaaggaagtaataacatttaataaaatgaaaatctacattgtgaagtttaattttattgttggatttaatataatgttacttttttttttaggaaggcttgactggacatctaagtgctaggaaaaagtgtgggtagattcttccatgcacttccagtttgatggccagtttctgaattgataatgtcatttttaattgacttctagtattagacttactcattttgacagttattgatcaaattaaactaacgttctaatttgtttttgcacctagctataataaacgtattaatgacataagagaatgcaaggaggcagccgtgtcacatgcgtgagtagttttattttatccgtggtagctttaatcaagaaaaattcttaaagcatcattttgttgaagtgagtacagattaatagtatgcaagatatggtagtagaagagggggactttcagtcaatgagaattattaagtatattgcctcaatatgtagaaccttggaattagtgaagtcagattttaaatgtttttgaagtgttgataaaatgctataaggaagtatcacacaaaggactcttactttgggtataatctcactgccactatgctctgcataccaatatgatttttgtactactacatgaaaattaatatatccatataactcttacagataatatttacttttttttttttttttttgagacagtctcactctgtcacccaggctggagtgcagtgataccatctcggctcactgcagtctccacctcccgggttcaagcaattctcctgcctcagcctcctgcgtcactgggattacaggcacccgccgtacattcccagctaatttttgtatttttagtagagacaggttttcaccatgttggctagactggtcttgaactcctgacctcagtgatcagcctgccttggcctcccaaagtgctggcattacaggcatgagccaccgtgcccggcaaatatttacttttaagagtacacctctttcccaattttaatttcttatattagtaaatatatagatatcc

SEQ ID NO: 97714 - DNA, 1922 bp, Homo sapiens
agataagctttatttttaagttattataacaactgtaatgattactgcattatgttaattagaaatttctgatctttggttgaaaatattttataaatgttatttttattaaaatgacttggttcataacccagaagtgacatttttcccgttttgtcagttcaggttcaaataactggttttgcagaatacagaaaattataattggaaaagaaacgtattaccatggtttatacatatgtattgttactgtcactcagaagcctcaatttagtgatcgtggttacgtttctgtatttttcaaaagctacactgtcaccaaactttggaatacttgtacatttacatttgtatttgctttctttttatttaaagttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgagggtatggcattttcatttattttgtcttttttggagaagggtggtgagtgagttatctttactgaagttttggggataaaggagtagtcacactgtgcaggaagatacagcctataccatctgacttggatcccaggaagttgtttttaacagtcatcctgatagttaataatcatgttttttacaggtaacttcacatattaaaaaaaaactgaggttacctgacctttcaaaacatgtaatataggagaaggaagatatgtcttcttttgcaagtcatatatgattttagatgcaaaagtaccatatacattttagaggtttaaaatttttataagtgttattttagaatagggtgtacttgtaaaagtatatgaagcaataaaaaatagttaattggattaattataaccattacagaattcatatcactgcatgtaggaaatcatgttgtttttatttaaataatagtattccacattatttattttcatttatttccagttcagcaaataattatctgaaatgtgtttctttgaaatttttaataactttatttctctccacttgagattctgtagccaatatataaaagccaaattgaactcagacttggtggcaattatgaaatcttttaaaaatatctaggatctgctatacttatgttgaatatataagttgggcttcctagcttcagataacagtgaaatttgcttatatttatttcacatccagttgaataatgacttaatgacattgaaatgaaataaaacttctagatattttaatgtatgtgtatatgtctgacgctaaatgtaagccaatatatcccacattttagtgtacataagaattaccccgaaatgcaaattgaaatccaggttcctgagcatcacctctaacctcctctatctgtgtcttggagaggttaaaggaatctgcccttttcttcccgagtacttttttgagagaaaatacaaacagaaaaatacatacatcttagctgtataactcagtgactttgcatatgaaaactccggcatcatcaccacttaaatcaagatgtaagaacatttccatcatctctggagaattcttttgtgcttctttctggtcggtactgccatgcctagtccccactccccccccactcctttctcaagtgactactattctgatttctgtcaccatactgatattcttatggcagtgatctgtcagtcatatgataaatagtgccctatgtacttttcagctcttattttagatggtggaataccctgaaatattatgtgcaagatgggctttgtcattttctaattgatttagattgaaaatcatgaaacttttattaatatcatgtactagcatactgacaaactcattgtaga

SEQ ID NO: 97715 - DNA, 1008 bp, Homo sapiens
gagctgagatcgcaccactgcactccagcttgggcaaaagagcgagactccgtctcaaaaaaaaaaagaatcactctttacagaatttttaggaagcagggattaatagcaaaagacatttatgaaagcaagaaagaaacagttgagatgaaacgttaaataccttgataataaagctgtaatcaacaaacccgttgataaagagaagttaagtaatttattaagatgaggtacagtgtattatttttataagacattctttagagaaatataaagcatgttgagttttattaacacttagtcatataaccctgaagtctttttcttttggaactatcagaaactatcagaatggaaacttgcattggcaaaaaggtgacagtgggctgtctatcccttttggaataaagttcccaagattgccacgtattttaacctttaagaaaataacatgagtttctgacctaagcttttgctcaaaaacgcagaatctgtgtagcttttataacgttagcaaaaaaattctagaggagaggagccacaacccaactcagatattataaggagcatgggtataattaggctgtgttgttttatgatggtatagttagaaacacacagcaattatagctgcaatgtaaacagaaaaggaaagaaaattattcttcagcttttttttcgtattttaattagtctctttcagatgcactaatttctcttcaaatggtatatcctcgaaggaatctttcagctgaccagtggagaaatgcccagttattgagcctcatcagtgcacctagtacaatgcttaatccagcacagtccgacactgtatggttctatttttctcttttgaatgaaaataaagtgacttttaaaaaaataatagttcagtaatgctgttgctgtttgtttctaattagcattagcttattagttgaagttcattataaaatgttcactacttaagtcatattgttcagattttttagctttagagtcttaatg

SEQ ID NO: 97716 - DNA, 2463 bp, Homo sapiens
ttcaacatttccctctttcatgtcttaactctagttttgcttctttctcatttcttttttgttgttgtggtttttgcttttgtttaatatattattgtgttttctggatctggtcagggaaccgttaccgtattttatgtttgtatctacattttattttgcatgcgtaacgtggctttacctggatgttctttttggtaagttccaaatttatatagcatattgtttttttgtagtgtgagttgtaatgtttttcaccttcttttctcccacttctagtaatgtgatcatgctcatgacttgtttttaattttttaagagttcatttgatactttttttcctaacactttcagattttccttaatagtagcgcaatttggtactaatatgctttgatttgttttatagcctcacactgtcagttgctgatcactattagcagttgctgtctcgagtactttggttttttaaaaagccgtaatcatctagaaatattctaaaagcttgtgcttccatatagcagtcataaaagaagatagtttgtagtaaaattaaatacttttgttctctatgagcaatgcattctaattttgtttttacagcaacagcttgcacaactacagaaagaaaaatcagagattctgaaaaatctggcattatattacttcacatttgtagatgttatggaatttaaggtatgtattttaatatataatatttaacacttcagaagtagatttaaatgtttattaattgtgtgaattgctgtgtcagttgtaaataataaaattgaaattcttccagaactgaagtttaacacataccttatttgtttgtgttttctgaatttaaacagatttatacagataaaagattaaaataagtatttcttttcaggaccatgtttgtgaattgctgaatactattgacgtttgccaagtcttctttgatattgtaagtatcattttcagaaaaatgtccaattattctgtttccagaagagctcaggggaccacttgcttttctttagctagattatgtaactagcatataaagttttagcattattaatttggcttgttttatagcttttttaaaaagtaaagtgtgtattctttttatttgttttgattgtcactgagtataagtcttgtacatattgggaaatacacgttaactttagtattttatttaataggcccaattttgaaaagttaagtggataatattttctctgtaaaaggcatacttgatggactctttcttagtatgataatttttagatacaagaagtcaaagtgaaaattgtctccatttacttaatggtgaactttaaaaaataatttttttcctctttcgtgagattggcaccagtgttccttattattctggcttttattcttttgaactgttaccagtttgaatatagtgatcacaagctctttttctttcatccataaaattgtgtcagacacaaaactgttatctgtaactgtcaaattttagatgtgcttttagtgaaaggaattagcattttagaacagggataaaataaatacagaaaattattagctctcaatagcttctatgaagattttgtgtgtgtttaaaattttaagaaataggaagtagttgaacttgatttttttttctcctagactgtaaactttgatttaacaaagaactacttagatttaattataacctatacaacactaatgatactgctgtctcgaattgaagaaaggaaggcaatcattggattatacaactatgcccatgaaatgactcatggagcaaggtagatttgcattataaaagtctttctaaaatgctcagtttgatggattacaactcattgaaatttgatatgtctgttttaagtgacagagaatacccacgccttggccagatgattgtggattatgaaaaccctttaaagaagatgatggaagaatttgtaccccatagcaaggtaagaggcagttgttaggcatatgagagaatgggcatataacatagcatgaggatggatggttggataaagggataatcttgtttttgaaaaatactataatgggatataagtaatagttatgtgtgcttttatctaattatagacagggaactaattaatgagattcagaatagtgtatagagactcaagaatatattgattgatttcattatagttttttagattttaatatagcactaaacaataggatttaccatatggtatttgagagggtctgttctcacactaatgggttttaatagcaattctgcaaattatagtataatatttgtcgagttacttaactaacctcacgatacctcagttttcttatcagtaaaaatggaataataatagcacttatttcatatggttcttatgagaattaaatgaattacttcattaaaaagtacagtgtttgataaattttaactttattatagtc

SEQ ID NO: 97717 - DNA, 1761 bp, Homo sapiens
agcttcctttgttattcacttaatatttaatgtacagcttctggctgtgaggcattgctacatattcttatgtacattatcttggttaattgtccatgtcagcttccatttcgatgaggagggtattaggctagagatgttaagtcatttaaccatggttgcataataaggtatgctttctagcatcacctaccaaaacatatcatctgacactggtagtctttgaagtttgtcattataatcccttatctgatagatgtttgcattggatacttcctttgtccagaactgtatgatatggactggggaaattaaaacttgagtttggtacactgtctaattgtgctggagatagctataatagaagatagaaagtgatagctgctgttagacattatacatgtttagaggagggagatgttagcatttcagggaaggagtgcaatcaggtgcggttttctgaaaatgggattagcatttaaactaagtgctttaggaatagtggggttgggacatgtttaaatggtgggattctgacattccagtagaggaacagtaagaaagcaggaggtgtgtatagaaaatagtgaatagattgttttggctaccgtatgtagtgtgtgaatacatgtaggggaaatgtagattggaaaagtaagttagggccagattgtggagggccttgaaagctagactgttttgaatttaggcatctagtagttgtttgataaatgtttgtagctaagtagagtctagttatatatggctttgggggaaataaagttgaatgagaaatgtagcctatgagattgtattaaaaagggagatgatgggcatgtagaatggtagaaagaacactttcagaagtaaagagatgagatttccaatcttggctctgtcattaagtagttgtaactttaagaaggttcttttaaggtctgtaggtcttaggttcttaatatggaaaatgaggtttgtatttaagaccatttaaggctcatagtaagatggtgaccgtattatttattgttcagactaggacactgaagttggaaggaaaggggacacaattagtaaaattatactagggcaactaaaataaattgggattattaagcccaatataaaccaaattatacccttcatatcttactattatgaatgtactttcacctgttgtattttgaaactcaagtttaaagtactgaaaagcaggaaaaaggactaagacatcaattctaaatgtttaatgttgtcgaataaggtaataagtattcactttatgtttttggagtagtaatgattaaaatgtgcatataaacatggaatcgttctgaaacagataatgttgtgcaaaatagagtcagctactctcagatgaagctaaaaatagtcactacaagtatatatcttaatttgtctggtatttaggggtagtaatgaaatatttcatttgtgaatattttcttttttctttttttttttttgagatggagtctcatctctgtcacccaggctggagtgcagtggctcgatctaagcttactgcagcctcctcctccctagttcaagcgattctcctgtctcagcctcctgagtagctgggattacaggcatgcgccaccatgcccagctaatttttgtatttttagtagagacagggtttcaccatgttggtcaggctggtctcgaactgctgacctcaggtgatccacccatcttggccttccaaagtgctgggattacaggcttgagtgtgaa

SEQ ID NO: 97718 - DNA, 1133 bp, Homo sapiens
gatgccataggaggggagtagtaggggaatgaagtgatatgactgtgatcactatggctactcggtagagaatagtctgcaggagagcaaaggtgaaaatagggagaatagttaggaaatttgccatcattgagatgagagctgatggtggcttggactagggtggttgaggtgagaaatgttcagattctggatatatttttgaagacagaacctatagtatttgctgatgaattgggtgttgggtgtatggacagtgagaaataagactttaaggtttttggcctgaactcatgtcaagatataatggggtgagagaacaggagaaataggtttggggtagtgcagtgggagtagtacagtgaatgcagtgggggaagtactcagtagctcaatattagacgtgttaagtttgagaggcttactggaaatctgagtggagatatcaaatagccaattgtttatatgaatgtagatctcaggttaggtttaagctgactgtcaagttgaagaagattattgagggatttgagagagagagaaaggaatggaataatcatctaggacagtaggaaaatgaattgacagaaaagtttgagtagtattgctactcagttgtggtcaatgatcatgaaatcaggttgagatcagagtcagcaaagtatatgcttttctgctactgtaggttttatcagacagttatgaaagagggagggaagggcaaggcagtaattataatgatgggccatttaaagttaagatggataagaaagtagggggcctgggcacagtggctcatgcctgtaatagcactttgggagactgaggtgagtggatcacttgaggtcaggagttcgagaccagcctgaccaacatggtgaaaccctgtctctactaaagaatacaaaaaaaaaaaaaaaatagccaggtgtggtggcgtgcgcatgttttcccagctacttggggaggctgaggcacaagaatcacttgaacctgggaggcggaggctgcagtaagccgagatcatgccactacactctgggacagagtgagactctgtctaaaaaaaaaaaaaaaaaggcgtaaggggatgagtgacagtaaaaagatggtagagtgaatggataggaggt

SEQ ID NO: 97719 - DNA, 1037 bp, Homo sapiens
cccatcactcacattactgcctgagctctttctcctgtcatattagcagtggcattagattctcataggagtgaaaaccctattgtgaactgtgcacacgagggatctaggttgcgagctcttgaggagaatctaatgcctgatgatctgtcaccgtctcccatcacccccagatgggaccatgaaattgcaggaaagcaagctcagggcttccactgcttctacattatgataagttgtgtaattatttcattacatattataatgtaataatagaaataaagtgctcaataaatgtaatgtgctttagtcaccccaaaccaccctccacccctccgccccagtacatggaaaaattgtcttccatgaaactggtccctggtgctaaaaaggttggggactgctgctctagagctgaattctagctacccctttggacagctccacaagctaaacagaaaactttttatccaatatggaacatgtgattatcctacctttttttctcttttgtgtttccccccttgagctgtcaccatccacttagttatttaaactacaaccttcagaatcccttttgacttgtaaaaaatatcaaactggtcatttacgacttgtccgggttccccactataatgtcatttgaatttatccccttcaggtctacatttcctgccgggacaaatgccatgttaatccaaacattgatttgtatgccatccaatctctcctactttcgccctcccttcctccctccctccaacctccaccaggggaagcagaacaaaacaaaaaacaatcactttctctgtggtaccccacatctgcatcttcctggaccacgcactcatctttgaatccctcttgactggcatgtagtaggccaacaaataagagtttggtttagaaggaatcaccttactgtaaaataatgtaactgggagttgtaacagcatgctgggagttgtaacagcatcatgaataaatatatatgccctaatggaaactcaaaggaatatttggtcccgaccaattaa

SEQ ID NO: 97720 - DNA, 1121 bp, Homo sapiens
gtatttttgagctgaaagattatctaatttatctgtaatataaatgctttcattattttgaaagtgtaactctcaaatgaaatttgtttctcgtaggtttcttaagggtacctggaggggaatctgttattttcctggatgaagaaaatagtagaaactcctttcttattttattaacacatacaaattatttggctcaggaaacctaaaaggcaatgtaagcaaatgttcaggtgtatgttaaaacttttctaattttttttccaatattttttaaactttttttttctctttcctatattgcattacacctaaaaggtagtttgtgttttttaaaacagtaaaaatattatctggcacaatagtgttattatggaattagcctattgcacattttaatgtaaaattttggatttgatatccaaattaatgaggaaatgataaaaattactatcctatgtatgctgaattagatcttgaagtctttaagaatagggacattgctggcgagtagagtgccacaggagtgatatagggattctagactaggacacaggctgttgttgaaataatttgaaaattatgttttcctaagttataggaatcttttatgttatagatattatttatcccctctcccaaggaacatagaattataagatgttatgtaaaacataattttttattgaagtagcttataaagtcactctaggaaagacaaagcaactctaagtgtaataatcagcagtaaagttagttcagaggcgaagcaatagagccttttaaaaatgttttatccctagtgcctgacacataagaggcactaaataaatgtcccattaatgaatggaactatttgatacactctaacataaccagctttcacttgtattcaaacattgctttagatttatgtcaggacctgaacttatccacactttttaaaagttatggagttaatgttagctaaaaaaagattgtactttttagtagaactattcagatatatcttattaatggtattattgaaagtcacccagaaatagagcaagagtctcaactcctaaaaacataaatgtgttttaggggtggggtggtggaattggtgataggtgtaggga

SEQ ID NO: 97721 - DNA, 1084 bp, Homo sapiens
taaaattgtagcaccatataattctaatcttgttctgttattcatagtctgcagtgcataagttttcttctgaaacgtatatcatagtttgacaatcattgtttacacgtaattttctctctttttattacaatgcttccccagcaaggacaagtttggaaggtttgcaaagcttttcaccttccctctgcccgcttgcccgctttcagatcagtttcatgtttcataacttctctttctgcaatccacaacatagccatagtaaacaatggaaaactataaaattgcagtagtgtatttcctcacacatggcagacagatgtaactttccaaaggacacatccttttcaaaatgcaataaaaagaagttaaatagaaatgttataattttagtaattccctaaggaataacatctcgctagcaagcagttaatttaatgtcacgtaataaaacaggaacagtattcaagattatattctgtattgtaatagttcaggtagaaagttctttctaataataataccttacatttgtatagtgccttacagtttactgcagagaatgctgtactgctgatacggtcaaaacgtaaacatatccatttgttctgtgcttatgatatatagaacagatgtagattcattgtttgaagtgctgctggtatgatggaaaacagtgttgtaactcagatgttcagagaataagacaacacaccttagcactataaagacaattttagcagcttccagttcttttgaactagggctcttgtattaaaatgtttaaagtgaatgaggaaaacattttggaaaagacatttaaacataagcttttattttataacacttagaaagaaacatgtctagtactctactgaatatttaattttgtaatattttattagcttcagatgaatacaatcctacctcaaaccaagaattttttttctttttcttttttttaggtttgagctttttccttcactgctgttctgcgctaactgcttcgaaactttccatgcatttttttcagtagaagaacatctctgtactgtctcccattgcatatttcagctgtgacaat

SEQ ID NO: 97722 - DNA, 1001 bp, Homo sapiens
attatttgttatggttctttgccaggatatattttacctagctgataacttttagtcatgtcagtttatttttttcatagacttcttcttttttgcctaagtattccccatacaagtgtctctcttgttattaagcaaataaatcaagtaagtggattttagaaaaaagataagatggggcctagtacttctgtatgtattaacctcttatttttaattggcattttttgggagctcttggtatgccaaatactctcgtaaagtctacaggtaacactttcatgtagtgaacataaaaactttttagcataggttgtaattattatctgtttaacagttgaagaaactgaggcacagatagaatgacttgctcatgggtacacagctaagtgatggtgccaagattttaaacatggacagcctgtcttgaaactcaggttcttaacaattaggttaaactctgtacagttacagcaaatgtagactttaggctgtatttaggctgtatttagatgtttaggcttaaagtgaataaaggaaatatttgattgagagaggggattgtatttaatagttgcataaggaagttaacactaacttgctagttgtatatatatattatgataaagactgttactatgattactattcatattagacttggataattattatcatcattatagctattattaaaaagcagctagcatttttagagcacttatgtgcttatcattttgctaaatgctttacatggtttctttatctctcttctaatccttataataaccctgtgaggtaagtactaatttccccattttacagacgaagaaacataggttaggagatattttgtaatatattccaggtcccatggctagtaagtcatgaaaattgaaactcagccagttttattccagaatatttgtttttaacctttgagacatactgcctcccaattaagtatgttagataaggtccactgagcagtgtggaaaagg

SEQ ID NO: 97723 - DNA, 1620 bp, Homo sapiens
gcgctgggcctcgcacggggtgggggcgccgctgggagccgggagctgtcccctcctcggcgcccccgcccccatgatggggcccataggaaagggagggtggtgggtgggcgaaattctaggtgggtaggaaaacttgagtgttccatattcttacggagatggcagcagtgaacagggattacaccccacatccccattttttggtgtgggaatgtgggtagagaagggctgattggatgaatcccgtatcccctccactttgccactttattttagattgctaaataaaaagccattgagagtgtgttgacgatttgggattatttcattttgaaggtggagaggagggggaagtgagggtggaaccaattttctgaaatacttctaggctgtgagtcactagaactggaataacaaccttctactctttcccctgtactcctcctcatgttagattttccaataccatttcttaaagttcggtgtctgtacaaaataaaaaccgtaaaaatgttgcaattgctgctgatttatagcatagtctgataatttgagcaactatagctaataggcccatttaaaggcttttacatgtcctcagtacagtaaggagtggaagaccactggaagtttagaaaagtccatgtaaagatagaacaaataattacattcattatcgtaggacaaaacaacaaaatctctccccttaaggcaaggttggtaagttttaaacaatttgataaagagaaaaagagatatttggaaaatttagatccatcgagtttccaatgtgtctttgatgtcataccttcataactatttgttggctttttaatatatcgtgaatgttaccgtttagtttaatcatagcaatagattgtaggttgagagggcttctgaagaaaggtttttttttttttctttggaaattcatttccaagcgtttgagtgtaaaattgatttattttttacaatttgatgtagacactaattctaaagagtgtcctggtttaatgatgataaattttggataaggacaaagtctggttgctcacctaattgcaaggctttattactctaaacccagtgctatctggagagtaactgcaacatgcttactcagtttgttaccttttatgtggcaggagctcagtgtcatgacaaagaagcccctctgcatttaccaaggagcctaggttataaatttatataggttaggaataattcagttttaaatagtattacttagaggttgcattgacctgaactgttcggggagattgtgctgcttaaaaaacttggaaattgattcctatatgaattttgtccaaaaatgaacaagtcaaatattataaaagttactagacctgtggtattgtggtttaaaggaaatggttatgatggtttctaaaagaggaagtgagagtaacatcaaaagtgatttgggtatttgggcaaaataccttttctaagcatttattaaacatttttgtaggataaatgcaatcaaactttaatatcccaccttcataaataagattaaatgaaattctgggcatttgaactctaataattccagttcattgccttttctcaaaagcactgtttttttcactt

SEQ ID NO: 97724 - DNA, 1706 bp, Homo sapiens
caaacaatactatggtgaacatccttacagctaatctttgcaacatctataacttttaggacaaatttttagaagtaggatttcagagtccaggagtttatgtaggatgactgttatcaaattgcccttcagaaagttggactaaggtccttccaagttgttggtcttttttttttaataacagaattgctgtagaaatttatataaaagttcaagatgattatatttgtgttcaaggtggtatcatttatttcttctagggtcacaagatgctgctcatgatttggatacactgaaaaagaataaggtaaaaaaatgctttaagtctggcaccatatacacagaatattttaattgttttatttaggaaaaactgtattggtccatctttggtatattatggagtttatttggtaacattttggctatcatttcaatagagttgaaaaataattggcacataattcaaatatgtggatctgtaatctgtctttccagttttacattcttcttgatctccttcatgtaccctcatgaacctgaccttggaggcatgtctttcttgcctgtgtttatgtagttcctctgtgtgggatagactttccctcatctctgcttgtccaagacctgtccataccttaagtcccaactcacataccacgtcttctgtaatgccatttccagccactctactccatacaactgatgtgatttattacatatttactcaaaaggatttttagccctctaccatttttttgagtactgtttcaggtcatggaattgctgtaggtgaaggagtgcaagagattcttgttcacttgaagcgtatgacctaaggggcagacagagaagagagacaagcagctaccgaacagcgtttgtgtgctttgatggggaagtgcagggtgctgtagaagtgcataggagatgatgctcttaacccatgtttggtttggtttgtttttggggggataagtgagtcaggggagacttcctggaggaagtgatattgaagtatttctctgaagaggctaggaaaggagtagacagcctgtaatcccaaggctttgggaggccaaggcaggaggattggttgaccccaggagttcgaggttacagtgtgctatgattttgctactgtactccagactgggcgacaaagcaagactctatctcaaaaaaaaaaaagaaagtaaagtgttcatacagaataaatgatatgtgtgaaggcccagaagcaagagaaaggtggatgctttcagggacagaaaagttcagtgaccctggaatagagagtgtgagaaagaagggcaccaagagacaaggccagagagagaggtaagcatgagccagatcacaaaaggccatgtaagccaaagttagttgtgtggacttgatccaaaagactatggaaagccactgagaagttacccagagatgtaacaaggtcaaatttgcagttcagaaagatttctcattagaagcagtgtggaaaatcgattggagggttgctcaagttagagatgggggaaactggttataaagctattgcagtaatctaaggaaaagatgataatggctgagattaagatttagtggagatagaattagatagatgtgaggggttttttagagggtagaattcttaaaatttgattacttatgaggcaggatagggagtggggctaagggagaaggaggag

SEQ ID NO: 97725 - DNA, 1024 bp, Homo sapiens
taaggtgactcatattcttaatgttgcatatggagttgaaaatgctttcctcagtgactttacatataagagcatttctatattggatctgcctgaaaccaacatcctgtcttattttccagaatgttttgaatttattgaagaagcaaaaagaaaagtgagttttgttttgatccatagttctgcagaagcagaaatttgaaagtgtggatccattacccaatctttattatttttataatgaatctctaaaaaacaattatgaaatttcccttctaacaatatttcattatttcctacaattatttggttaattgctcttttttcaatgagatgtttagtttcaacattaattcagactataaaacagagactgctctagacttgttagtgtatttatgatgattaatatgcatttgattttaatgaatgagatagttattgtgaaactatgcatttttagcagtaaaattttaaggcactctaaggactaaatgtgtattgctttacttagattgtatgaaaatgctgatcagaaactgtctgttggttttctgaagttagaagaccaatagccaatgtcatatagtacttcaggcttgttattgaagtcaacattctgacaggcaaagtttctaggttggctgttatcaacaattattccttgaaatgtcatcatttttagtcagcaaataattcttacagactttatgtaagatacgtagatgggaaagtagaagcatttacagagagaaataactcttctggaacacctaacaatgacaggattacaatcaggtttaattgaactctggcctaccttctctccctttatcttttctccttcccattttctcttcctctctcccttctttcctttcatttagtaatatttattgaatgccttaggtgcccagcactgttctacgtgccttcctactagactacccagaaaatataaaactattcaattctactgttcatcaactttacttaatagcagatacagtcatgcactgcataa

SEQ ID NO: 97726 - DNA, 1550 bp, Homo sapiens
gagagggaatccttgggtgcccccaagttcatagtcggtcccctactcgacgcgtcgcctccatactgctacaaaggtggcgccgggaagctgagggccctgggagggtgaagaaaaggccgtctggcggtgactgagctgtgtttgtgcccccacacgccagccacgttagactggcccataccttaacctccttctgatacccgagacgcgatgctggttgctggattcccagctggttgctggtccccagaagcatccctgggaggaactgaccgcggtacacgtgggtgggcggtgccctgaagtgtgtgggtgcagtccactgcttcttgatcaccggtgcttccagttcctgttttgactcctctctcccgggctttgccaaaggaatcttgttattaatggaagcttgaatcgtgcaacatttaatcaaccgtgtggttggtaatcattgagatattgaccttaacagcaagctaggagttcgcacgatatttcccgcctttatttggggaaagtgactcttaagtattgtaggaggtatttttctctagtaagtcacgatctgaatttttttaaagattcattcccattattcattgcggagcctcgttgaaatatgtcgtctttgaaaaaaatctaccactttaacagcacgcggatttctttttttcctgctgagttttgcgacttgtgagaatcgtcgaaaattttagaacggaaaataaaccgtcttactgtcatagagacttacctgaaaagttaggttataactttctgagcttggaaaagagagcaaatgtaatatatatggtgtggaaagagtctttagatttgaagggtatgtaatgcttgccatgtttggtgtaaaataagttctttttgagaatagagtaacttgaactactttagtctgtcataaaaaaactaaatgcataatgtcaataatgcagatactctgcattaaaatttatatatagatgtcgtcttggtatttatttttaatgtattttagagatcaaaaactcttcatttccagttccaaatttttctattcaacaaaaacattttggagtgcatatttattggggttacaaatgtgagtaaaccaatccctgtatattgccttgccagaaatctgacattagccagtattaatgtttaagtccacattttgcagatattccaggtgcccactggtgtagtaaaactaagggttgacttcaacaaactgctagctgagtacgtatcttttgggagcacagaatatgaaatggaattgaggacatgcagcatcttttccttaagtttgctttaagtgaaatttagcctgaggggtggttggtgacagtcctgattaagagcccattgtgccctccttcctgtctggtgctttcttttttcttttccttccttcttccctctctccctccctcccttcctcttttttgacacagccgtgtcacctgggctggagtgcagtcgtgcagtctcagctcactgcaacctccccctccgggctcaagcaatcctcccacctcagcctc

SEQ ID NO: 97727 - DNA, 1040 bp, Homo sapiens
ccagctacttattgtatttttggtagagacaaggtttcgccattttgtccagactggtctcgaactgagctcgagcgatccacctgcctcggcctcccaaaatcctgggattagaggcttgcgccttctactgtgtctgtatgtatccagatacatcagaacttttcttaagccaattcttactttattttgctataatttttttttcttttagggagggggagtgaatgtagtgaatgttaccaaaaactttgcgtttaatatggtattctgaatatctgttaagaatatgcttttgtttagacttttggtttgattttagtggatcttcttacgaaatatttctacagtgccatgtaacatagtaactagcactttataaaataattacaatgtaattagagtttttcacaccttgttttagcatttgctttatccatttattgaatttgtttttttttttgtcttttatacacttgtattgttaatatctaggcctaatataatgggaaataagaggaagactaaatagttggcagctttcggatattaagaaacagattgttaaggccatctagaagttaagtaatagttaataaaaaaccatacaaataacatagcaaacatttgacccttctgagtgcaatgagtcacactcaggcttgtcacctagttgaaaattattttcataagcagagattgcaaattctacatttatactttactcagtttttgctattataaaatatttgtagaaaataataattcgtatttattgagcacctgtgtatcaggtaccaggtcaagctatacttgctataattctaacaaaagctctgttagtggatgctagctatgcttattcccttttactgagagaacttgaacccacatctttgactccatagcccattgttttccttattctgctattttgctctgaaattagaattatatagctcactcatcttcataagggaaataatatctactctatagattgtgaggatttattttgtatcaattgtgaggtttcagtt

SEQ ID NO: 97728 - DNA, 1054 bp, Homo sapiens
ccatagactgtgctctaaatagcttaagctgtacagtccaggctcagacattagtcttaccgatggcctgggctgcatcactatttgacattgcatgttctctgatcgataaagacatctttatgtcacagaacttggtccttttactacatctttattatgtacttaaatatatttctactgtgagaaacatgaatgggatctacttaatctagatagtcaaactctacatagggaattgtatttattcaggaatctacagactggagctgtttagtacctactttcaagtgagaaatgggatcaagttttgtatttaaatgttaagcgttttgtagagtgagcaaaagttacatgtgttttctgaaaactaagattttcattaactacttactctgaatccttttattcagagtgcagtctatggatcagcagcattggcattacctgggagcttattagaactgtataatctcaggcttcaccctacaccttctgaatcagagtctgaattttaacaaggtccccaggtgactgttcagcatattaaagtttgaaaagaactaacagacaagattttaagtcagtatttcaaaaatataaatttaaaaaatcttaccaaaaagaagaatccctttttttttttttttttttgtacactgtaggtgggtcaccaccacaaccagttgtaccagctcataaagataaaagtggcgctccaccagttagaagtatatatgatgacatttctagcccaggacttggatcaacacctttaacttcaagaagacaggtaatataaatacccttttgatccccaatgaacaacatcatggttttatgtgtctgttcagtgagagtcaatactttgaaatgtttccctgaagtctgttttaatgtaactgtgttgcacagaataaacattaaacacatcatagaatctacttaaattgtgttgatgatgaactgtacttaacagtgtagaactctagattttctctcataggtaattctcaggtgtttataggtatgccttatccacctgcccatagct

SEQ ID NO: 97729 - DNA, 1025 bp, Homo sapiens
cataatttatagagaatgtttttgatttgaaagttggtaagaatattattgctagattagagcccaaattagttatgccccctggaatttgctcagtttgctttctaatcatgaaagaattggcattaataattgaggaataaattttatatctctcccaacattctctcagcatttagttctggttgctaaatgaagctatttgagatttccttagtttaattagaatctgttttaaaaaatctttattgagttctagagagattctgttctcatttattgattggatattgtctttgttttagaaggattttaaactattttaatccttaattttcttatatttaaaggaactaaaatggataatttaccagttttggaactttctactggtagtggtagggatatgctgtcttttattgtttagactgatttgaatctatagtgtttcatggtttctaagtatctgttgaaaatcaaattttgtcacccttctgtttttctgtatgaacctggtcattttaaaaattaccattatctctgttatttcaaatattgtacattagaaactaaaaacaaatagttaacatgtcaccttttacagaagatagtctttttttttttttttaacataatatgacttttcttattttaaacaaatactaagggatctagtaaattttaggttaatactgtttaacttatggggaaaaaagagtgcctttgtactttgagctaattagaggcatctctagcacatgataaaaattcagttatccattgaatgaagccttttaacacttactgtatttatgttttgcatttttaccataacactttcttctgtttgtgtagccaaacatttcagtaatgcagagtcctcttgttggagttacatctactcctggaacaggtaagtgattctttctttttttttttttttttaaaagacagggtctggctctgctacccacgctggagtgcagtggtgtgatcacggagtaaacaactctgacaccaaatac

SEQ ID NO: 97730 - DNA, 1563 bp, Homo sapiens
ttattaaaacttgtcaataaaaaagccattggaattgggatgaaaaggaatagttaagacactgaataataaaggtgttttgagagatgttaatgcatagttataaatctaaatgccgttgaatagaagcaaccactgattatatacctagtttttctttaagattaatggctttttaataatcatcattatgcttagcacagttcttcatatgtcgtcatatgtgtataatcccatcaaatgtttattcagcaaatatttgagcacctaactgtgtactctgggaaatagtaaacaaaatagatattccctgcctttatggaacttacatttatttgcagaatttacatttataaacaaaacaagtaaattataacatttgttagaaggtattacattttgtggaggaaaaaattaagcagcaaagggggggagggggtagagacttagagttttaaatagggtaatgtattagttttctgttgctgccataacaaactaccacaaacataaaagtggcttaaacaatacacattcattatctttcatttctggaggtcggaagtttgaaatgggtcttggtgggctaaaatctagacattggtagggctgtgttcatttatggaggttctagacaaaaatctatttttctttttttttttgagatggagtcttggtctgtcgcccaggttagagtgcagtggcaccatctcggctcactgcaacctccacctcctgggttcaagtgattctcctgcctcagcctcccgggtagctgggattacaggtgctcgccactgcgcctggctaatttttttttttttttgtatttttggtagagatggggtgtcaccgtcttggccaggctggtctcgaactcctgaccttgtgatctacccacctcggcctcccaaagtgctgggattaaaggcttgagccaccgcgcccagctggcaataatctattttcttgccttttccatttctagaggctacttaatgtttcttggcttatggttcccttcctccatcttcacagtcagcaactttgtaactctttgaccattcttctgtagtcatatctccctctctcttttaaagacccttgtgaatacattgggcccttctagataatctaggataatctttgtattttaaggtcagttgattagcagggttaattccacctgcaaccttaattccctttgccatgtaatgtaacattcacaggttccagggattaggtcatggacatcatttggggacctacccagcttattccacctaccactgatagttagggggcaagtaaactttactcaaaagtctgtaagtgagggaggtagggaatagtattctagacggagggaacagtgtgtctggggtgttcaaggaagaataaggggatggtgactgaaatggagtaagtgagggggagaatagtggaaaatgaggtcagagaggagaggtaatgggggcagatgtattacatggccctgtaggttattgtcacaattggtctttacccagaaaaggtggaagacaataaggatgagactgttgc

SEQ ID NO: 97731 - DNA, 1472 bp, Homo sapiens
aaaaattcaaaaggtatgtaagaatgtacaatgaagttttcccttttgcttttgtcccaagctagttttcctcctctttaaggcagtgattgccatctgttttttgtgtatgtttccagagagattttatgtgttattgatttctatttgggtaaaaagcgggtcattgcattccgttgttctctagaaagtccatactcagtcctatatccatagcaattgggctggtgtgttttttttcttcttcttcttttacatttacatttttatagtctctcataaaatggcttttttttttttttgagacaatctctctgttatctaggctggagtgcagtggcatgatcatagctcactgcagcctccaattcctggcctcaagcaatccttctacctcagcctcatgagtagttgggataacaggcatgagccagcttggctgcatgtttttgaaaataggtacccactcttaaatctgtttttcaggctcagtagtagtggtttaacttttaagatttccagtaattagataaattacttgaagcactcctagtattttttcgtatttcagacattaactctcccagctgtttatttttttactttcgtgttttaataaccctctatgactttaatttcaagaactgaagcattctcctttaagggataaagtattttattttgatcatttatggggaagtacctctaaaggatgcattatatatgttctttctttggtagtttaactttttcctactgacttagggttatgaaatattcattgttttgggtgattctgctatagagtactagaatgtaagtttctactcaaagtggtccaagagttttagaattatgttttatttcttaagtacttccctcacttgcagccattctttcttcttttcatttttgtttgatctctgccctgtaggcacccaacctatttgttgtttttctttgtggttagaaatttcatgtccagattttatacaaatgaattttcagttctgattgcagtgaatattttactcatatagattttatttaattaattaatttattttgagatgaggtcttactctgtcacccggctggagtgcagtggcacgatcttggcgcattgcaacctttccttcccaggttcaagcgatacttctgcctcagccgcctgagtagctgggattacaggtgcccgccaccatgcccagctgattttttgtatttttagtagaggcggggtttcaccaggttggccaggctggtctcgaactcctgacctcaagtgatccacccacctcggcctcccaaagtgctggttggtattacaggtgtgagccatcgtgcccagcctcacatagatttttaatgtgtttggtttctgatttatttttgagactcgaatttttttttttctttagggttctaattcagtcttcagataactgaagttagatagccatttctatgcg

SEQ ID NO: 97732 - DNA, 1057 bp, Homo sapiens
agaattttctcatgcagagatatggctaatcaaattttggtaactgtccttttaagtgattctataccataaatattttgatgctgaattttctctttgttatgatactaaatttcagaatttttaagtgatgctcaatgtataatgattcgtttataatttaaaattctttatcttttcataaccgtagtatacctaaatatattacatattaacatacacatattgaaataaattatatatagaactgcaactttatagttttttttctaagacctggataatggcaacgagagtagcatttttagagatttcagaggtagaatctgaggatggagaagaatggcaggataagactaactttaaggtatttgcttttgagtgactagtcactgacagaattagcccatatcggggaaaacaggatgatcagcactctcctgttaacgttctagacagttgggggccatttatcttgaaacattatcttgtagtaatttgcattcacattgatagtagaagctgacgttttctttggacaactctttttttcaggtttcctcaagcatctgcttcctacatattactacaatttgcacagtatgggaatatcttaaaacatgtggtaaggcttaatttttttcagttcagagttttgactaaagagggataagttgtgaattgagagaaactgcttctgaattttgtgggttttttttaaacttaaatttttttttgagttttgatataatacatcctttgaagtctggaaggctggaagttgcctaatttttgataaaaagagatatagtgagaagatatggagaattgagagtttgaaaatccacctcctctcacctcctttcttaaacagtttacagtcttaaaaaagatagattatgccaagtattatattactgttttccaatttgagctgcttttattggggataaaagaagtaggaggcagttcctgagcttttagagtttttagagctttatagctctaaaatttaaaaaattatcttaccttgtgctacaagttataagtaacaaat

SEQ ID NO: 97733 - DNA, 1011 bp, Homo sapiens
actacaggcgtgtgccaccatgcctggctaatttttgtatttttagtagagacgggatttcaccatgttggccaggttgatattgaactcttgaactcaagtgattcacctaccacggcctcctaaagagctgggaagtattactaagtaatactaaggaatgtactggcatgaatgaagattcatttataaagtatattttcatctgaaaacttttacattgaagtctttttcttccagtttaggattatattttatatcctatttcataatgtgcagaactcaattattcaatatagaactggctactaaattccattttaaaagtcgtgcatttgtatttgaattaatacacattttattaaaagggttgtttattggagggggtgttttatttatttgcataggcctttatggactgtgaagtttgcttttgggcaaaaaatatttgtttgctatattttgttatttctcttggtatcatatcttacccatctttgtatctgtcatttattttaaaagatccaggaaaatttcagaaagcgagctgtcctatttttgaacactatataaaaacaacaaaaatggaatatctgtgatgttaggaaagttaccctgaactaagcctccttttaaaagctcagagaagctgacttcaaaaaaaataacgtgaaactataatcatgcaagtttgtttaaaaaaaaaaaagagtataaggaagaaaataacatccctgtagacattgaaagcacaccagaaaggcatgcccataaatggatagaagctatagagtagtacttaaaattgagttttaagacatttagaaaatgatacaagatatgaaagaacaacaaaaataaaattgaagaacttgggaaaatgttagtaatagaggaaaatcactcataaattaagactagaataaacaacagctgatgaacaacagatatgccctaaaagaaatgaaagataaaaatggaggacttttagaaatcagaaagaaaagagat

SEQ ID NO: 97734 - DNA, 1003 bp, Homo sapiens
actagccgttttgtttcctctccatgagaatggcacgcgtgagctgcttctagtcttccatcttgacccaacccccaaggttatttgatttttaaaccacttaggtgaacttgagaaatattttacatgaatctcctgggttctaatcacagctccttaattaactactaattaaagaatatttgaaaagactattttaaaaacatgaagccaaataaaatatttctttttggtcatataaaaaagtatacttaaaactttacaacatgcaaaggatgatctcaatgtaaatcactggacacatttggacacatttgttaactatgaatatttaaatagtatcaaagtgctgaattcttcatgtattttgtttgtgctagcacttattgtctaggctgaggcatagggacattcttgggacaaaaaagcatctctgacccagaggacacatatgcatcctttagctccaagatctccaagttttgccaactgggagaaacatcagggcaatgtgtgctggggtagaggcaaagacacagggaagggactccaaacttttttctttcttttttattgagacggagtcttgctctgtcacccaggctggagtgcagtggcacgatctcgtctcactgcagcctctgcctcctgggttccagtgattgtcctacctcagcctcctaggtagctgggattacagggacacgccactacacctggctaatttttgtatttttagtagagacggggtttcaccatgttggccaggctggtctcaggagcgttggtgaaaaaggtttctctggagcctttgggtcatgtcttaagttatcaggttatttcttggctcatcagcagaagatattttataaatttaaatcatctatgtcttcctggttggtttttttttttatatgtagtaaagtcttgcagcaggttttaaagcacaatttcaagtggcatttaaatagattgtctattttattttatttattttattttt

SEQ ID NO: 97735 - DNA, 1072 bp, Homo sapiens
gcaggttctcaatatttgtcaacagctatttttgtaccatgatagaaatcttggggtcttggatagatgcagagtaaaaattagagaaaaataaagttaaatagtttggggagtgttttatatagactattgagacaaatagccttttcctcactgatgtccactaaccatctagaagaatgacacatggtaggtgttcaataaatatctgaatgaatgtaaatatttcctttttggttttatatttttaattggttgcttttccttgcatgtctaagaagaatgatatgagaacctaagggagcataaaagagaagttgtagaagaagaacatttttaggaaagaagtatcaagaaaatgtttaattgaatggtggttggcatttggagttttattgtaatatagtgatctgtgttatacttaaggaatagtaacaggttaaagaagaataaatttggtgaaacttaatatggatgtggaatagagtgttgcttacatgtaaaatgaatgagatactaagacagtctctaagcagcaacattctaatttcaacccgtgacttccctgcgacctcggtgacctagaggtgttgcttaagtagtagagtttctgtgggaaatagaggtgagtatagcagcaaagtcctttagagtagaataccatagctaattatttctcttctctgggaacttgagctgtgttaagatgggcaggaagaatagcaatagaattaagtatctccaagcaaaacctttgaaaacaatcgtaattatcttttttgttgattggggcatctcttttcagaatctgaggagagatgagaggaattagagaactatttttttctaccatcacggtgcttctgaagacaaagtgtagtaggtttttaggtgcaagcaacagaaactcagcaggactaaaaagaatttggtaaaggatgttggagagctcatgtaaactctgaggatatgggagaaggaggtttgaaacaggcaggaactaacgcagcaatagccaggaccttaaccagagaccgccgtaggaactatccaactcccaaacaaagatgct

SEQ ID NO: 97736 - DNA, 1020 bp, Homo sapiens
ggaaaagtttcccggtgaggtgacgatggacaagagtcgccccatcgtaagcgaaagtggactgagaggaagcacaaacgcatggactcaaccagctcgcccagattcaccctcaggccttttgccatctgaaaagggcctatcggatgcgcgacatcacgagtgacgcgtagtcattttcccacgtcccgtccctgccccctcctagtgggacgcagtgggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagtgagtacccacccctcccccactcacgccgcgagccctccggaaagccacttccccgctccgggcttccctgggagccggctcgcttcctcgggccacgtgttcctcccttaggcctgtgtggcccactgccccttctccagcccctgatgacgctagctctctcattactatagtgacgctgctggcgcccccgcacctgggctttgcctctccgcccacacgcccgtgttcacccacccatgcacccgggtgcgaaatgacccctcgggactggcacagggttttatccttcgctagtcctctcagaattgaggagattttccaaggttatgtgtgaagaaatacgctgaacggtctcgggccagcgtctttctggaagaccgactcatgacgagtctttgtgttcgttatttctttacccgtcacccagggatggtactgttagttcttttgaaccaacaaattacgacttggtggctttttcgatccacctctga

SEQ ID NO: 97737 - DNA, 1309 bp, Homo sapiens
tattgttattgcctattttgatagtgtattataaataaaaactaggggacatcagactgatctgcacagtctatacagtgcttagttcctgcccattttttaatattgcctccattttttaatattgcctccattttttttatttgcctcttcaaatgccccaaaactttatgaattcatttgtattaatactttccgaaatgaatatgtcaaacaggattatggttctgttagaaattaacacattagtctgaaatggcatataccatttgctttcttacaactaaaatttagtgacaaatggagtcagtattgagcaatagaaagtttgaatatggaaagaaggaaataatcttggacttagggcaagcaaataaaagatacccagctaagaacttgtatcagcaaggaaatagtaatagggacctatagagacaggatccaggtgtcgtgaaagatggagcaagagaaattggttgccagtgtagaacagctaccaatagccaaaatcaaatgttgattacttgaagctggattaaccagttgcataatatatattgcatggatggacaacaagaatacattagtgcatttgggagaaaactaatgagggaaaaccgtgacagcttctgcctacccgaatgtcccaagagggtagactccattatcttggagcactattcagtgttgacctgcccttccgctgcttccctttttccaaacatcttatttaagcagtggaggctggcccgtaaaaggaatgggattacgtacggatgggagggaagttttaagtgaagcctggaatttactgagtgttaaggctcttggagcctcaggaagtcatccttttctttcgagactcctctgtattcatgtcccaagttgtcttctgaaacacacataaacacgcagttcctttactatcatgttaacttttgggaccttattaatccaatgaggaccattattctcctagttttattttaactgtggtttggggttgactgtaacctcctttttttctaccttgtaattcaggttaatctttaggtagggctctgtcctaaactcaggaagaagcctttttgaacttctccaaattgcaaatcattctgttttcaagaggtgctattggtatctcagatctgcagtgtgatatttagaaaggttattgcgcaccaaccagcccaataacttaatgaggtttctctgggaagtagtttattaaaaactgtagaaggaatttgcttggagtcaaatatacctaggttcaaatatcatctgtcacttaatagttaacatttac

SEQ ID NO: 97738 - DNA, 2043 bp, Homo sapiens
ttctaacacaggaagtctgcctctagagtccttgctgtccaccactgtctctctgaggtaaatcttttaactttcacaacaaccctaagtgagactcactttacaaataagaaactgtggcaaagagggtaatttacccagctctgtttgggattaaaatttgggcagtctggctccagagtttatgcttctaaatgcttgcactatacagccagccccttattaatgacttaacttcaaatgaatttatcatttctgagtttctgtgtatcatagaattgttgagaggattcaataaagtatatattcaggggttatgtttatgtttagtgaatactagataaataagtgtcccctttctctgtggaaaaatgttaatttctgagctctaacttagaggtgaacacaactcacttattatctctttaaactggttatttatgtgccagagcagtgtaatgaaacctgattttttttttcttcttctgggatcgggagtttatacacctttaccagaaactgccattgtgagtgctttcttttcttactggccaggtccccttaggggacatttttctttcctaagtctatctggcagtatctgctttgctatttggccttatttattcattgtttcttctctgtagttacagatggagcatgggttgaaccgcagtttattttctctggcagagcacctgtagatgctgtttaatcctgatcatatttttttctagagcctcctctccctcccgtgagagctcactttttgtaaaggaaaagtatggcattttatacttagttgctgcactgtgttcatctgtatgtatcacattatgttgaccatctttcttcaaattgaattgagtgttaaactttctttatagaaacaagggaagccatccgtaaaaggctcagtgcagaaacatccagcttgtttgtgcttcttaccttttttcatacacataggctgtagaaaattcatgtagaattttgtataataccatgttgggatgttaaatcatgaaacaagcatttaagtagaggaaagcaaagttttggtatatggatatagatgtcatgaataaagagatatttcccaatgagagataaccatttagaagcaaaaccctctgtacttttttgtcttaagactattgaaagatcttttactgattttgaggttgctgtaaacattatgtcatgttgtatgtttttaaatactaattgtttcagtactattgttttctttttctagcttgtccacgtggtggtattttgtatctattattctttctactcattattacttttcctttcccttagaaataatagcaaaataaaggctataaaatggccacttgtttcatactaaatgccactcagagggtctcaaattactttgagaagacctttttgcctcttcttcctctctaaaaccacccataaacaagagaatgagaaagaaatacaaattctattttgaaattagaagacatctgtaatcttggacctcagcatatgaagattggcagtagatggatgagttggtaactgacttagagcagagcggttatgtctgagtgcctgtctaggagtgtgcctgtaagaagcaagtgcatttcctctgcaaaattatgaaaaaaaaaaaaaactcaacaatgggaagcactaggtaatacagaaggcaagaggctgaaaactagaagttaaaagtgttaggagtaattaataattcttatctactacagctcagccaggtgactacctctgcaagaaacaggaggggtcttcttggaggtgggaggtggcagagaacaggcctctctgcttctggaacactaagcacagaggaggtgggatgtgagcctgaaaatggaagctagtaagtctgtacagtaaactgagaccccttctacctgctcttttctcttgtttacagttagacttattgccctcccagctggaggatctttctccagagaaccagaaaagacccagaaaaaatatttcagatattagcatttggtttcttgtcaggct

SEQ ID NO: 97739 - DNA, 1594 bp, Homo sapiens
aaacacctcatgttctcactcataggtgggaatcgaacaatgagaacacttggacacaggaaggggaacatcacacaccggggcctgttgtggggtggcggaggggagggatagcattaggagatgtacctaatgtaaatgacgagttaatgggtgcagcacaccaacatggcacatgtatacatatgtaacaaacctgcacgttgtacacatgtaccctagaacttaaagtataataaaaaatatatataaaaataataaaatttaaaaagcttcatagaataacaggtttaatgatgataatgttgagtacatattgaattgtaaagaatctgggtgatgatttaaggtcatatattgccttgacttgatgtttagtgttttgcatgtttttatattagtaaagaataattatcaataaaaataatgatttttagatatcattggaggatatatatggtaacataaattgctaagatatttctgtgctctttctcatgtaggacaaaactttcggtttgaagaataagaaaggagcaaagcaacagaagtttatcaaggctgtcacacatcaagttaaatttggtcaacaaaatccacgtcaggtaagtaatttaaatgtccatatctttttataaatgtaatattaatatagcctctgtttcagataaaatgtctggtattattatataattgtatttcaaaacagaatcctacttgaaatgtttttgcaccttggccttccttaccagcagtacctcttggatattgtccaagccattttgatataactctcatttattctaataatgattgcatgccgttctacagtacaggtgtgttatattcatctatttcactgttcataagtgatcactttgtttccagctttctgacactaagaccacctgtagaaatacaggagttcttacatgtgtttatgcttttatttctgtggcataaattagctggtaacagactccagatcaagggaaatggatttctaattttaacattataaatttgccagatcactttccatagaggctgtagtacttcacattttcatttgtagtacatgagcaatagatactaaagttctttttaatgtgttacaatctgataagtataaagtgatatcttattgttacattgtttccctcgctactggagagtatcttttgtatacttgttagctgtttgggtttgcacttctatgacttccctattgaaattatttgctttattggttgtctttttcttgtcaatttatgagataccttttgtctgcattgcagataattggtgatatttcagttatgttttgccatgcaccaatttttaacttacatgtatatatagagtttaatattgctagatatgttgctagctttttaaaaatatggttataaggtctcccctgccactggattctgcatgtttttcctagatcatttgtaattattttatttttatagtctatgtcatatgaatttattttatatatcttaaagttctcactctgttgcccaggcaggaatacaatggtgtgatcttggctcactgcggcctctgcctcctgggttcaagccat

SEQ ID NO: 97740 - DNA, 1042 bp, Homo sapiens
atagctgcttacaccagcatcatttatccaactgaaataccactattatcctacagtcatagtcatacattgtttagtgatgtggatacaatctgagaaatgtgtcgttaggcgatttagtcattgtgcaaatatcatagagtgtacttacacaaacctagatattacagcctactacacacctaggctatatggtatagcctattgatccaaggcttctaacttatacagcatgttactgtactgaatactgtaggcagttgtaacacattagtaatgatttgtgtctgaacatagaaaagatagagtaaaaatatggtattataaccttacaggattactgtcatatgtggtccctcattgacctaaatgtcattaattctgtgcttgactgtacattaaagtctcaaggcaagtcttttccccaaaatggtataccttttctatttttcctggttgttcttaggcatttattctttcatacgaattttaaaatgagtttatccattggcaactcatttgaaaaaaatgtagcccctttttttttcaggttctttagacctctcacttgtaaagatttcatagacatggatctttatttttaaagtacatttttccaccatttttatctccttttcattaacttctggaaacacatttttgtaatgtaggagagaagaaagaatttctcatgtgtttacagattttttaaaaatctgctaatatgtatttgtgagataagtaaatttctcttgctcatgctgtctgcaaatcagtgacccaacactttcctttcacatccattttcccagcttgattctagaatctaaaactattgctcttccaaactgctaacttaatagcccggtttaataaaaattaatgtttagagctcacgcctgtaatcccagcactttgggaggccggggcgggcagatcagctgagaccttgcagtgagatagacttgggtgtgaatcttcctatcttttttgttacatgatccttaaatagcaaccctggtctttatctgtactgtggaag

SEQ ID NO: 97741 - DNA, 1092 bp, Homo sapiens
gatgtttctaggtctttttattggactttttaggttcttttgtcccattttatgttgattttcttcaaggaagtgtcctttactcttgccacttttttatgctctccttaagtaccatatacccaaagttttaattgttacctgtaagctgctatttctaaagtctttatctcaaagcagaccctctctgatttcagtggaatcaatatgcatgtctatctgccttcaaaagagctctacccagatgctttgtaagcatcttgcactctgtatgtctaaaactaagctcatcttcacctcttaccctgaaacctgttcctcctgtattccctgtcttgtttaacggcactaaccatatacatgataatcctagattcctccccctttatacttcatgttcagtcagtcctatcagctctgtctccttttctccatccttaccagtaatgctcattttaagctcttgtgttttattgtgtacagcagttgcagcagcctcttgcctttattcttggattcccaatccatcctctacaaaacttgccctcttgatattttataaaatgtgacctgaccttgttattgggttactttaaacagttgagagaactctgttcaagctactgatgcaatctaagcatcttactgatgtttctcatactttattcctctagtccctgtaactttgcattggctggctctttctgtatttcttttcttgcccatcaagaaaaactcatccataaggttattggctcaatttagttttctcaggtatatgggcattctttgttcccagagcactatgtactatgttacagttgttgacatgtctgtcatcctgctagattctgagcttctttaaataagcatctttgtcttttcattgtattctctgtcatctaacataggacctgacgtataaatgtttggatgaatcctctaatcatattaggtatgtaaatcgtgtgcctggaactatgttatatgtcatgttttgttttgaattgttttgtttaatatcctacattgacctaacccagtgtttttccatgagggcactatataggtttttggggtggtataattcat

SEQ ID NO: 97742 - DNA, 2142 bp, Homo sapiens
atttcatcatgttggccaggatgggctcgatctcctgacctcgttatctgtctgcctcggcctcccagagtgctggaattacaggtgtgagccaccatgcctggcctcctttttgcctcttgccctattgacatcaactagacaaagcctgtgaaatagcctatgttcttgtttggtttcccactctctgccacctttcatagtcagaataaaagaaacaaaagtagacataaatgctacaaaaagaactttaaagaaatgtcttgctaatcacccataagtgccgttttcctctcacatcagtgaatggaaaataagttaaccaaaattcatcatatttcaggtagaatctatactttacagcctggcagattataatacaaataccatatgccatttgacataggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaaggtaatttttttaaaaacactctcttaaaaataaatgttgaatactttcggtttgctactaagatatttattaaattgaagaacatttcaatcttaatagactgtttataaaaaataattaattgggtttattattttttataaaatctgaaaattaccataatatgccctttaagtaaatgaagatactttaaaaaacagtgatttattttggaattgtctgtcaccctttccttcagtactacctgctcatttatccaaagtacttaggaagctttggtgaataattttcttttttttttttgagacggagtcttggctctgtcgcccagactggagtgcagtggcacgatctcagctcactgcagtctccatctcccaggttcaagcaattctcctgcctcagcctcccaagtagctgggtctacagggtcgtgccgccacgcccagctcatttttgtatttttagtagagatggggtttcaccatgttggccaggatggtcttgatctcctgacttcgtgatctgcccacgctggcctctcaaagtgctgggattacaggcatgagccactgctccggccttggtgaataatcttaaaactatttatttctgcctttggtgttttaagaaaaccgtgaggccaggagcagtggctcatgcctataatcccagcactttgggaggccaaggcaggaagaatcacttgagcccaagagttcaagaccagcataggcaacataatgagaccccatctctacaaaaaaatagaaaaattagccaggcattgtgttgcatacctgtagacccagctgcttgggaggctaaggcaggaggaattgatcgagctcagtcaatcaaggctgattgagggaggttagggcttcagtaggccgtgatcatgctatcacactccatcctgagcaacagtgagaccccgtctcaacaaaaagaaaaagaaaaatgtgttaagccatgagtcttataacacagcattagtgtctaaggagatatgtgttgtgggagtagtagataagattacagtatttaatcttcatttctttatttagatactatggataattgggatgagaaaaagctggaagaagtagtgaacaagaagcacggtgaggcggaaaagaaaaaaccaaaaactcaaatagtatgtccttttcttgaattgagttgctgtgatatttatcattagggagaattatgtggcaaggtatttgctgctattttctattagattattctgtaagttactggaaaatttgatttcatcaagataaggtacacgaagctttatttttggaatttacaagttagattttatagattcttgttcagaaatagctgaacaagaataaaactatgttactgaagtcctttaaatgccattttctgaggtgaacgttctcaaatatggataaacaaaattacatatccagacaaaaatccctatttttttgcacagagtggaaggaggcctgttaaactaacccacttaataatgtatttagttttaatagggatagatttttaaattttaaggtttaaaatatttctacatatgaattcca

SEQ ID NO: 97743 - DNA, 1100 bp, Homo sapiens
gcaagtgttcagcaaattttttgttctatatatttattatttgattattggccctgaggagtaggtgtttgtttgtttgtttgtttgtttagttttatttctcatcttctcaggaacacaaatgaaacttggatattgttatggtgctttttataatatatttattattttcagcaattgattcatgttaaaacaatttcttatgacaagttactcatcttcaatggtgagaagaaatctagctcagaataatatatttttagtgtttgtatctctggatactcattttgctcattgccacgtaaagtaaaaaaatacataaattagcttattccaatgtaatatcttcaggatagtcatgggcaaggaattaatcacattaagagataactgcaactaagcactatttgaggtgacttctgtggaaaaaaaattaattctttaccattgcagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtggtatgtctcaggctcacccaaactgattctttattcttccattttcaatttctgtgtcatgcaagattttgtttctatttcatcagtgacaaggaatgtttagatttttgtcctgagttgatatatttgtgtgtctcaatagatcagtggtcgtgaagtgtttgaatttcgtcctgaactggtcaatgatgatgatgaggaagcagatgatacccgctacacccagggaacaggtggtgatgaggtaagaggaagctttgtgcctcatctccttatgttaattgaaagaaacaatagaaaataccacaacatggttaagagccaccaacatcagagccacagtgcctgggttcaaatccttactccaaccatgggaaattaatctaggcctccaccctcatctaatatggacataatgattatctctacatcatagtttgtgagaattaatcgagttcatgaattagtagttctttatacagcttaggacagtgcctagt

SEQ ID NO: 97744 - DNA, 1024 bp, Homo sapiens
agataacttactgttgattttttgtgtacttacaaaattctggcctctgggttgaaagaaaaaaattgtactctatatataaaaatgtgatggcagaggaagaagtttcatataccaccttgctattctttttaaacgaagtttagaaaaaataattttgaaaatagatcttttgtttttgttttttatagagacaaggtctggctttgttgctcaggctggtctcaaactcctaagcccaggtgatcctccacctcgacctcccaaagtgttgggattacaggtgtgagcctccacacctggccagtaattggtcttttgttttcacttggatcagtgataattttggctcattaagataaatgtcaggagtaaaagaaaactgttcttatttgtaacaactttcttttctatatgttgttaaaggttgatgattcagtgagtgtaaatgacatagatttaagcctgtacatcccaagagatgtagatgaaacaggtattactgtagccagtcttgaaagattcagcacatatacttcagataaagatggtaagtatgctaacttttgcctaattttaagaactaggaagttatctaaagggggttataccaggcttggcaaacttagatgtgtgcaggtaccagattggtaacataaatgtgtggtttgaccataaataaaagcagtaataaatagtgaaaggctgtagacatgagcagctgggtgtatattaaaatcattaatggaaactagaaggagacaaaaatgagcttggagttaaagtcaatgagttcacttcgggacctcatgagtttgagattttttgattatcaaaagtgcactgtctaggatattgtgtagacatgaacaccctacagaacatcagtgttatggggtaagtaaaagaagaaatgcttaggaaagacattgagaaggtcagagaaaaatcaagaaacaagtttccaaagaagcaagtaggatgaaaaagaatataaataagttactggttgtaattggttata

SEQ ID NO: 97745 - DNA, 1464 bp, Homo sapiens
tatagcactatgtttttttttaacaatttgattacatgatgaagattttctgctgtcacaatcacagcattacaacagcatgatttaaatactatttgcaaaaccaaaagccaagtagctgcttatattacaaacatttttttggtttccataaccatttagtcaaataaaatattatatggaaattgactatttaaaatctaattgctaggtcatgtagggaacacagaggtgtagaagattgatcctgccctcaaatgtataaaccattaagtagtcaaatggctacagtgaaaaacagtattttatagtaggtatagataattggcacagataagctcagaaaagaatgatcagttcttgctggagtaattctggggaaatggctttcatggagaaaaggaaaagaggaagtgtagtatcagtctatgttgtctattgctaatgtggaatggtgttttctgcttctacgccttactgattccagtttttatatttagaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaatatgggcctttttttaagtttttctatgaaaaatttaacatttctagcttgagaattttaaatacctgttataatatcacataggcatgttttcttaatatttactacagaagcatctagagtacttgacagtactacaatgagt

SEQ ID NO: 97746 - DNA, 1065 bp, Homo sapiens
ttttctatgtttagatgcacaaataccattgtgtcataattgcctgcagtattcagtacagtaacatgctgtacaggtttgcagcctaggaaaataggttatttcatatatttcatatagtggtagatggtaggctttaccatctaggtttatgtaactatgatgttcacacaactgaaatcacctaacaatgtgtttctcagaacatatcccttagttaagcggtgcatgactgaagttacattgtgaattttaccttatttttgcacagatggtatatcagatgctgtaagcccatcatactgatataaatggactgatataaattgtataatggtacaatatatttctaatgtgtattattcagcgctgaccgttaagtgattcagaatgtgatagcagtgagattacaggatcagatcattgagaaagcattgcatctatcaggttttaacacataaagtggacaaagggaacttacggcagacgttcatacagataattagtagaattattatatgagttctcttcttgttctgggtagttaactttgtataaagaactttcagaatcacagaagagatttctacctaagtataagactgtgatgctgatacatatatatatccacatacaatattatgttaatgcttctaggtacttagcacaccattcatatcatatgaactcaggtatatgttgtaataaattcgtttcaaggcataccagatgagaggataaactcccaaaatcttgtgttttgggtttttgtctctatttttaagcatatatcttactgatgataggtgttctctgagaataaagataacactttacttttcaattagtagaaattacgagaagctgaactctaactagaatctgacaacatctgcaaaattttatagtactttagaaacaaacccaaatgaaataatagtacaaaatgtattttcacattttctccttttaatgttgtattttttgattgttactctttgttaatgtcgaaagaaaaggagattcgttttcattaatttcattaatattgtgtgctttgccaca

SEQ ID NO: 97747 - DNA, 1027 bp, Homo sapiens
aattttttttgattgaatagataattgtgtatatttgtggttaattattattttacactccagacctatttctacacctgtagggaagaaacttaatcactgatatcgtcagcctgtcagataccactgatatcttcagtctagttttaagaaaaactaggactaagaagaagtatataatcaagttcaagctaatcatggccatttttaaattacttggtcttttttaatactttttcccagagcaaccttctaaatggaagggcaaagcctcaactatctaaaatgcagcttttaaggactcttagatgtatgatatgccttatgtacaggagattccatctataccttgacacccacaccactcccacccctgttctctcttccaagaaggtttttggcagcaaatagttctctttaattattatatttaaatatttgtatatatttaattcacattagggataacaactaagaattatttaattggcaggtttattaggtagttgttgattgatgacatgtataacaatccaaatggtatgataggtgaagccaatgcagtggcacatgcctgtaatcccagcactttgggattgcttgagcccaagagttcgaggttgcagtgagccatgattgcatcactgcactccagcctgggtgacagtgtgagactccatctcaaaaaaaaagaaaaaaaaaaaatttggccgggcgccctggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccggcctgggcgacagagcgagactccgtctcaaaaaaaaaaaaaaaaaaaaaaaatttgtat

SEQ ID NO: 97748 - DNA, 1054 bp, Homo sapiens
caggctctcatctcctttcataattagtcacatgtaatttatcttccaaactgaaacattttttgagtgtggaagggacactatggagagtgaagaaaactcttttagtacttacattagacaactggtatacattggaactgtcctctgcaaacttgggcatatgttcactgtacttgtaattaatttaacctgtttcctttccttcccttcctgtaaccgatccatccaaagcattgctggatttatcttcttaagcatagttttaatcatgaggtctcccacttcataattctttaatggctctaaattgcctaccaaatacaatctaaatatttaggcctaatcttcaaactctcctctggtggccccagcttccctctcctactttcttatttctttagtcaagtaactcacaatgtaatgcttaacttttttgatcctgagttacctcattagtaaggtagggattaaaatgtctcttcctcagttgtgaagctgtaatggggtattatatgtaaagaaagtaggctggtatataagtacttagcagcaagtacttagtacataggcactgaggtattagtagctattatcacatacactgtagggttgtttgttttgctttgttttgttttctgagacagactcattccgtcacccatgctggagtgcagtggcacaatcacagctcagtgcaacccccaactcccggattcaagcaattcttgtgcctcagcctcccaagtagctgggattacaggcacttgccaccacagccagctaatatttgtatttttagtagagatatggttttcgctgtgttggtcaggctggtctcaaactcctggcctcaagtcatccgccctcctcggcctcccaaagtgctgagattacaggcatgaaccaccacgccaagcccatacactgtagttttctatgtctatgtgttcctactttatgaaatattctctctcacatcccttttgacagtgttcacattcctaaatccttcctatccttgaatgttttgaagatgtattcccatgaagac

SEQ ID NO: 97749 - DNA, 1057 bp, Homo sapiens
tcttggcttgctgcaaccttcgcctcctggattcaagcaatttctggctaacttttgtatttttagtagagatggggtttcaccatgttggccaggctggttttgaacccctgaccttaagtgatcctcctgccttggcctcccaaagtgctaggattacaggcatgagccaccgtgcctggcctgtgttgctttttattccttaatttttttatatagcatcttttatcaccttgtacccagttttctatgcaagtatttctttttcactacacagcttcctcgtaagactttaacatatgtctaaggtcattttactttctctatctcttcattgttctctttaaaaaacttaaatatcttaatgataactttaatatcgagatggcattttggatgaaaaacttcatcagcttttttccctcacaaatttagcatgtagatattgacacattccttttatattattctgccatttctgtagcatttcaccagtatgcaagtctgcacatgaaggtatgcttaggaaaacttaatgaacatccatttgtacacctgattaccatcatttcatgcctataatgtgcagatagcctgatgaaaagcaacaggcttgttcctggtattattcaaggaactcatgctatgtgctgccaatagagtggtgttttcattcagagaatgctcctactgggctctttttctctgtctttgttgaaggccttctcctaataacttccgagctctctctgtcttatagtgccaagtaaagaaagtatctgaaacccaaaattaagtagagatgttacacaaggaaattgttttaagggtaatttaaataattggatgtttaatagaggatgctttctgcattcttgaggggttcagacgtagtggaaatgacttatttatatatggctactttaagattgagacatagctattgaatttactttgttactccactgtccatttaaacttttcttgagttcttataatgtggcaggtgcaaaagatgaattagagtaccctacattcaaagaagcaatttatcata

SEQ ID NO: 97750 - DNA, 1049 bp, Homo sapiens
taaagagccaaagtttatataggaagatgaacattgaactcaggagtcttgactctgaattttcctgctcttaatcagaatttctttgttaacctgctaccaagcccacccctttttggtgatccagaggattttatgctctttgctaatattacttgaaatttcaaaaggaattaatatcatggctaaagatgacttcaagcaattataattttgattatgcttttccaaaatctctacatcctcttctctttggagattccagtccttttgtgccccgctaccctttgttgaattggctactgctttagatcttccttgtaccagaagcataaaaataggttactgaaatgcagtatagtgtttatgcctagagcccttaggccattattttttgtgttccactggtcaccacatagtttattagagaaaattagtaacaaaagcacaacatgtaagactcttactcctacatttgttttgtccatgttaggtgacctgtgacaccaggtcaaaggaactattctgtcctccagattctaagtagttgaacctacaggaaactgcagattatttcaataaacacttattttcttagcccaacactttgatcctacctgttataagtgggaagtgaacattaaaagagtgatacctactcagatctgtattgtgtgttaggaaagagaaaaaatcaggttagaaagcatacactgcacaggatgagggaaattgaggctttatcctcagtgcttggatgccatctgtactgccatctttatgttggtattttggttatggtactgtcatcttcggtggtatgtagagaatctgaagattaaatttgtatttttaatttctatattgcaaaaatgttcctatttgaaaagataattttatagctacgaagaatgagttaacccttgtttgccaagtttgttacttattaattatatgatgtacacacacacgcagtacactcttattttcatttgatgcatgtgggaactgaggttcacatagttgaagcaatcttatttccacatctc

SEQ ID NO: 97751 - DNA, 1029 bp, Homo sapiens
gttttcaggatacatatagagtaagtcagtgttgatgttctgaatggtcaaatgaggatttaaacccaagttgttctattccaaaagaacctttcctctacattattcacaatagaaaatgttttccatttcagttgcttctgtattaagcacagcttttctacaaagaatacctcctgctttcatgacctaggtttggataattcctgatatgtaagaatacatggaactctcctgaaaacatgcgttctaacaatgattcccttgttcacagaatgcttttatttggtttaggcacagaaattataaagtcatttaaagccatattttctaaggtatttaacatccaaatcaggtcaatgaactgtggcttgtgggcctctttttgtgaataaagttttattggaatacagccacacccatttgttgatgtgttatctataatcatctagtacagttgtgagagttgagttgccacactgtgtggctcctgagcctaaaatatttactgttcggctttttacagaaaaagtttgctgaaccctaatctaaataataaaacctcaaatcttaggaaaagcttaaagaacagtctcaaaaaacagaaaagcaaagtgcatgcctttgtttctaataggcctgacactttcagtaacccttgattattgtacatgctttttgattcaacctttgaaatgttaagccacctataataggcctaaattgtgaggggcatcttgttcagagaagaagactcaggagcggaagtctgagaacctgggttatattctgactttgtgctgacaatccacctatagctatgggtaattcacctaaccactctgggcctttgtttcatcattggtaaaacaccaattcacacaaaaaacttctgaggtataaattcagtgttttttatctgtttcatacttcaataaattatgcaaacgaataattggttttatgagatgatgtctgttttgtaagactacactgctaactttttaataactttgcttgtcttgtggg

SEQ ID NO: 97752 - DNA, 1078 bp, Homo sapiens
acttatatggacaccgtggacaaggaacttcactgtctgtcactaacttaccttattactgattacatttgctttcagcttttcataactgcatgataaaacctcagaccttaggagaagagcataaaaaacaacctcaaacaacaaaaaagcaaaattacttggggaaattaagtaacttgaccgtggctaaccagctagtaaataagagagtatagacctgacaccacatgtgtctacaccactacactgcactatgtcaaatcaacaatatacttatcatttcctgagtaatgacaaaggacattatgcagtagaccagatgttcttctgttctaaattgcctagccacttttgttccttctgtctgctttctgatgctaatattatttgaacatagatttttctcagtaatgatttctagttggcttttcctttccttttgtcattactcagggaatgataaagatattattgatttgaaacagtacagtgtagtgttatagacacacctgggttcaggtcctactctcttatttactagctggttggccatggtcaagttacctaatttccctaagcatcagtttccctatctgtacaaattattgagtaataatagtatctcttataggattggtataaagacttaaaaagttaatgtcatgtaaaatgctttagcataatacctgactcagagtaaaggcttaataaaccctagctgatcttactgtcagaatcaataatattactatttgtaatataattaccagacttaacaaatgggagaagtattaaccatctgcaggaataagtaccagagcctgcatcaaaatagtttatattcaacatgaagtctttaaattggcaaaagcactcagtttaatatatacctgttaagaaaattttaagagacagtcatggtttttagctggatactctgggaaaccaaataaagcagataattgtacagtatgataatcaaaaaaaggatgtctttataaatagcttgaaatagttccccagatgcaacttgaataaaggaaataaatagccgacttgctctaacttgaggtta

SEQ ID NO: 97753 - DNA, 1024 bp, Homo sapiens
ggttatttattttatatatacacccttttttaggtcagcttatttcggatcaagtggcagaaatcgtatctaaatacgaccccaatgtttacagcatcaagtataataaccaattagcaactcggactgcacaagctatttttgatgacagctatttgggtaggtaaaaccaaaatttactcatttttggaactgtggtacatatatcttatatctgagtatggtcttttaagtagaaaaatattttatgtgaaatagattaggattttttgaaacatacagaatatacaatttcaaattgttaatgagtactttggttatgttacgtttcagtaattgaaattgaagacagtgattatttgtgcagtgataataataatagctagcctttaagatatgcttactgtgttctgggcattgttcaaggtgacttggtttgtattcactcatttaatcctcacaagtcaagcatactgtattattctcattttgtaggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggacttattaacatgtgttctctctttcaatttctttatgatatattaaaacaagtcatatatgacagaaatagtacttgctgattgagagaatttatttgttctttatgatgagttgtaaatttggtgtttttaacagactcctttgtaaagttaataagacaattgtagttttgtaataaaaatagactatttgagtatttaactcagtttcatttaaaattcatatgtcatatatatatgaatctgttatgactaggggacaaaatattgcataagtaaaggagtttcttgaaaatattttcaaggaatgcttactcagcaagcctgctgaagataacgtccttgtcctgatggttctcccctttggtttcctgtttaggttattct

SEQ ID NO: 97754 - DNA, 1052 bp, Homo sapiens
gctgaggcgggtggatcccttgagccctggagttcaagaacagtctggacaacatggcaaaaccctgcctctagaaaaaacacaaaaattagccgggcgcggtgatgcacaccagtgtctagcttctcaggaggctgaggtgggaggatctccagagcccagggaggttgaggctgctgtgagttgtgattgcgccactgcactcccgcccgggcgacagagccgagaccctgtctcaaaaaaaaaaaaaaaaaaggaaaagaaaataaaattttaagcaattttaaaccattgttatggaatataacagaagaaatgaggaagatgttagcacactggtgagagtccaggctaggtctgtgctgaacttcctctagtggctgctgaaattgagacagctacacttggcttcagtgcctttcctttctgcttctttttagcccccaacactgttagtgatttccttagcattttcctccttgtcttcagcaaattcattcctctgggaggaagaattagtgtcttctttctttaggcatcctttgttaccttctgggccatctctgtacggttattaccccatcctctcattgtccatccatcttccttcagagctccgtttaggaatcacagtctttacctgattttgatcacatttttgtgccacagccacttctaccccacttcagtttgctctgtattatttttcattactgtactactaaactaaatgtagtttttcttcattcttaggttactttatcttgtctattcttgtttaacaatattacaaatgacttgagggcttatttgcatatgtttgagagccctccagaatttgtattttgtaaattttgattttatagtttaaaaatgctgggctatttattacggagtaccaatttttctaaattgattgtttgttttgaactgaagtagtaaaacttaaagcttgctgacatagtcacttctggtctgcaacttccagtgttgtcctaaaaaatgaataatttgtttgtttgtttgtttcagactttgtttcaggagttcca

SEQ ID NO: 97755 - DNA, 1037 bp, Homo sapiens
agtagtagttacacataggggagccaattattatctgttattaataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaagcctcattacctgattgtcattgtgttggtagaataaacaaaagacaagacatttagattgaagcactatatgcagagaaaaaaaataaccctatttggtacatatattacaaatgttaattgtctaaactaattggatgaaatataaacatttcattttcatctttttatccagatggctgcatatttcggattttctgtagctgccactgacattaatggagatgagtaagtttaaaaaaaaatgtttccagaaagttatcttctcatgtttacgaatactttactcaaactaaacatttttttcttctgtttttgtattccttttctgctaatctttctgtttaaggaaacaatttgaagcaaccttaatcatgaattctagaaaacctcatatgtttgttctgttttttttcagtagcttttataacatgaacaaataaagtaattttatgaattattcatagtttcttaaaagaattaaaggaagtttcaaatttgaaatgagtgctctggtaatcattttgtgtttcactgtgggtgtgagagatgcagaaagaggaaaagtgagttgtagtaagaaagaaaatgcctactaagacatgaaatttgttcttgctttggtgagaagtttctgttcttctagttatgcagatgtgtttattggagcacctctcttcatggatcgtggctctgatggcaaactccaagaggt

SEQ ID NO: 97756 - DNA, 1068 bp, Homo sapiens
taaagatttaaaatgttattcatttatcttctttcagtgtaagttgagcaagatcaagatgaagtcacaacttacgaatttctgagcagattggcttctgttcagaaaaaacaataccatccataaataaattatctagaattttgagagtgaaaataaactttagatgaatcttttgatgtgtcctcctccatcccctacccctagttttaatgaggaagcatttgtggtccagaaagtttaagtgattggtttaaggtcagagccagattatctggccctaaattaatgtcttttctgtacagttttgcttgagtttccttgaattagattattgcttatggataaagagtaccctactgaactttgaattagtatttatcatgatgaatgggttctataaatattaagatctgtacaaataattacaagtactgaaactttcttctcttcatccttgccctcttccccccttctctcgttccttcctcattcttccctttcttttcctcctccttacttctgtcattctccttccccctcctctttttttccccacagatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccaggtgctttcttatcaacacatagagcccttagatttttcagtcctaatagcaaatagtattagttactgttcttgatttatgttataaattattgcaattcagtatttcatatgttgatcaaacctctaaaatattcaaggcatcattcccgtcacctaagggtatatgaagaaaagtcagctctctttcctgggagtgtacagtgtactctgagtttctcctgtagtctttaatgaaatgagaagagtattacagaagttataaacaaaagttaaatgctcattctaagctgttttaatgttagctatctttttt

SEQ ID NO: 97757 - DNA, 1052 bp, Homo sapiens
ctaacttttttggtacatattaaagactctaatctttattttctgtccttactgctcactatatactgagtggtaaatattctgtcatactaaattttcattcactattttttaatcatatctaagagtttatatcaaaatgctgatgtaaaatgtttttcattatcatttaccaccattttattaatgtgattgcattagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttgaacaactacatttatttttataccatgcattcctctcactttcctttttcctagtcagattaatgccatattttcttcaaatgagctatttttgtagatggctaataaaactagtttatgtcccaactttgattctcctactctagttctttaactgtcctctttctgggcctcctcctaatctctgaggctttagtacgatactaaaaaatccagaaggtcccaacaaaaatacattggaataataattagcacttgattaacctttgttgagttagcctatataatggctataatgtttttaaaggcaattgtttttcttttttcttttaattaacaaatctccagatctctagtagagaacctggtatagtgttttttgtttgtttgtttgtttgttttttgacacagagcctcactttgtcacccaggctggagtgcaatgacacaaacacagctcactgaggccttgacctcccaggctcaagcaatcctcccctatcagtcccccaagtagctaggactataggcgctctcccccatgcccagctaagttttgtattttttgttgagatgaggtttcaccatgttgcccaggctggtctcaaattcctgagctcaagcgatctgcccacct

SEQ ID NO: 97758 - DNA, 1477 bp, Homo sapiens
ggtctcgaactcctgacctcaagcgatacgcctgcctcagcctcccaaagtgctttgattacaggagtgagccactgcacctggccttaatttttcttacctaattgcactggctagaaccttccgtacaatattgagtagaaatggcttgattgctattgtcttatttctgacattagggagaaagaaggatgaagtatgatattagctgtgggctttttatcaatgccctttctcaggtcaaggaaactcttttctactcctaatcgtcaacaaatggtaccactactggataacattgtcatgaggtgtatatatgtgatatgtctaatacagtgtgatcagcatatagaaggtggtgaatatttatttcttttggctgccaacctcgaagttactgattaaaacattaaatgtgtcagaggccatcagcatgcgatttgatttctgtaggccctccatggaaaaaccattaaaaattctgttttcttttccatggggatgttgagatctggttattatatcttacaaatatcaccatgttatgggtttgcctaaagaatattgagttctagtcatagagtgaatcttttaatattatggatcttatctttctataacaaatcacgataaaaccaaccctttcatttacaaggaactacatgtgtggcaaaagaagaaaaagaaaagaaacataccaaccccttcacaataaaaagcattcatagactcaactattagcctgtttattttcaagacagaagaatctggataatctctttggccatcacacaaaaagaaaaaaaatggcaaattttcaaatgttgaagagatgatagaatgaccttttcttataagtaaaggatttgttttggcagggttgtggagttgctcagtgcttgaagattgtctgccaagttgggagattagacagaggaaagagtgcaatcttgtacgtaaagtcattactgtggactgagacttttatgaatgtaagtagacaggtgcagcatttagcaaacatacccagtgttttcaaataaatataaaaggcctgatatctgggaaatcatctaattgttatttccaaacagaaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgttta

SEQ ID NO: 97759 - DNA, 1093 bp, Homo sapiens
atatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctagcaggattgttgctactggctgttttggtatttgtaatgtacagggtaagtaacggacttagaaagaaggagagagggaaagcagaagaaaagggaaagggaagaaggaaaagaagaatgaaaagtaagggaaggaagaaagggactgtaatgatgatacttgatgagcattacttattatatgagggaagataaattttatgaaatacaatttaaatgttcttagtggtaatatagtcacccaaaaaatacttttcgtattctacactgatgtgacagtaataatggtttttcttcaactgacagatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggattttttt

SEQ ID NO: 97760 - DNA, 2437 bp, Homo sapiens
caaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtaccacttttgtgtatggggtttatcctttctgtgacgtgtttttgttttttgattacatgagctagcaataatgcactaaaaggatgacctcagaggtaactttctgtaaaacttcaaatcttgaatgtcagttatttgatgaaaagaaacacaaaaagagcaaaatgtaccacattaaaattcatccttagaaaggcaaatatgtatttgcctgaaatataagaattattttatttctaaacaaacatttctaaattcattatgctaacctttattatttttacattatcagattccttttaaaatgcacatttacatcttttataatttttaattatagtgtatatatgtcattgcatatatgcagttgcaatatacatatgcaattctagtataaaaatacctatttttataaatgaaaagtaccaagaagaaaattaagtgttgagatgcttgggaaattatactgaagtagcataatacaccaccgtaaattcct

SEQ ID NO: 97761 - DNA, 1030 bp, Homo sapiens
atcccctgctcatgtggttttatggggaactttctcctctggcttctgaaaggatttggtaaatggcaggccttgttggatgactggatagtcaaaggaagactgaagctagcatatgtctctccaccacatctgtggtgtatcttccatggtttcagcttcaatggaaaggcccaaatggttctaggattcacctgctgttcttggtctatgataacagaggctcctcttctcatacgtccaatctagggactgtagccccatatgtactagcctagctttttcccattttgaaataaccttgattttatgattgggccatgtttactataggttgtatgtgggaaaagagaagaagtttgctccctgtcatcagaaaattttctctgttctggaataagggggcttgatgtctggcattgctatttagacgtaacaactaacatttgcaaagaaggatacaacttacaaccacattcacacatattatctgcaacttactgtgggcagatatatcttacatacaaaatgctaaagtgaaattgatgtataagtcatatatcattttatcatacacatctatttcgaagttactgtgggtgtttaaacaggaaaaaaagcgatagtaatttcctgttttctctgtttctcaaattaggttaattgcatctagtgcatctcttttgtttctgaacataggtgataactggaagctcatgagatcaaagtggtggcaattaataatcattttatattctacactgtgcaaggatgatgataatacacatcccacacattggaaaagtgtgtacaatagtacaaatcaattacaatataactctcctagactgctagaaaattcctctaatataaatgattcttagtgacaggaaatgtcaacattttctagaatgtctagcacacattctcaccattcaactttgatttatgatggcatatcatcatgtcaaaggatacaaaatacaggcatgtaggataaataagcctagagatctaatgtacaacatga

SEQ ID NO: 97762 - DNA, 1052 bp, Homo sapiens
tctttatgacctttcaattttaagttcactggcaaccctccttctatactttatcctcaggtaagtggcccagtatacacatgcggggggaaaaaaaaaagctccacagtgcttgtttttccattcccttccccgttttttttttctttatagaatatcactttccaccaatttaataccacttctcctgattaatgaatagagatacatactctttcttttttacagagagagggacaagtttaccacacattcctactcagaaacagattccaatctctaatctctaggcttttatctattacctcaggacactggactcactctaacatattatttctatcatatatcttgagcattatgattgcaaagaatttgaataaaaaagaaaataaaagaagaaaaactggccatatccacattatgcagaaacaatcactgttggcattctagcatatctcatttactattttcttgtattttttttcaacttaccacaaagtaaataaagttcaagactggaagtagctgctggaggagcccgaacaatatagaataagctcagcataaaagtatctttttgtaaaatttaacctagcaaatctctaagctccctacctaataaagctatctctatagtaatcatcctcccaactgattgcatgtcctcttaaatatttgcccaatggatacatatataaattctattctcatttatatgtgcttgtatatatatgtatgtattgtgtgttggtacaaaatataaattattatattttcttgattctaacatgcaggtttttctaccttttaacatgattctaatgatgatgaaacttataactgatagtgtataacagtgtaattatgtttttctttctttttttttcgagatggagtcttgttctgttacccaggctgaagtgcagtggctcaatctcagctcacttgcaacctccacctccggagttcaagtgattctcctgcctcagcctccctagtagctgggaccacatgcgtgtgccaccacgcccagctaatttttgtattct

SEQ ID NO: 97763 - DNA, 1061 bp, Homo sapiens
aacacaatcactgatataatcaatttataaatctgcatgagattgttattatctccttgttattatctcgcctcttgttgaacgtgtgattgcatgtagaggaatactgaaaccatgagaactttctggagagaaactctccctcaccggctaaagagttccacatccagctgcataccacaggccatcacaagcactgtttacagttcttaaaaaacgaacaaacaaacaaaaaaaacccacttcatccacagtccactttcatagttctaaagaagtatcttgactttcataatgtgttctaagaccaagaagcacaggaacatccctcataatctaaagatgcctgcatagtaaatctggagcctcatattctgattttctgacaagttggctttccaaaaatagataacaagttttggacagcacccagcaagttttctacttcctgacaggaatgctgatgagaaacaaaaatgtggcacttcatctctgccaaaatcactgccatcaaaatgcagtcaccctagatgaccactgtctacttttctaatccctttcttcctggaccatctttagtcttaacacaagataatttgttgccccagtcataaaagtcctccagagaagtgtttctcaagcttgaataatatatagatatctttaaaaggaaaaaaaatcacagacttccaatttgtaagccaaattacttaaaataactttcattttgtatgaaccagtaacatagtaggaataaattcattatgatcattatacaactataaaccaaaaattgtttacaagttaatactatgcaagctacaaactaataaataatactaatttgataagacttcttttgcttaaaaaaaagaaaaatccttattgtaatatgaatttaatagtgactggtgtagggcagcttagtaatgtggtagaaatagcttagacaaacttgagctactctaagttgtgtgtaattctctaccttttttctatttgagtaatggaaaatctttgcagaaatgaaattaagaagtattaatacaaaatggtggctg

SEQ ID NO: 97764 - DNA, 1410 bp, Homo sapiens
ctaataggggcttaggcaaaccaggctgtatagacatgagacaaatagataaataaatagatatcagaaagctcagatatgactcagatattgtatataacacataatgtaattatatatctaacataagtaaactaaagcatattagagagagagagacaaaaaggaacagtcatatgtaacaaattatacatgacctttttgacatcactgtcctatttctagtcatcgatcatgtggtaatttagcttcatccacttgcctaaaatttgtctgcattgtccactagtcctctatctattgcagatattttctgtcccttaaatataacttttttccgtccattcaaattggccttttcattatcattaaacacaaattactcactcttattctaaaggatgttttatgttattttccccacctaaaattgactgaccctcctaatcttcttaaccaatctgccttttcactaccataaggaggccttctttctgtctctctcccctggcttcttactatgattccttcaatacttgtactattagatattgtgtttgctctgcctcactgtctagattacaagatttttttgaagaaaaacataatgtactatacagtttatagacttcccccaccctcagcattgaccacagtgttaaacatataaagatgactcacattttttatttatcaattttgtgatccacagttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaacatagtcttctcactgcacctcacttgtaaatgtctaactagcaaagaaaaatgaatattctcaggagttcgtgctagttgtgagtcttttgaccggacctaactattcatggaaaaaaagtcatttttttcctgatttttatacatccctttgcttccatacatcaactatttgtttttgttttgttctgttttgttttttgttgttgctgtttttgagatggagtttcactcttattgcccaggctggagtgcaatggcgcgatctcggctcactgcaatctccgcctcccaggttcaagggattctcctgcctcagcctcccgagtagctgggattacaggcatgtgccaccacgccccgctaatatttgtattttcagtagagacagggtttcatcatgttggccaggctagtctcgaactcctgacccaaagtgctgggattacaggcatgagctactctgcctggc

SEQ ID NO: 97765 - DNA, 1076 bp, Homo sapiens
atgcttttcctgagaagccaccctcaatagcttgaaatgttcatagaccttccctaaatgttaatacacatgaacatattaaaaataattaaaccacatttttgccataatgttttgtaatttcaaagcaagagtggtacatggtaaaataatcttttattccttaaatttgtaaaaaaatgacagttaattccctattaatttactatgagaaatttagaatttgaaatgccaatcccaaaatatggtagataattttaatagtgtatatttatggataaagttagatttttactttttaatttttatgcttactccttcaataacttagccaggtatttataaattttattaaaatcagtaatttatttacacaaaagaatattgctttctgacatttttataatttctagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtcgtaagtttatttcttatttcattttagttcatttataggcatccttttaaaactaaggcatctcagatggcattctatactcaggttttgtttgagccatgcaaatgaagatatatttgtgtgcattcaatgtgagatttgtgactgtagttttttaaaaagcacagaaaattaagaaattattttcatagatctaatactttttatgttgcattatttaattcttcttcctgagaatactgcagtacaattttggcacaatagaattgctgaaatctttcacatttatacaaatatgagagcaaacagttactgaaaaccaccacctaaagtcactcagttttatctgcctataacatttattaaagggatgacttaaacattaactgctacgcttttttgaccaagaactacagttactcatggaaatattaccttacaattatatttaaagattcactgtttgctaatttaacatagcaatgt

SEQ ID NO: 97766 - DNA, 1077 bp, Homo sapiens
gttttatgtgtaaaaagtgacacaagtgtgggttagggagagaaattcaaagaactgtccattagctgagttaaaagaggtctattgtggacacatccacttgaatgaagttgccttacaactactactcaattccctcccagttcggttggtacgatttaagcaatacctccctaacaagagtctagaagttgtgtttcatttggtgaatttattaactttatctaccattttgataactgaataactttttatagtttcttagtatgttttattgtacttttccttaaaatcaggacatattaaaaaggaaataaagaacattattacagtgttgatggagattacatgttatatcttttatttttactttatagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagaggtaggtttctgggaacccttattactcaagaccctttagggctattgagtctaattatggatttgataatttagggagaaaagtaatttcatgctgttttaatatttccaaggaatcttttatttccacatttttagactttcagggaatcctaaaaacatttaaggaaaatgataattctgaattgtaccatgaaatacccacatttataggtaccagaaactctctatatgcccgagagacattttaaagcaaattatcaaattttaggtacggtcaacttgcatgttcaactatcatttttcattttcttcatatcagtgaattataaaatatgaggccccatttattgtcttatactcttatccataataaagacagaagaaaaaaacctcaactcatgttcaaagaattgtgaagtatttttaaaataaagtgggtgtaattcggcctcccagacttgtaatctcagttggcagaagaaaaactgttagtcacattg

SEQ ID NO: 97767 - DNA, 1069 bp, Homo sapiens
ttctgaaaatgtgtttcctttttaaaagaagaactagagcagagggaaagataaatcaggaattaaaagttgcattaaagaaataatagaaaaatgcctaaataattattggttctgactgagaaagaatagctgtgcgaaagatgtggaaagtaaaattgcacatggaaatggactttaatacatacttcgccatattgatcagcgtttacccatgtctctcaattactgtcctttttatttatattttcaaagttgaaatatgacctgtttgcttgaatattaataaatatatgcactgaatgtgtttgcccataattctgaatactacatatacattttaagtatgactcattgagtatgcacagagaaatgtatgtgtatacacataaaatggcatagaaatttgcatatgaggtacacatatgatgtttactagtctgtaaatgagtgcatattaacactttatttattagatatgtatgggttctgtatttcagagatgatttacacaatgaagaaagtacatgcactttgggcttctgtatgcctgctgcttaatcttgcccctgcccctcttaatgctgattctgaggaagatgaagaacacacaattatcacaggtaaaatattagaagcaattatctttttaagctagttaaagctctcaattttaatctaaaaaatctaccatagttttccattgtggagggaaattagttgttattgaagtgatatttttctttggaaatttattatacctaatgtatgtgtgtgtgtgtgtgtgtgtgtgtgtgtgtgtgtgtgtacatgcacatgtgtgttttaaacagtccgaaaccaagtaactttagctgaaacacttctctcttttttttcagcatacaatattaaacactggagtagctccgggctattgcaaggagcaaaatgttgtaaaaacaactccctatgacatttgatgctaccctttggctaggaaaagtgtgaggaggaaagggaacttcagacatctgaggtttcagctattctctctttcttccccatatttccaaaatcaaaacttccc

SEQ ID NO: 97768 - DNA, 1018 bp, Homo sapiens
tgcgcaattttgaaaaagatctccaatttcaaaacaagccttctgggtactttcatagttagtctgcacaactaactgaatcagaaaacaaatatattactcaatttcaggttacaagaattgacctccagggcagtgccttctgctctcttacatgtgatttgcaattacagttgagaaataagggtagagaaggaattcgaaggtgaggatctgttttccctgccaagtctttccttcttattgtgagcaaaaaatacactttctcattggagaacacttacagaaaacagtcactttcccagaccagtacttcactcttaaggaacaaccaaaaacaaacgaataaacaaacaccatagtttgggcaaattatcataaaatgtacaacataagaagttggcgattgctgtattttcaatagaaatgtgattgatatgaccagtcctgcctaaaggttagtaatgccgcaagaaacagagaatcaaagtctatagctatgtggaaaggaaagaattgaattgcacattagaaagtgcactctagggctgatgtatcttcagctccagcctactgatagaaaggcagtgacccccacttccaagacaaacttgcaaccaagttagagacactttcttgaaacactaggaatgttcctgctctgagttgtgtttccccaaaatgttggatacctaacccccaatgtgactgcatttgaaggtaaggttttagggggtaattaacataaatgagataataaatgttcaatcctaattcagtaggattgatggccttaaagaaggccttagagaaaagatatctttctttctctccatgtgcacacaggacaggaaaggccatgtgaggacatagggagaaagcagccaccattggcaagccaagagagagccctcaccaggaacgattggaccagcaccttgatcttggattttctagcctccagaactgtgagatacaaatttctgttgtttaagccacacagtctgtgatattttgt

SEQ ID NO: 97769 - DNA, 1035 bp, Homo sapiens
ctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaaggtagagtaaggaagacttagctggtgttgggcttggcgggtccacttggtacgctgggcaaactccaagtaagtgagggctggcagtcaaggtacccctccctaggtcctagtagtgtttcccaactgagctcgccttactcatttgcaatcagacattttacatgcactatttcaatctgcaagtttgacaaagtgtaatgcagtcaattaggaaggatttaataaatttattttgtgcctgcttttaaaatacgttacaccaacatttgagaataaaaagttacggagaatgttcaagtcatgactgatttctaggactagcaggagacaatactgatgattttgtgtctgtattacaaaatgggtgattaggtgctaaagtaagggagattattagacagagtgaatgtgaggaagtggaaaactttcagaggaattggaaattcttcaaatttgcaaattgctccctttctctgccagtctttcccttttccccccatatgaacaagtagccttggctggaaaacccacaaattgggagagtgcagtcgctggtgactacaggctttgctggaaacagcagacaggctaaggtactgccccactgcataattaaaggtctccttgagctgtccaggagtgttttccaagtttttacgactgacaaggaaaaaaagagaggaacctggccggcagccaaactagactgagctcagtagccaggcatgaaagagactgggcaagttgcaggggctaattggaaaggggctgtcggttgcacttggggtttaaacaagaggtttcttt

SEQ ID NO: 97770 - DNA, 1515 bp, Homo sapiens
atttttaaagtccagcttaattttacctttatgagaagttaccaagtatattcacagaacttggctctcttctcagaaataatgcttgagaagctgaaatatatttatgacatacaaacagactttcttttcttaatggccacaacaatttccttaagaatttggaggatagattttggagccattcattaataaatccagccaatgtttgttgcatgcatatcatgcatcatcgggcctgtattccaatcagcaccgaacttctcagctctgtgatttctgtgcatgttattttacttcttaaacatttttccaacatatcatttattgcctatgtttctgtctataatttatgagcctgttcattgttgattcattatgatcattgtgaaatatttactttttagtgtgacatgtcaattagtaaaatatactacatatttttatggttcattgtactgtgctacagtcatggatgtttaacttaactctttttcgggtgaacagatcaacttattagagaaaacagaataagtatagataaattgtttaaaggataaagtcttttgctaaaatacctagtcatagcttttatttttagactttatattataattaatagtgaatctgtaaaaagcacgtgtatatgggatatagtagttgggttgaaacttacactatgggtatccttgaacaagtggctgtttgaggatatattagggtaattttaatataaaatgtcaaattttacctttcattttaaattagaaatccttaaaattcttatttccattgatgaatggtaggtgattttaatttaaattttacttagcagagtgatgtatttgtgattcaattcgcgatattgcaatttgttttctaaaacctctaaagaataaaaaaagttattttatttcagtataataatgaattcaaagatagttacagaagctaactgcataactgccatgagccctggtccctaaacgtattagaggctggtggatctaatattgtttgccttaatgcatttagagatcaggaaacttaagctttttcccataagagcataaaatatactcagattggaagaggaaaaaatggtataactttgaatggagaaatcgcttcactttcaaatactggggatatgaaattgaaatcaggcctttatttttaaagagaatggctaaaagtcattgttccagagtaagacttagaaaacaatgcttatactgttttcaggcccttgttatttgcgagttttttgtttgttttatgcctaagaaatgttttcagccactctaatgatgcttaccatgcatgattgtcatcagaggacagttaattgactcaaatattgtgtgggatagtaagtgtcaattttctgtttacattgaaatggtatagttatggcgaatttgaaattagttttgtctttcagtgtagtatacttaaaaatagttttgaaaaggctgccctaatttgcacacataatatgaataagtaagttaa

SEQ ID NO: 97771 - DNA, 1120 bp, Homo sapiens
gggtagggttggaccgcacagtctaagataattccaactggctattttaaagacagcaggggtatgagctggagtggcggggtgagaagctttggtgggaaggacggttacagagcaggtgaccaaggatgactaaggacagagcaggtgactaaggagggagcaggtgactaaggatgactaaggacagagcaggtgactaaggagggagcaggtgactaaggatgactaaggacagagcaggtgatagaggctaggagggggttgtttactaaagctagggacaaggagatgtaaagaacgaggaagttaaactttcaaatggaaaacaaagaacagggaagctcaatatactaacatattggttctttgaagaggaatttactgtatcctacaatgtaatgaatctttctttgggactttcttattcaatgagattttgtctttattcagtgattttccattcacttaatatacatttgaagtctttccccccttctcattctgggaaatataactgtgtttaaactgtgcatctgcaaataaagagattctgatatgatacagttgaatttaataaatacttatcaaataacacttgttctttttgtagttgtgtgattagtaggtgacagagacctcctcttattaacttaaatagaagttggtatttctatataattctgaggtacagtgcagaggatgttgaggaaggaggagtggggaaagcgggtattcaccagtgtgaagggaagcagtgtatggaaagaatgtgtgcaggtgattcttagaccaagtcacagaggatgaggatgagttgggcaggcattgaaaagggacagtgtcagtcagagcaggtgggataggcaagaaggcatgaagccatgaatgtggtttaggagaacaacttgtggattttacagttatagagatgttcctcctttatgtttccatgttcatgaactaaccattagtaattacataaaggagttttagctggattaatagttttagctgaataattttagctggattatcttgcaaaacaaccatcttgtttttctttctttttttccatttctccagacctgatcagcatgtaattggaatcacaaggagt

SEQ ID NO: 97772 - DNA, 1039 bp, Homo sapiens
ttctgtgttctgatctgcattgccaaatttagcaagaatcctgctaagtgtctttggccatcctcaatatttgaccactctatatctaatgagggtcctcaccttccaccatttcccagatgatatctcatcaccctaaccttcattcagcaagaatcctgactagtaatttttcttccactgtcttacatcctgctatttggctacaaattcctactttttcttgtagtatttgaagttgagcctaatttttcttactcactgcaaaaaccccattgcaatggtcccaacgcctgttatgatggtcctgaataaagtttgccttcctgttctttaataatgtcatgaatcatttttttcaacactaattttataaaactctagttcactggaaccattagcaatttaatctttttctgccaccaagttcttgacctgacccagcctttacaatgacttagcagtatgcatattggtttttgtaatgtgctctaatcaaagtagggagatatatatctctttgtctttttgccctgaaggtggtaggaataacccaaatctgagaattgacaagagcagggatgaaatatattttggagtattattgctcgctttagctgaaatagttaaccaagtagtttaagcaggaggtggaggcaagcagaactaggactaacctaacctgctgaaagaataggcaaagtgtcataatgggcaggtttgctgggaatgagggatgtgagaaataaaaagccagaggttgtgtgggcagtgcacttgaagagagttggtgaaactgtaggtaggaatgttacagatgctgaaagtctgcagtaaagctgtgtggcaaccaggtcattggtcaagactgagaaaggctaatgtattagaactggtatcagtatgggtgttaaaagcatggagattgggttggagggaaacatagccaataactggaatacctaaggaaagtgaaagagacattagagaagcagttattgatggcgacatttgaagtaacaagacctcctacattact

SEQ ID NO: 97773 - DNA, 1037 bp, Homo sapiens
ttctcctgaatgaaataggaaacatatttttacaagatatactggaagtaaagtgatagtcgacacaatctagtcaactgggattttgattgatgatctggggagtctaagaagcagtgacaaccagagagaaatatatttagtataatttaataataacctgatttgcatgtttttgtctgttggagtaattacatagatttatctcttatatctttacattgttttatttttccagattatggtgcagtctgtcaaatgtttatgtattgaaaaggccacttactgatagagtatgagaaattcagagtatacgtgtttttgttgtatttatatgtgccatgttaatggatagctttccttggaaagttggggaggacatagattttatttataatgtataataatatacttaatcatgactatataacttaaaatattataaacatgtattttaaaatatgctattaagtgaattagtgaggttttttttttatattgtggcatatgtatagtggatcgaagatgatattagatggaatgagaaaagtttttctgagagtaaaactatagttccataagtagattgattttatgatcacagctttttcttttccagtttttcattgttcatttttgataccttggcaaactaatctttagtgtcagccaaaatttcacttggctatttattgtaaattgccctaattgatgagtgaaaaaacttttgatacctgcctaatcttagttggatgaaataactgatttccttctaattaatttttgctccataaaatgatatgttaataaatgaggaaaatcagtcatgatctagaaagtgcagttattcttgttcagaattaaataaagcagaatggagaaaatgcaaagcatttttttgactgttgactgactatcgctatatatgttattttagtgaatcagagtaagtctcataaaagttgtaaaacatttagtcagagggtatataaattttttatagctagtaggaaaatttctaagtccttttaacatgc

SEQ ID NO: 97774 - DNA, 1066 bp, Homo sapiens
tattagccataaatacttattacaaaactttagatttttattttgttgattcagagctctttttttgtcctattctttctttcatttgatcttttttgccctttttactttcttctatcattgagcttaatatcttggagtatgtttgatggtgataagtttagtatggggtttcccagtcttggcaatattgacattttgggaaagacaactctttgttgtcaagggagtggccctgtgcattgtagcatgttaagcaacatccctggcctctacccactagacaccagcacagtgcccctagttgtgataaggcaaaatgtctctagatgttgtcaaatgtccctgggaggcaaaagcattcctagttggtgccaaatgtccgctgggaggaagaccatcaccagctgatgccaaatgtcccctagggagcaacaccatggtggtagagaaccaaagtttattagcatctctaaactcatatagtattttttggacatatttttaaaggaaaggtggctatccctgaaacataatgtgttttgaagtataattaaaattatcataaatagaacagtattgaaccttcactccttatgtgtacaattgactttaacgtccttggcagtaggtatgtatttgctgcatcattacatggaaagaatattcactgatgaaaaagtcctctccaacttgaaagaaatgttttcacatatctctgtgagtatcagtaacctggtataagaccttctttcctatgtcctgacaaaagtttatacagcactttgactcttggtattttacaaaaatgtatgcatttgggctatagcaatgcaatgcaacatataaacatattttctgagaagcatgttttgttaaaaaaaataaaacaaacaggctttcaaaatagatgctgcatcataaagtttaagtatgtatggattttctatacataatccttcaacattcatcttctatgtgaatatgggcaatcttcaatttaaatggaaataacataaactaaaattttaagattttacctaaaatttgcaaaactcagtaatgt

SEQ ID NO: 97775 - DNA, 1046 bp, Homo sapiens
tgattatatacaaatcactgagcctctctttctcagtctacatgtttgtgaaatgggcctattgaactatatcatgaatttattcttatgcaacatatatttgaaagcctgctatgagccagatactgttctaggtgctgaagatacagcatcaaaaaggacagacaagatccctaatctcacagagctttcattatggcatatcaggctgaaaataaacatattaaataaaatcatgtagtgattaacatcatgaagcagataaatggaaaaacaaggaagaatgtggctggagtgtcctggaatgtggtgggagacatccatggatgaggtggtctggaaagtcttcactgaagaaataacatttggtatctgagaacaaagcaatagttagcatgaatatatgtgggcatgtagatttgaaggctgaaggaggctcaaggctagaaattctaaggctataaaagttttgcttataggaggaccactaaaagactagtgtagctggtgggaaaagtggcaggagacaaggtgagaagttggcaggtctagatcatggacttatagtcaatggtttcaggctgtttctcaaacaccagtgtgcagatactctagggcaatccatgataattttttcatatctttgatgcctttgttacctttgacacctttgataattccttccaactctgtgatacctttcatggttttagaaaatctttccttgtgagtagtttcccagaatagaaaccagaaacttgcttctcctataaatatatctgtatctatatctatatctatatctatatctatatctatatctatatctatatctatctatatatttttttctttccaaagtcttgttctgtcatccaggctggagtgcaatggtaagatcttggctcactgcaacctctgcctcccggattcaagtgattcttctttctcagcctcctgagtagctgggattacaggcatgcgccaccacgcccagctagtttttgtatttttagtagagatgggggtttcatcatgttgaccag

SEQ ID NO: 97776 - DNA, 1041 bp, Homo sapiens
gattgagaacatcctggccaacttggtgaaaccccgtctcaactaaaaatacaaaaattagctgggcgtggtggcaggcgcctgtaatcccaactactcaggaggctgagacaggagaatagctggaacccgggaggcagagcttgcagtgagccgagatcgtgccactgtactccagcctggtgacagagaaagactccgtctcaaaaaaaaaaaaaaattgttttgcttttagagagtgcattgttctttacagctgataaagcactgcaataagcattattgctctcgattcacaacatcactgatccataggcagaggaggtattgctattattttatcacaaataaggaaattgggactcagaaaaattagtagcaatagctgcaggttgagggcttttgcaccaggcatagtgttaagaaatttactctatgctgtagaatttattattaactggattttgtggttgagaaaattgaaaagaagttaagtaacttattcaagtgtatgtgacaggtaagtgacagccatagcacaaacccgggaagatggacccaacagcactctgagctcctaatcgtaatgctttgctgcctttttagggtttccacacatgagttgttgttgctgtttttccttcttctctgggtcttctaataaaacttctaataaaaataaactgtcagaaacaatgcatttattatgtaatatagttatctaaatgttcttcaaaaagtccaaaaaagtcagtgacttaactatatattaagtcagcttaatatatagtcatgcttttaattagcacacgtgtagtttcagcttctagtcagtgactatctcaaagcatttttttttttttttttgagacagggtcttgctctgtcacccaggctggagtgctgtagtgtgatcatggctcactgcaaccttaacttcccaggctcaagtgatcctcccacctcatactcttgaataattgggactacaggcacatgccaccacgcccaactaatttctttttctattttttgtagaga

SEQ ID NO: 97777 - DNA, 1061 bp, Homo sapiens
cttatcaattatttttttcacagataaatttagtgttttaagttggatttggatagtaaacatacaacatctttagatacgtgtttcaaagtatctgtaagctgatatgcctccattctgttctcatttcattattttttaacattaatttattctttcaaaagatatttattgagttatacttatatgccatgcattgtaccaacttttggagatgtagtgatgagcaaagaagatgtagtcactgataattatttaggctccagagtgatatatgctataagggctaaataaacggggctgtgattgtattttacagttcttaaaatgacagtaaaataactgacttaagataactaccaacaaactcaaatatctatctaactaagccaaacttttggaaagcttttctctgctagcatggtattgaatgtatttcctgttatcatatgcttcatgctcctataacatacaaaatgaaagcatttcattagattgtgatcaagttagtctcatgggaaaatttgcctcagtttattgttttgaatgtaaggtggctttatagttagttgtaaatataagagcaagatgaactgtattaaaaattatattgatgtactattagttattgcttttctgaggagaagggaggtgataggccccaaataactgattgctcgtttttccttagcatggttttggaaggaaaagactttgctttttcatgtgacattagtaatattgtaggacttagaaaactgaactcaagatgagatgctgcttatgcactggttaactttaggaattgtgcaaaaagatatattagagctattacacagagaggaaagaatcagtgagtaaatgaaccaggaaagagactggggactagctaaatgtagaggttttcagtgtttgttttgtgattgttctgtatttatcaagccttgctgattttttgtaatgtcagttgaacttctccatgctgcagaattttgttttcccattggcaagatgctctgctgcctcttgatctccaattctctttggttgacatcctgtag

SEQ ID NO: 97778 - DNA, 1008 bp, Homo sapiens
tttggctgctgtttttggaaagatagcaaggcatgacatgcttatgtgaatacagagcaataaaacacaaactgccttttagaaattttattgtgaagtttgtatttcattttattatctgattttaagaattgaaaagtaaatagcccaaataacagtcttgattttaatatataataaatagtttagttaccatacaattgaagggtattattcaacgtaatcatgaaatatagtttctcttttatggtggcgtgaacctgaaaacttaattattttccccaataaattagcaatttaaagctctttgcctttctaaaatgtcactgcattgcgtaatattgcgcagatgacaaagatagcttgaccatgacgtattaaatgctaaatgttacgtgcagcatgtaaaatacgttctgctttgtaaaattatttgatagagagtcgctgtcattgtttttgtcaatcatttattcatctgttctgtcccaggcttctttttatctagtcattttcaagaaacgctgatgcctgcttctgatctctagtgatttaaattagagtctctgagcatgaaaaggtgctaggccaaggtctaggaaaagaaatcctaaggcaggaatgactctggcttgtttgaggcacagcaagaagatttatagaagatttttgtgaatggaatgggtggggcaggggaggcaggagagaagagagagagagagagaaacaagggccagcttatgtaagatctataggtctgtaagtgttggcggaaactatgaaatgatttttatgcgtggaaatgatgtgatattatttgcataaaaagatcattgtgactttaacatcattacagaaaaaatatggaggacacccttggaaattgcacatttgatgtttgttgtgatttgttaggtgttcacacctaaaccaaattgaggtaattctgtttggcagattaattgtatgagaagaaaactttgttggcggaaaattgacacttatcta

SEQ ID NO: 97779 - DNA, 1045 bp, Homo sapiens
agcacaatttggggacttagaaaaaaagattatagaatgaaggctactttggttcctatatctcagggctaagtagaatgatatctgatgaaatctattccatctcagaaataaagcaactttatctcagaagattgcagggctgtacatatctgtctgtgaaatgtagctggagatactgaaaagtttaatggtaattcctgggggttagttttttgaagacccccatataatttggagagtgtgccacttactctgcgccttagaaaattaaaaaaaaaaaagtaagtttggggaaaatgttaacatctgtttaaatcttttgtcactgtagagcaaagctgaaaaaaggtattgcaataggaggcacaaatagaagaaccttgagtgtgatcttagaaaagaagacatggatgaatataggtgaattagaattgaagctgatgccaattttctgattgtaagtccatctttttccattataggattaaaagcacaagattgttaagacctgaaaacacatactaattgagtcctgaaactgagtgttagagtaataatgaaaggaaaatactttcattatttcaaaataccccaaggtaccttggattgagtccgatcattcccagttaaacattaattccattgtttgcagagtgatacaagtaaccaagatgccccagtgctctgttagaagattgttgattgacaaagctcctttctgcaaatgttttgcccattctgtgactaattcataaaagtttgtttgttttatttttaaccaatgaaaagagaaggaaactatcatctagaataaagtgggaatatactttagaatttttattaaatttatctttctagcatttcttattaagcagtgtttccactcttcaaaatgaaattcttcttaggtgatttttctttcttcccctctctctttttcctcccttgcttcctccatctttttttctcccttcccctgtcccacactactttcttcttttttctcttccttcttttgtttttcctttggggtggggtattg

SEQ ID NO: 97780 - DNA, 1049 bp, Homo sapiens
ctcttgtcctatgtccaagaagactaaggatatgctgacaatttcaacggtgaggatggcagagaataattttattgagtgatgggactgctctcagcagagaggggatgtgggagtgttcccccaatcctgcagtctggtggtttctcccccagtatggcttagtctggggtttttataggcacagaatggggagggcatgatgattagtttgtgagtatgcaaaaaggttaaaacaaaggcaccactcaaaggtgggcatgacacagtaaaaaactaattagggaaggataggtatatgtaaaataggtgaacagtggggatcaatcagaggaaagcatgccagacaggaagacaggttctcaatctggtccaaggatttacccaggacagcctttgacttgaaggtggggtttcaccagggaaccacctctatctgcctaggcatttgtctgcctcctgcctctgtcagtagatcaggatcaaaagggtctaattcaaattggataagaggacttactggtgaaaaggatgaggaaatccaaaactgaagactgctggtacaaatgaataaagaggatcagtaattttagtcactgaccttagttgtgacgaaatccacattaggcatagggacactaaagtgtatctttctcttctacctcttatctatgtcagaagaaactttaagaaaaccttcggctgggcatggagtttcatgcctataattgcagcgctttgggaggcggacatgggagggattacttaaagctgagttccaatccggcctgggaaacatagtgagacccccatctgtacaaaaataaaaataaaaacaaaattaaccaggtatgagggtatgctcctgtagtcccagctactcaggagggtaagccagttggatcacttaagcctaggagtttgaggttgcagtgagttatgatcatgccactgtactccagccttggagacagagtgagatcctgtcttcaaaaataaaataaaataaaataaaatgttcttagatataaatatattcacatgacaga

SEQ ID NO: 97781 - DNA, 1121 bp, Homo sapiens
gttgtgaaattgcaaagaataaaatgatctgaaactttgtcctaactttagcttatgtagccatataatactaaattccctgggcttacataagattatggtaacataaattcattcataattgtgtgtgtgtgtgtgcacaggcttcatgtatcattgaacaatatgtgaggattggtagtagatagattgaaagcaatgaggccacaataagtttgttattaatttttaggtaggaatttaaataactacgaatgtagtatattatagtgatcactataggactgaaagaaacagctagttagatgttgttttttaatgggcagaaaaacatggcatttgacaaactattttatgatgcacttataaagaaagatagaaaaataaatataactttgcgtaggtcagtgaagtttaaataatgtatcctttccattctcaaaggagttctctagtggagagcatggggctctctcctgttttacattattgatgaattggggaagaatgcttaaataatgataatcaaattcataggtgattgaaagcaagaaggtgatgatacatgaatgctgtagtaggattacagatgtgtgaggaaaaaatgacaagttaggccttattccacactataaacttactaagatactgcaaattgtcaaacaagggcccagaaaatctaatacttttatcatgattcaaatattgctgttatttggaagatgcatcttgaatgctgtcagagtaaaaatggctgaagaataaagtcaacagtgtgagtatcaaaggctctgtgtcattttctaatgtatggatggataatgaatagtccagaactatgactagtgttctgttcagtatcaggcagttgggcactgggtgttctccctttaaaaggttacagtgttaactgacacatagtaacgtgcccagatgagaaagactgagatgacttcaggactttcagccatgtaacaggaagcatgactgagaaccattcatgtgttaatgagagctgtctttcaatatttgaaggactgccatttagccatggggttgagtttagtaaaggacaaataggtgtaaatgataatgtcactgatttaatatagggaaaatga

SEQ ID NO: 97782 - DNA, 1195 bp, Homo sapiens
aaatgtcatgacttctaacttccaacattaataacatagagctaggaaagctctaaaaagaatgtattgtctgaaaaataaaactgacacgatgtcatgattcacatattttcaatttggaaaacatgactgtagaaattcattgggacttttaaaagcttggaagtttactggaagtaggaactatactaaggagaaccatttttaaagcagggcttgagttgcctatgtggtgtatatacccctacaatgcatttcaagcctaataattatttcatggttttataaattaaatgttgttataacaattataaagaaagttattttgacaggcaactatgtagatcagaatataaaggcaaaggtagttatttctttatcccattttgacagagagtaataggtatttctccaaagtacttaacaatagcagagaaaatgatggttaacaataattgtgaaactgtttttcatattcatagctattgtaaaaataaaacaaatatccagtgggctatttgaaatttagtgaactatcaaacacttttgttggtgaaatcacatattaatccaattgcaaatcaaagttccatcatatacatgaagctgctttatttttatttcagctaatcaacagtgaatcataagttaactggtttttttgtttgtttgttattttactttatgctgctgttgaataaagtcatagcctactttctgaatgatctctagcaaatttacaagattatatggcttttgactgcaaacctgtttctactcttccattttgctttgttgttttttttttgcttcattttgctaatttgttttatctttctgtattttatgagtagttataagctaccttaaataaatttttggaagtagtggaaaattttttaatcagtgaaattattttttaaaatatttttatttgaggaaggaacccctgggaattcaagatcaatcatcagcaaaataccctttgtcttaaacctctcttctgaaccttattgctgcttcttactctgaataaaaaccaattctttcataaggacactaaatccccagtagcctctgaagtggtatgtgttttccttccacaactatcctgtagcacctgctataacaggtgaattaaatgttctccttttctcttccctaaaattttccagctttgaatttcacattatca

SEQ ID NO: 97783 - DNA, 1003 bp, Homo sapiens
agaaagcaatagaaaatttctgtaaaaatgctctcaaagatgatggcaaaaacggtgacaatattattccagatgaatataaaagatacagtgaatttttgggatatatagaaatgactgctacttgtaacagagaattagatatattagaaactattcatgtaaaaatatgatttcagtaagatacgctgcataagattacattttaaactggaataattagacataagtgacctgccttcttaaatataaacattcaaatgcaattgattttttttgcattctcaaaagtagagtatattttagtttgtatttatatcaacaatgggaaccaactgatattcattgcagtacattttactcctgaaagatttcatcaagttttctgtaataaatagcaatcttataaactaaattaataatcgccagtgtactgcccaaatcattgagttttctgatacagtctgggccaggactgaacacatatagggaaagataaatgaaaatctcatgaaaatgtagccaagaagtaatatcaaaattagacatttatcactttgtaaaacagggaacaatatgtatatatgtataatctcctttgaaaaccatctgatttgatcagggataaaagagaatttccattttgggggaatagtggcgaaaaatttgcttttcctgtgagaacttggacagagattgcttccagtagttcatattaaaattagaattctcagaatacgtttaattttctgattcacaggtagtgcaggtgatgaaaaaatcaggcttattgtgtgtagagaatgatgggtttgctattcagctaaaataattgctagtacattatttttcatgcaggaaaattgctgtcatccccctttctttaacaatttgtttattgtatcccctcacccctttactgttactcagcaataccattcccctaattatcccattcctgtatcccctctcacttctatatctctactctttttcacgatac

SEQ ID NO: 97784 - DNA, 1341 bp, Homo sapiens
ggctttcggtaggcagccaaaagtgtctagcgtagtagccattccccttgagtattatcgtgtgcttagacaggcaccacagatcaccaaacatcttgggagaaatatgtttcaggaaataacaaaagatagttttacctaaaagtatggagccatgtagaagagacaaaactgttcttagctgaagaaaggctgaaatgtagagatcaaaagggctcactctgtcttcaggccccacgtcaatgtcttacctgaggtgagggttaatggaggactgggcttatgctgagaaagccctggacctaccgatctccctctggctcctctttccccacaacgaccacactgttcccacagttatgcctgcccttactcgcgctaacacctctcgtcaatccaacaagattgaaacgcgagcaagactcatcccaacccagcctcaaagagactcaaacagcaggtagagatgccgagaacacaaaggaccgtgttgtcagctgtaacaaaggcatgaatgaatatatgaaatggagataataatagtaaactcctcacagagctgttgcaaggattaaataaaatagttacacatgataagagctaaataaatattgtagtactataaaaagggtggactcatatatatggaataaaattaatggtgaatggtcactgcttagataccactggtgaaatatttgaggttcaaagataaacaatatcaaagacttccattaaaaaacaaaataaatgttacctacacaaaaagaaaaataagaatcatttcttattactcttctaccacattaaatgctaaaagatactgtaatatctactgcattttcagggaaaaggtttaagagccaacccaattctactcacacaataaaaacaatagaaagacagtatcaaatactcaaggactcagattaaaacccacatagtcttcatgaaaaaaaaattgttcaaaacatactttaactaagaatagcagtcagtgtcatccttttaaaaactaggtcaaatcatgtaattctttctgctcagaactgtccaatcatccccattcacctaacaggggtcaacacaacaaggaccaaaaaaatctggctcctatgacttctcttacctcatatccaactcccctcacccttggccattcagctgcagtcacagtgacttgaaaagctggagacattctcacctctgggctctgaagaaacagtcctttctttccctcctgttatctgaaagacactctctcatcttcttgctcaaacatctgttctttctgtggactccttgaccaattgtttatttgaatatcctcatccccagttc

SEQ ID NO: 97785 - DNA, 1123 bp, Homo sapiens
gtgagtctcttacagtctcctatttaaattgagttaggattacttctggcaaaatcccaacataaaaatcttctaggaagatcagttctgtaaattagacatactagataaatgggcatcaagcagtttttcaaaattatgcagttgttaacttcataaggggaaataaaaatgtatgcatttacattgtatgtattaaaacaaggcagagcatttctatacgttcctaagttatacaaacatatatgtaagagtgaaatatgtaaaaaaacttttacataagcagatgcatacaaactccagatgtgctctttttcttactgtgggttgtgtcttctataagggaaaaagaaatatttatcatttcttttactgctgaggggatgggtgcggctctcatatttcagaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaag

SEQ ID NO: 97786 - DNA, 1025 bp, Homo sapiens
aaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggc

SEQ ID NO: 97787 - DNA, 1015 bp, Homo sapiens
tttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattc

SEQ ID NO: 97788 - DNA, 1006 bp, Homo sapiens
tgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaat

SEQ ID NO: 97789 - DNA, 1050 bp, Homo sapiens
tgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccac

SEQ ID NO: 97790 - DNA, 1046 bp, Homo sapiens
gcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctcccta

SEQ ID NO: 97791 - DNA, 2020 bp, Homo sapiens
gggtcaaaagattttatactactagttaattctaatttttattataattagcaataaaaatgagttatttttgatacatgagtgaagcagatttaaaaatacttatgcttgttctcgtgaattattgttattattggtttcattaccctttgggttaataaggacagaggttcttttgagtattcatagacattttaagatatgtttagatgtacagctagaatagcttactttatgacaagaattaaagtaatactcttcaaaattgatttatctgaaatcaatttatatatttatctatacatgtgtaaggcattatgaaacccttcagtcttgtgtatgacaaagactctttgtttttctagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctgtaagtactttttgatctacattgatctggttgaggaaaaaaaattatttttgttaaaaatactattacagcactagaactgggggcaattttaccttgtatatgagcataatagcagtttgtttatagtcattccttagggtaaatgtgtgtgtgttagcacatgaagcatgatagaggtttgaatccatatagtaaagaaagaactggatccctaagatctgatccagttcttctgcagactttctttggttcttttccaagttatttaacttactgaatctcagtcccatgcttaaaattccttatttctaaaatgcgtaattaatccaagatactttattttttccaccaatttgtaagtaagtctccccgcttgcatattgagatataaaacgaaaataatactaaatggtgaattatagtttcatttgtgaaaaacaaaaaagctttcataatttatgttgctagtgaccatttgggaagctgcagaagaacaaaggaaatttacttaaagcatgaaagaaattctgttacataagtacactaatatttcactttatgttttcattccttttttttaagtagtactctaaaaatcattgcctttacattataaaagtgtctgggaaggttgctgtctaacatacttggaaaaaattgtatgtacatttaacccattgcatcatttaatttcagaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaagg

SEQ ID NO: 97792 - DNA, 1005 bp, Homo sapiens
aactaaacccaaaaaaattatttgttaaatgttcattgtgtatgaataactttaaaaatatatgtatattatattttatatgcaaatgcctttaaatattgtgtttagataactcttttttccttattgttaaactttctttttgtctttttataaagaagaaaaaatatttctctgaagttacctcttttattgagtcagtattcacattaatcttcagtttctttccaacggatgagctgttttcacctttaaataatgttagaggttctgtgcggattacaatttatgactactcatatgcagtatgattttgagaaacagagaacttctttttcatactgaaaaacctgtaaagctgtacccaacttattgtaaattccttgggtacagttttaccctggatagtttctgattttagtttgtcctcaacattagggtccagatggcccccctggtccagctggaacgaccgggcagagaggaattgttggcatgcctgggcaacgtggagagagaggcatgcccggcctaccaggcccagcggtgagtagctgcatcggtcaatattttatctcatatgtgcaatacaaattgtttagagaattgattttattttttttgcttgatgaatagatttaaacagtattgtagggacattaatttttgagtctcttaaaaatcttttgatcttaaatgtcaaattcttaactaccttacaaagtctttgaaaatatatatttgtttaaccctgagactagaaaagtaggcaaataaggatatggatttttggtgacctttaaatccttcttcaaagattaaaaagatcccggagctagaggagggggataatcttctggtgaataggtagtgtctttttaagtaaacatgcttaacaaaaataccatattttacagtaaaccatcaaagggaagacatagttgagctaaagtaatatttgaggtgaatgtagggggaatgctgaagaaggatctgaaggtaatc

SEQ ID NO: 97793 - DNA, 1046 bp, Homo sapiens
aaacagcaaaaaatacaagtaatgcaaaattatagttttggcgttcttttttagattatataaaaatatttatctaatttttaaatttaaattttatttttattttaagttccagggtttatgtggaggatgtgcaggtttgttacataggtaaacgtgtgccattgtggtttgctgcacccatcagcccatcacctaggtattaagcccagcatgcattaactatttttttctaatttttactaatgctctccctcccgcaaccccaccctactccctgaccggccccaatatccaggtattttaagaaacattttttttttttttttttaagtcctgggccttgaatctaagctttggacgtcagcttgggttaattttatgatttggatagagaaatcaggaggacagaattgaatttctcagaatgtcatttgaaaatttttgttattttatactgtgttgtcatttataaaataattctattatgacaactttactgcaatatttttcaacaaattggctgcaattttgctttctattttacttttcttttcgtttaagtaaatgtctgtgtagaaaacagaagggacaacttaatcatatggtgtacaactaccatgtagatccgtgaaaactgcaagacaccctgtattttctacccactgtttctttgtacatgtctttcattcagacatggacaatgagagttcactgagtttttgagccctctgtgatgtgtatggattcttgtctgagtgaagagaagacaaggtttaacagtgaatgtggtttttcgtctccttgctatttaaaagcattccaactaactttccacatcatcttaaatttaattataaattctcaggagaagggaagccatgatgactcagagtataaaactaacctttaacattatcatttaaagaaagtaatccagtggcccacttctttgccccttgagttgaagttatgttgtcttaaactttcagaaagaaactgctcttctaggtgttaacacaagactgagacaatgtgtcttttta

SEQ ID NO: 97794 - DNA, 1009 bp, Homo sapiens
tatatgacatgttttcctccctctctattcctgttttaggtggttccctgcctctttcccaggcagagttttccttacccccaccacctcaaataccttctattttttcaaggcctgcttaagaacccacttctactcaccctttctcagataatttcagcttatagtgataccatcttttcagatttcttatttgtaattctcaaacctcgtatcttatataaactatttgctacctcaactaattgtggtcattgaagaaacaactggatagaagatactttacattttgaatgttcttagtaaatatttgttaaaagagtgactttataaactttcctctaagctcctctggagtagcttgtgtatctttaacttttgtatctttcttccatggtatatagtcaggcatacagtaagtagactcaataaatacttaagtaatctatgaaaatgagtataagtggatgtgctaagtataagtaaaataaacttttagtatgggtatttaatatcttacttcacagtgttttctaaattacaaaagtcagcttctttcaaactagacattatactatttttttgacttcctaaaatgtcaaaacacaataatccagaattctgtatctacaattgaagaaagactgtggaattggacctagaaaaatgctttttttttttttttttttttttgagacggagtctcactctgtcacccaggctggagtgcagtggtgcaatttcggctcactgcaagctctgcctcccaggttcatgccattctcctgaaaaatgcttttatagtttgtcccagtgtggctagagtgagttagtcatcggcaacaaatggttcctgccatgttgctgtgcaccactgtcttggcttctggactgctggcccgcaccaccgcaagagccccacccctcctccaaggcaccttcccatggacataccagttggtttagaaacaagagtgctgttgttttaccctcagtcaaaggaagagat

SEQ ID NO: 97795 - DNA, 1063 bp, Homo sapiens
aactctgtaaaggccagctggctggtgagaatgcataaggttctgcatgactggctttaatacagaatggagggcaagtataccaataactctcagagtgggatgaagaggatgacagatctaacaacctgtattgattccaaagaaatcaatcagcatatcatttttagtatttttttcttttttgttggtgaaagaagagctttcataaagggtcaagcaattctgtatggctgtgtcctccctggactgcatggtcattttcaagcagagggtgtggcagcgatttcatgtatgtcttcccaatccttcactcagaaataaacacctgaaggaaaactaaaatagtcattcagagcaggatatggtgctttaaaaatctttttcttgtgtgaaacataacttctgaactcctctgattctgtcattaacacttggttggtgaagtggtctctctagcttctttttctagcttcccctctgtcgtaaggatggacccttctcaatttacattaggcccagagtaatgaacacctaactggcttgctgcatggaatctttccctgctgcctgacgctcttagttcattccgttgtctcagaagattcagtcttcctttttccatttcgcagctcaacaaaggaaaagacttcatgccatccctatcactatcaaccaagtaaatgcaatgctgttagttgatgttcaagatgtctgattaaaggcagccaacaccctctggcatgtattccacaagaagttctttctttcataaagaagttgaataggctgggtgtggtggctcacgcttgtaatcccagcacttgttggggggccgcggtgggtggattacgcagtcaagagatcgagatcatcctggccaacatggtgaaaccccgtctctactaaaaatacaaaaaattagccaggcgtggtggcaggtggtgtagtcccagctactcgagaggctgaggcaggagaatcacttgaacccgggaggtggaggttgcagcgagccgagattgcgccactgcattccagcctgccgacagagcaagactcg

SEQ ID NO: 97796 - DNA, 1058 bp, Homo sapiens
caggtcattttgtggacctgattccactctggtatcaacccacatcatatttgtggaagaagaagaagcaggagtcatgaattatgattctcctagcgaatgagcgcatccttattaaaccttgttaagtcctgtgaataaattttgagctagaactttaacttcatactatagttttgttggtgttactgctatgcattcatttcattactgctgtgtagtttatattaatgacattgactttcaaatatcatgtcttagagaataaaaaatagagtttctgatatagtaatctcctttaaggtatccaaagagctgtgagttgtctgcatatgtgcatgcatatgtgtgtatgtgtgtgtgccttttttgtttgcttgtcttaattttttaaaaaatgtattacttcaagacactataacattgactcataaaatgtgtagttattaatatgactgaaagtgccagagtttgcagtcagtaggttgcaattttccatagccagggaatattggaaagctgttattcaaaggcaatgcagaatcttagggggtctatacaggaactaccttttaaggaaaatgcgtcttaccagtgaaagtgatggaggatgatttccagatgttcaaatgcttgttttggcaactgctacagaaaactgaaacgtgttgccagaacaaccaaaagggatgtgaagcactgatgtaagagggatcaggccatggaaagcaaggcaagcagaaaccagagagtatatagagagataccagagaggggagatagttgagccaagagaacaaactttagagccccagtaattacatgtagtaaaagcatatctgcctctgtatgaggatgcacacccaagcttatcacccctgtgcaccccacttacactttcctgtgctttcttcattatctttcctgtaactattgatgtcattatgttaattgggaaaactcttcctggctaatatgcttgttagatattatgggttagtgaagcatgcatgactggggttaagcagatttgtcttcaaatcttgagttcattcttg

SEQ ID NO: 97797 - DNA, 1017 bp, Homo sapiens
cttttgcgatttaggtacttcagtgcttctctttttatcttccctctgcctattgatgttttcctccaagttctgcttcaaatcttatatcctctaagaaactaagagattcttatctgcaataaatatcccctttcctttcaagggatggtccttatgttgcaagtgtgtttgtgctaaccaagaataagtttcctgggagatagggactatgtcatgaagtcattttatattttagatccacccatgcataaatgccaattgagtactatttgtgaaaatctagaaaaattttttccacaattcgttcactcaagtatgagtgatccgaattcaaatttaggttttggaaattgtatttccatattctcgggcaattttttttatttctctgtgttacagtttcttcatctatcaaattggaatgatacttcaaataattatgatgaatactatctatctatctaacacctacatgatagcagtgactcccaactaataataggaactcattaatatggcagatgattattattagattactatttaataataacaggccaggtgtggtggctcacgcctgtaatcccagcactttcagaggccgagctgggtagatcacctgaggtcaggagtttgagaacagcctgaccaacatggtgaaaacccatctctgctaaaaatacaaaattagctgggcatggtggcacatgcctgtaatcccagctcccagctactcgggaagctgaggcaggagaattgcttgaacccgggaggcgaggttgcagtgagctgagatcgcgccattgcgctccagcctgggcaacaagagcaaaaatccgtctcaaaaaaattattatttaataataatagagataataaatgcttattgggtgattatgagaaccaagatgttagatattacagagaaataaagaaacaacttttgctctcagagagattaagcctagcataaaaattttaaaatgcaatttttatattttattctactatgat

SEQ ID NO: 97798 - DNA, 1046 bp, Homo sapiens
ttttatttttttctttctttttatgacttcagggtatatttccctttacttgactgtggttatttaccagaaatgtaaaatgtaatctgagtatgcctgcctgatagaaacatatgaatgagaagataaaagtaaataaataaagttttaggcattttaagccaaaatcagttccattctcactgagttttaagaactgatttgattttctaaatttataagaaactgaaaggagaaagtttgggagttgggctgactttagttaaaactaacgtaacaaaaattagggagttaaaatgaaaaaaatcagcttttaaagagtttgtgtgggtgtatgtgtgtgtgtgaaaaatcagggagttaaaatgacaaaatcagcttttaaagagtgtgtgtgcgtgtgtgtgtgcgtgtggtgagagtgtgtgtgcattggggtggtggtcttcaaaagattccacatttgtgttaaggaaaatgctagagcatttacagtgtatttatattcctaagttaatgcctagcatctagtgagctatatatattcttgttattagaagtaggcatgcttaattttagaaaataatctttgttatgaatcattgtattcaacatgggataagcaatggagaagggaaggtgcagaaatgtatcattttgtttccaaatactgtaaacctcaatgctttcagaggccaggcaggtaatataaacaagtgaagcaagccagtgtttgtacatcaataggtgatgatggggcctgtggagaactgaaggtgcatgtccactttaaggcattcagaattaacattttcagaagatattgcatatgacaaataaaatatatctgagtatatatttggctcccggcccatgaatttacagccatcatgttgcaatcctacactgatatcctcctggacccaagctaacttttgattactgagagatgaggggctcacagtcttatatgtcatggtctcttgcatttttatgatatgtctgccatttatctcattgttacgatacaaaaatcaggaagcaga

SEQ ID NO: 97799 - DNA, 1024 bp, Homo sapiens
ttggttgtttaccatcaatcagaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatggtgagtttgccatttgctttgcttgtagtgtttattgcacggtttgggaaataggtggaatgttaagcctcaggaagagcgtgaagaggaggttctggtttgaagtttgagaagggggctgacggatttgcacctggaaaacgacttgaaagacaattgggatgtttgtaaatccggagcttctagatccaccgttggagagagtacactactaaatttttctgggaaagcctacaataagtccttttggctgagtgtgagagtgggacgtttaaaataagaaaagagtgaatgcttaaaacggagcactaaaggcattttagttagaggagctctgttctgtgggctggagttttcagagcaaggaaaagtcgcggcagaagctgggtagggtggagtctttttgtactgaacttcagctgcttcataaaattctttgtttagtaaaacctctgcagcaactctgatagctttgatttttctttgtctttggctcctcattctttcctctttaacaatttaaacttctttttaccattttcatttgtgaaaatgtgatcacttttgcttactgggaggcagtctcgtttgtttctccatgacagaggctgatagaagccagatttcttaa

SEQ ID NO: 97800 - DNA, 1116 bp, Homo sapiens
gggttacttgaacataagtacttcagtacagcaatagtggataggataaactagacagtttctacgtgactaacgggcaggtgtgtctacagcagagaatgctggaaaaaggaatgattcatgtctcaggtgagacaagggaattcactactgagaatggcatacaattttaaacttatgaattgtttctggaattttccatttaatattttcagattgatcttgactgtaggtaattaaaaccagggaaagtgaaaccataaataagagagtactgctatgaatataatagacacagagcaaatactttttacttggaagatacaagaagatttatatttctgcgccttgttctgtgataatatcgtgaaagtagtcaaacagtgccccaagtagcttaaccacttttagtaatttagtagctgctgctacatggaagaaatccacaaatccagaaagacaaagcaaagctagcatttcagcaacaagaaacaaaaatggaataaagtctttgtatttttctgtacaaaaggcccagacctcaccaactggagcagaacctttgacttaccatttgtaagctggtgttgccagtgaaccatggagatgttggggacatggaaaaacactgctgttggcagtactattgaagagtaatagttgatagtgactagtacagtgtctgcatccatttaatgagcaggcaacttggttaagctggctgtttttgcaggataattccatttatagcctctgtctacaaacagtcaagagatatgatattggcatcattaatcttttctgagttaataatctcttctgagttaatgaactgattggtcatagatgtccccatagacaaaaggcacacaaatttgagtatacaattcttaaactataccaaaagaaatgtctgttgcatttttatcatggacaataaaaagatcctactacctattgagtatgtgatatggtttggctgtgtccccacccaaatctcattttgaattgtagctcccataatttccacatgtgggagggacccaattggagataactgaatcatgggggcagtttcccctatactgttcttgtggtagtgaataagtctcacga

SEQ ID NO: 97801 - DNA, 1025 bp, Homo sapiens
cattgcgaatatccaaaagaggtatgtagtttttggtgtttctcaaacttacttgacttgtgaaccatttggtgtctggaacacattttgaaaaatgttggccaggaggtattgatttggtagatatgttcctttagaagtaaggctctggcttactctagatattgcctagtcttaagaccagtgtctagataagaaaatttgtttggtgagtgggtcaactagttagtttcaagacaaatttgggaatttaatttagtccagattttcccacgtcccccacaaagcagcccttctttcttagtatttaagaataatgaaatggtcatgttaattctgttcttaagtttcggcaaatctactaaaattttatctcaacaatattttgttcttgctcttatttttaatccaattccattttcctggattagtcacagccaacttggaagttattgattaaggatggatttgcattgccattcacttttattccaaaggaaataaagtagcaccgatcttttctttccaaaattaaatgagctacttctaaaaatcaaagttaagtaacttttctacgggatccaagtacatattttatgcttgccgtcctctgagggtttgacaaaagtttatcgctgtgtgtagtgtttgaatgtttttaatagcaaaactattattttgttaaaattgaaatttgtgaagtccatatactaagttttatagccaaaaaaacgtatacacaattcataaaagctttgtttcggatgactgaaagtgagtaaaattagagaagggcagttttatcagatttggttgaggtgcaggggcagcagttctggacttaggagtcacagtgtttgtgtattaaccattgttttgacagtaattatatgtttgacttgttacattttactagtccatatttatgattctcatatgcagtaattgtgatataaatttcctagtttgtataattttttgacttggatagataatatggttttactccaacatttttacattcc

SEQ ID NO: 97802 - DNA, 1037 bp, Homo sapiens
gccaccacgcctggctaatttttgtaggggtttcgtcatgttggccaggctggtctcgaactcctggcctcaagtgatgcacccacctgggcctcccaaagtgctgagattacaggtggcagccactgcaccttggtgcttttcatatctcattcaaaaccttaccatctccctcttcaagacagaaagttggcttttttcctctctcttttagttaaaacttgaaatggatggatctgcttcttgcagaaagctgtgaaaagattgttttgcagaagcaatataaataaatgactctacctctttaaggttaacagtgaattaatgaatagaaaatgcccctgatcaacatttaattattcatttgatatcttgatgaatttcttttttttaaatcaattttgtattgttttacccttttagctgtattcttgttcccttgatggcacaattaaactgtgggactatatagatggcatcttaataaaggtatgtggattgatctttacttttcgttatgtgaataaaaaaaggcaatgtaatttaatggtagatgtactgtttctataaggccaaatatttaaatagacttcctaaacaagttacaaaataacatcaaaaaaattaatttgactatataaaaattttccacttataaaagacaaggtaaagctggaagaagatatttacaaaagatattattccaaatatacaaaaatcttcccaaaaaccaataaggaaaaactaatagcctggtagaagaaattggcataaagtaggaatatgtaaattcacagaaaagaaatacaaatagtcaataaatatgaagagatgcttaaactcattaataaagaaatctaaattaaaacaaatgacacaatatttcccctcataaatttagccaaattgtagattgaaaaaaaatctagtgataggtaaagtatggagaaacaggcacttttttacccaatgagagttaaaactgaaaatcaataaacacgttttgctacagcagtctcacctcggaataatggcct

SEQ ID NO: 97803 - DNA, 1054 bp, Homo sapiens
aaactcgaaagagtatttaacaaatatgtattagttgtcttctgtaggccaggtactctccttatgttgggaatacagcaatgagcaaaatacataaaaacccctgccttgatggatcttatgttccactggagggaacagacagtaaacactatggtgctctttatctttcagactttcatagttggatgtaaacttcatgccctctttactcttgcccaagctgaggattctgtctttgttatagtgaataaagaaaaaccaggtatggtataattaacttactatatatggcattgagtggctctttacattttacagttcctcaaaatttaacattttggttttaatctgaagccaacagtttttagaatgggcatttaaattgcttttgtcattattgtgctcatttggagatggtttgtatgaattctgaaatatgcagtgagggagggattattttttatgtggttgtaatagtagattgcagacctcaaattttaaatctgctttacaaaggtggatagaattttgtctttctactgaacttaaatctgttattaagcatcactatcatttatctatcattgaacacttctcactttcttaagtcagggtggaaatggcatagaaaattggttgatattggccaggcgcagtggctcacgcctgtaatcccagcactatgggaggccgaggtgggcagatcacaaggtcaggagatctagaccatcctggctaacacggtgaaaccccgtctctactaaacaaaatacaaaaaattagccgggtatggtggcaggcacctgtagtcccagctacttgggaggctgaggcaggagaatggcgtgaatccagaaggtggagcttgcagtgagctgagatggcgccactgcactccagcctgggtgagactctgtctccaaaaaaaaaaaaaaaattggttgatattaagaaccaataatgtgactaagttattattaattacattttcactgtctttagaacattggtccattgaaactgctgtgcatcagcattttaggaattccta

SEQ ID NO: 97804 - DNA, 1909 bp, Homo sapiens
caacacctaattgagcacccaccgtgtgctaaatactgttatgattgcacaaaacaaaacacttctaagtcccagtagtaaactgactggattagttaatatgatacagtaagatgaaaggtggtctagagaaaaataaagcaggggagggaaatgagcaacataggaggagtaaatactaaatgagaggaagaagggctgtgcagctgtgttggagaagggaggccggtggaagtgagccagtggagaatagattatatttagcatcgtaggctattggaaggacttttgcttttactctgagtaaaaagaatacccttaaggagatattttttaaagggatataaagagaagaatgtgtcagtattacagaaaaggagattttaccctaatattatggcaggcccatcatagcatttctgaaaactctcagatgatttgttgcttttagctactcagctgaccaacattcatattctttttccattttaaaacccagcttaatactttggaatgtaaaatgcaccagtaagatacaagttgatttgtatttcttttgtttttttttttgaaacagagtcttgctctgtcgcccaggctggagtgcagtggcacagtctcggctcactgcaacctccacctcccgggttcacgccattctcctgcctcagcctcccgagtagctgggactacaggcgcccaccaccacgcctggctaattttttgtatttttttagtagagacagggtttcaccgtgttagccaggatggtctcgatctcctgaccttgtgatccacccgcctcggcctcccagatttgtatttctatatatttggggcatttatgtacatgagttatggaattagacttccatttaaaacttgctcattcaaacaaagagtccacctttaaggtatgttttgttcaagattagcctagaattattatcttgcatcaaataaattctagagtactgattagcagtttcatagggccaggcacagtgcctcacacctataatagcaatttgggaggcaagatgggtggatcacttgaggtcaggagttcgagaccagcctggccaacatggtggaaccccatcgccactaaaaatacaaaaattagccaggcttgatgtcacatgcctgtagtcccagctactcaggaggctgaggcaagagaattgcttgaacctgggaggcagaggttgcagtgagccgagatcacgccactgcactccagcctgggcgacagagcaagactttgcctcaaaaaaaaaagaataaattccttacacatgtttgctctctctagagaagctttatattaatatagctttctttggctagatatatttcagctggtttcagtgaaactgccaaaatcctcaagccaggaagtagaagccaaggagctgtcctttgttttggattacataaaccagtcacccaagtgcattgcctttggaaacgaggtaaattttgttttgttcgttttctgttttgtacctaaaatttctttcctgcaatctctcttctgagcattttatgttacagtgattttatattcccttgaattactatatttgtattagtaactaagaagcctcttcattgctttagcatgtatttatggtatagatttttttaggactatccttatttttgtgtgttctgtcctattgcctttgtaaactctcttagactatgtgtctttagaaattatggcctcccatatgttaattaattaatgtttataattaatatgcccattatagaaaatttggaaactacagaaaaatataatgaggaaataaaacctataatctcaccagtgataattgaagaatctctttctaggcttttttcttaacattcataaaataacttttcccgaaaagaattaaga

SEQ ID NO: 97805 - DNA, 2471 bp, Homo sapiens
tttttcacttaacattgcagcatgtgtgtatactaacatgtttttcataaattataactgatgtttttatactgtgatttcttcagccattccctgttaacagttactttactattttaaaatcaaatgctatgaaaagcctccggacatcactgtagcggcatgcttctttagtcttaagttttatagcattattttggcattattctgaaaagagttaatttctcagagtaaacttctttaacatcattaatgtcagcattcttcagcattgttagtcatcaaataaatactaattaaaaccgtagcaacataccactttaggtccactagaatagctaatgttgacaggatatagagcaaagttaaatacatttacctagcgattccattcctacataaagagatgaaaacataaccacaaaatgatgtgtacaagagtgattattcatagtagctccaaaatgtaaattaacccaaatattcatcagcaagagaataaacaaatgtgatatgcatacaatggagtgccgctcagcaataaaaaggagctaatgacacacatgagaacgtagattaaattcaaaaagatgatggatgatgttgagccacagaggacaagcagaaaagagtgtatattttaccattccatgaatgtgaaattctacaaccggcagagaaataagctatggtgatcgaaacagataggtgggatggaaacattgaggaatgactgtaaagagggaggagggggcatttctgaggaaggaaatgttctagatcctgattgtggcagtggttatatagatgtacatgtatatcaaacattgcattttagtgtatataagttattcctaattctagtcattgtactttaagcttgagagtctagttttaggatttaggacctaagttcatcttttaattttctgtcattgtttcaatagtatgattattctttctatagccaaagtggaatatatcatattaatatactcttatcagctgaacaaagttactgttaacttttgtgggggagtgtttctttttaaacagtgttgggccgggcgcagtggctcactcctgtaatcccagcactttgggaggccgaggcaggcggatcacctgaggtcaggagtacgagaccagcctggccaacatggtgaaacccatctctactagaaatacaaaaattagccaggcgtggtggtaggtgcctgtaatcccagctacttgggaggctgaagcaggagaatcacttgaactcgggaggcagagtttgcagtgagccgagatcgcaccatcacattccagcctgggggacaagagcgagactttgtctcaaaaaaaaaagaaaaaaaaaagagtgttgactatttttgtgaatgtttatcttctttttgaaatactagggagtatatgttgctgcagtacgggaattttacttgtctgtttattttttcaaaaagaaaacaacatcaaggtaagaattattttttattagctttattttatttgctcaagagttctttataattttatttcttcctaatacctatagtccaaagctattcctagttttatgttgcaagagagtgtaagactgtgaagtatggaggtacagtttttaaccataccgtatagtttttaagcatactattagtcaccaaaacctaggaagctttttccagtcaaaagccctatacactgaattctagtctgcattcttggagtcaaagttggatgtagtttgacagggtttcaccacatgattctcattgtcattttatgaatgtaggaatgaatgtaggctttgacatatgtaagttttaattggatcagatttagtctatttgatccccactgcacctcaatttaaaacatatttaaaatagagataatatctacctaacagagttgtactgatgaatgaggtgacgtatttagagcagctagtgctaagtattgaatagttaactatttgaaaataataactacctcttcccttttaccctgccaagattgctttttttttttttttttttgagatggagtcttgctctgtcgcccaggctggtgcaatggtgtgttctcggctcactgtaacctccgcctcccgggttcaagtgattgtcccgtctcagcctcctgagtagctgggactataggcgtctgccaccaggctggcaaatttttgtatttttagtagagacggggtttcaccatattggtcaggctggtcttgaattcctgacctcaggtgatccacccgcctcagcctccgaaagtgctgggattacaggcgtgagccactgtgcccggccaattgctttctttttagtataatattgatcctgacttcttcagagcctgaagattgacaagtattcagccaaagaataggaaataggctagatattataacaagtagattgatccctttggatttgtcctttcagatgcattagcca

SEQ ID NO: 97806 - DNA, 1094 bp, Homo sapiens
catccattatctgatttaatcattggccgtaggaaatgagtggcattatactcattttacagataaaggaagtaggatttggagttgataattaacttgcctaacatgacatggtgggtaggtgggtttggacctggttctgattttagagctcttgtttttaactgttacatggccttatttgacattagctattttaaattaatctccatcattgtttcatttaagctgcatgacttctgtcacagctttgtgtagtgtagctatagcgagtaaaaatacctttaaagtaaagtggtcttcaacagaaatacagggaagtacatcttgtctttgtttacttttagcatcctcacacccatgtggtgagagttatgtcagtttatttgactggttctttaagaaagttactacatactagagaagattgtgtgcctaaaaaatgagaagccaggaaaagtgatttttctttctgcaggtcttcctggagactgacaggacaagtcttagatggtaccatatgctgtggtatccttagagtcttacttgggtgtaatgcccggaagccccaggaaataggagacaccttcaacccgattatggtttggggagtaatgactagtgtatggagacaatgtaggctgctcatttgtattctctaccctccttcccactccacaccctcaaaatactagtgagtgcttggtatccatatgtatgtgtctgtatatgttccaggcaggggtttttttttttttagacaaggtctcactttgttacccaagctggagtgcagtggcaccatcttggctcactgcaacctcgacttcctgggctcaaatggtcctcccacctcagccccctaagtagctgggactacaggcacgcaccaccacgcccagctaattatttgtattttttgtagagatggggtttcaccgtgttgccaggctggtctcaaactcctgacctcaggcgatccccccagcctccacctcccaaagtgctgggattacaggcgtgagctaccgtgcccggccattatttgaattcttgatattatatttcaagtagcatgaatatttttaaatgag

SEQ ID NO: 97807 - DNA, 2226 bp, Homo sapiens
ttctgtaagtggggttacattaatttatttttcagctgttaaggtaatctcattcttgcagtaaactgcgatgacatgataccctttaatatatcattggtatagtattttgcttaagaattttcatctgtcgtgaaatcggcttttttttatatatatataatatttttggtatagtatttaaatgtttagaaaaatttatcagtgaagctatcttggcctaaaggatatttgtttgtccagcttttctagttgtcaacagaggagttggtcagcaacaaactaatcagatatcactggaaaaaaaattcctgaaccagtgatcatttgtcttcagagtatattaaaagatacgaagacactttttgtagctttaaatgagtttatttctctagtacggtagcaaaaacaaaagtgttaattatatttttctttctcttttttcctcaaaacaccatccttttaatttccttgaatggatatgaaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataatagtaagtctaaattttttattatgaggaaatatataaacaccataaattagctagcatctgtagggaacagagaataaagagacctaaaactaagagtagcgtatgagatttaatgagccttcttttccttgcattactcctctcttttccacccctctctacccctaggcaccaccagaattcaacatttttgagaattatttttataaaatggaaggctaagtgtatttggttattgatgtgccacttacattttcaaagtcttttagtgtgggatgacatgaggaaataaagggaaggtttggaagtggacattggtgctttcataaaccttccgttttcaaaagaatactgcaagattctcttttgatacagctgttacctgggggcaagagtcctgtagatttgatagaaatagaggcagtcttatatttctccaaaactttgttcatccagtgactactcagcctagactaggatatctttgtaaatccacttccttttctttcaaaaaagaacataactgtgagcagtccatttagtggcatgaaaaagttaaactatttttattagatatactctatagattttgcattaacacttaaaatgtgttcataggcacaactgataaaaacttaaagactccaacagaaaagcccctatccccacccctagattttccactaactcacaaaatgtattcctgattttctagtagtactctgagttcattgaacttactgggttgttttgtattctggtatatttcagaatataaactcaggtgactccttcaccttgaagctctaacccaggggtgtccaatcttttggcttccctgagccacattggaaaaagaattgtcttgggccagacataaaatatactaacactaatgatagctgatgagctaaaaataataataataataatgttttcagaaagtttatgaatttgtgttaggctgcataaaaagccaccctgagccacaggttggacaagctttctctaacctattgatatttaaatacctatttttttctacccacagagataataattattcaccgaaaccttgaagcatccgcagtaattcaaggcctagtgaaaggtattgcagaactcagtggatttggaatcatgaacattttaaagagtgcatatttctcttatttcacctgttatttgtcaccacttctgcagataggagtatcttcactggtttgatgattgatccaagaactaaagctttggttttgaatggaaaacctggccacctgcagttttattctctccagagtgataaacagttatacaatgtaagattttgatcattagccttgaaattaatgaaagctctttacagtaccactggagtcaagcaatttgtttagtagcttttaaaacaagatcctgtgcatatgtttacttgaacatagtattatccgtggttacttagttcagttgttcagagcataattccattgaggccacagttgcaggttacatgtaagccagttggcactcctgtacgtgctgtctctgtcttttgtttcagaatgccctcctattagctatcc

SEQ ID NO: 97808 - DNA, 1015 bp, Homo sapiens
ggcattttatttacttagtataggcaaggaaatgggattttttttaaaacaaccataaataaatgctggcctacttacattggctatcttttttcatttcttaaagattgtaggtttatttctgttctgcttgtttctgttgacagagaatctagccttgagatgatgtaaagctgtttgttcttagaaacaaaagaaaagcactactataaattaacggttctgttgtatcatatagtgggtgttagtaatcgctaatattcaaggtcattgaagaataattaccaccaaattgatactattataatgtgttcccttttttaatggcaattttggtgtccatagtaacaattagttcatttttgcctttatttaaaaatctattactatacagtacagaagttgtcttggatgtagttaattatcatttcttgaatgctgtaacatttgtgtatttatgttaataaacattttggttttttggttttttttactcatcagttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtaatactatctgtgtagccacttaatttcaaagtataaaatatttcacttcccattttacagtttcaattgtctttaagatgtttcatcttgacaaggtttagatttagagatatgggagaggttttattctaataaaacctttaagctttctgctctgagaagacattgatgtcctctaagtcataatgtcatctcataatgaataaagaaacatggaaaagtgacacctcctcaagggcataataccgaattctaggcaaatccagggttagaatccaaatgttcccttgctcttccgttaacagcatactgccttttgaaaagagggagtgtag

SEQ ID NO: 97809 - DNA, 1108 bp, Homo sapiens
acaaggagcactacagttccagtatgtttttctttcggcctctcactttagtgcagcattctacaaatcatttcagtgtgtctccatgtgtgttagttggaagcataagattcctcttcctaagaataagagaagttttttaaagcttttggtaaatctttccttagaagtgaatcacctttgtttttcccctcagtggagtggaatgcaaaattaaatgttagagttatggaacccgatcctaattcagagaatattgctgcaatctctcagtcttcagtgggttcagactgtaagtacaaaccacactttgtagtaagagaacatctatgacctaagttttcttcttaatataatttgagccaaacttgccttcacatcagatgttaattggaagccattttgcttgaggcacggcccttctttgccccaacactttgtcattgtgtgcgtccatacttagttctaggagagctccaatatgtttcttatttttccacaagccaattcgtactcaatctttaaaattcaagagatttcaccagtttgacatatttccaactgcccctgagaagctttaattggtcatcctctatgttcttgaagcagtttctacatatctcatttctagtacttacagacaaaatactactgtaataatattttggtttctgtcttctgcagtgggccctggcctctggagcacgaattcttctttctgtttttcatcctcatagccctcattcctaacctgcctggcccatagtaggaacacagtagatacctcttgaatcaaagcctaaaacagtcatgacttgggccagttactcaatggggtgagtcccaggattagtgtgatctgccagtctgaggctagaactaaccttttcaggcaaaatgttattgtttctttgttttttccctctagtgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacaggtaactgcct

SEQ ID NO: 97810 - DNA, 1049 bp, Homo sapiens
aaacacaggcaacagcaggatgaaaaactaaacgaaactttagagaatgagctggtacaactacccttaacagaaaacatacccgcaattagtgaggtaagtaattatgaaaaccatgtgaaacagattaaatgcacttaaagcacctgaagttggagttttgacacagtcaatctgtaatttgtatgctgtacaactttaatacccaaactaaataactaacaacaaaccgagtaacttaaccttgtgatctgggattgttttgtcctggacctggtgtagggataggggtggttgttggcataaatgtaggaaggtagaaatgtatttttctttggtttggcttttgtatagggaaagccttttcatgtttcactcttggcatttacaataaaagggactccgtgaggacactgtaggaacagactgcggtggaggataagctttttaattgcaaccgtgttttctgtttgactccagcttcttcacactccagcccatgtcctgccatctgctgctttcctgtgctccatgtttgtaaattcattgctgctgtctaaagagactaagaggtaaagcagttcttaagacaggtttggacactctcttttgggaaacaggatcgtttgtgtttatccttttttagagtattcttccactgtatttctttttatttcataagttttaaaatagatttaaaggctataggattattaagtcaagtaacatacattgaaaataagtttcaaaaaagatcttgtatgtgtgtgttttaagggcttggtacataatttaaaattacatgtttgtaaattcacctgctcttttataaataacccataatttttaaagtgtacttagtaacaaaattcttcatttactttgtgtgattatatttctacataggtgtcaaattagaaagttactgtttagaaacatttaatagtgtttatattttattctgttattgttaaagtgctaaggaaattcctgaagatgtagatatggaagaagaaaaagaaagtgaagattcagatgaagaaaatgat

SEQ ID NO: 97811 - DNA, 1061 bp, Homo sapiens
gttctttgtactatgactataatggagcctttaacagaaacctattaacataactatctggttaaaactaactaaatcttataaatggcatcaatttttctttgaagctgctctgtctgacctactacttctagaaattgtgcttcctctgttagttgtgtttctcgatagcaacaaaaatgacaaaatcaccttaagacaccaaagccataattctgtcaccacacaatcttcatagaaatgggaaaagacctgggaaggattttggatcccaggtagcttatttattcctgatgaatacctttgagattaaaacaaaatagaaatgaaagtaactgggatttgatagtagtacactatgacaacaggaggtgagtagactggaatgaaaatgaaccactcaaccacagagatgcagtcaataattatgatgctcagattgctttgtttttcaaaaaccatgagcaaaccacttaatctctgagtctcagttccttcatctaaattgcagaattagacaaagtgacccttccagctctgatattctgtgacatcaaaacttagataccagaatattgcagcataggtcccacatcccatcccatgtctcagaatgccaagaaactggtcttgcaagtattaaattttcggtgcatgtatataaataggtggagagatggctatcttagttttccatcttcaggcatgacatacatacccctggcttagaaactccctgggagatcagagcacttggttcacaaaatgaaataatcagacatgaaagtgcaccagttcctttcattgttttgttgagttttgatcatccttgttactcagtggttgtctactttaacggaaggatgaatataagtgctctgaaaacaagcactttaaatgcaaatatttggatattatgctctagctcacataggaatgtaagttaaattcatattctttcggaaatgcctgtctgcagttgtgaaattgagtccactagcccagctcaatgtggcgtttctgccagaaagagcactggtctaggagtcagaagactacta

SEQ ID NO: 97812 - DNA, 1059 bp, Homo sapiens
tctgatgactgtaaaaatcatttattgaggccactaataacccaatatttatttatgaaaaataattcttaaggcaaggctatggtatatttaaggtgacttaaagacagtcaggctaaaatgtatattttgcatatgtcaacagatttttatctgtgatttgaaatgtatgcctgtaaactaaaatctaatctttaaaaaaatattttattataggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaac

SEQ ID NO: 97813 - DNA, 1069 bp, Homo sapiens
aataacaacaaaaatatgactggtcgtttctcagctgtctgtctttatattatgaattattgcagagtggaagaatctaggctattcagtctttttctaactttctgatgtttttcaagtaggaaaggaagtgagatgtttgttgaactcttgtccactctacattagcttttagtaagtggtgctctttcacatccagccagcagtgtgggctggtggactagtgaaggaaaactttctgcatgtttcaaaacaggaaacagaaacttctttagttctgaaggtcagaaagtatctaattgtggattttttgtgccatttctgctattgcagagttaaaggagaacagagaaaaaggaggaggataaaggaaaaatgggacaaagaagggggaaagtacatctagaagggactccacctgctgccttgggttcctatgaggttgtgtctcttatacacagacccacctactccaggcaggaaggatttgtgtttatgcaggctgatttttgaggttgtggcaaagaaacccaggtaggggcctaggccaggaaggcttcacctgtttgtgatatgtttagagggtgaaaggggaggggtatgcccatgaaaagtaaaagttttgagctggatgctgattgctcccatttcctcatcacagtgtttcttaattttagagattgttttaaaactagaagctgtatcactgagggtaaaagaaaaggaggaattttccctgccaaggttaaaaagttttagaatttcagtggcatcaggccaaaatacagcagtcattatccagtttggaaagttccagaaaaggtgttttatttttctcatgaatactgctaaccagttaactaatttaggtactttctaggtgcttgatttagtacagtgttttatgataacattctcttgtgccacgtttgaatcttacttccttttcccaggctttttaactccatctattgctttttttcctcctccatttcttttgaggatcactctttattagtatcttctgagatttttcttgcccatcatgctaaaaaataatctgccagtt

SEQ ID NO: 97814 - DNA, 1030 bp, Homo sapiens
actgtactgtaattgatttctggttcaatagcaaactactttatgcctctgcaatcaagataggcaaattccaggccccaggagaaacctgacacacaggagaacacgtttttgtctcaaaaagccatcttgggtctggaaactgcattttgtttctagaatgaaaaagagaatgtgcggttcattaatatcatgccttttcaagtttacttaataattgggcaagaatattttccattgtgctgggatgaacgttttaacatctgagcagtattcaatctaagagtaattactgactttgaaagtctcataatgtagccaggaagtgcccttttgataaggaagcaacttcctgagtacaatagactagaaacgaaaaatattccatcaaaacattttctcttttcatttaagggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaaggtgagtgttgttatataattaagcccttttattcatgggaccaatgcctgagctacctctgtagcaaaggaaacaacaaactaggagagaaacaaccagggaatgtctgcatgccacacttgagggaggagggcttagatggcaccacctctggatggagggtcccatggctcccacacaaagttgggatgcctggacattgacctaatagatttttttgtatctttggctgttcataaatttcatatgttaatgattaaccttgtagcacttctctgagaaccatgttaaacattaaaagtttgcttaactcaggcttcctaactgtatcttgtactggagtccctttagtgtgatgttcctgagacagctttaacatctgttctttggttactatgtttcatgtaagagtatgtataagggaattgaaaactaagaatagcttcaaggcagaat

SEQ ID NO: 97815 - DNA, 1026 bp, Homo sapiens
gcaggaaaacccggggagtggaacgcgtcgaggcgaaggtccccgcaagccgcgcagggtgtctgcggccggttggacgcttgcgcccggggtgggcgactcctccgggcaagggcgcggggacggcccggcgcgcaaggttgacgggagctcgtctcgcgccgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggtgagtgtcgttgaccgaaagcatatggtggaaacccaggtggggctttggagacaagcaactctacacgagttctggaggaatgtggctctgctgtgaaccatagctttgtaaaaagatcctttgactcatatttggtggacgttaaggaagaaaggaaattcagggtgtgggaaaaggggtttgcacacaggcacggatggagtagattgggcagtttggattgccttgtgtaaaaaagaaacaaaacaaacaaaccaaccaacccaaaaaagaatgctgaaacaagagtttcttcactgtatgtgaaatgtgaagttgggcagttattgactaggtcaataactgaatttagtgaatggtattaagtgaacgaaatacatcggttca

SEQ ID NO: 97816 - DNA, 2485 bp, Homo sapiens
agtcaacagttatatatatatgtgtatatatatatatatatatatatatatatatatatatatatatatatattataaatgttttagaaagcaatagttattaacatgtgctttagaattttaaacaggtctaagtatgacaaaccattaccactttctacctttgtgactttgggtgaaatactttaagcctccaaggtattgtgggatctaaataagatgctatgttaaaagtgcttagccaagtgcttgggccaaaatcagcactcggcaaaacagaagctatttttctaaaagataaacattctttattagtagcctgttgttaattatcattggtactggcacagtgtgtgtgtttatatggtttgattttggtaaacagcttgtgttgccctctgaattgctaggtaaaagtccaagaatttttatgttatttaatatttattctccttccctgcaacagatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtatgacacagtgtttcttctcctgagaattcctgagacctatttttgacccttaaagcttttagcattttgattgtaagaatatagcatattttaggtgcatttatcttattttctttactgtgtagttgataacatttttatacggatttctttaaacctcataggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaaggtaattctaatcatttgagtgttcttacggtatttttataaaaacagcagagtgtaaatggagactttaaagtttgttttctctttggagactgttcacatgaataagagcagc

SEQ ID NO: 97817 - DNA, 1055 bp, Homo sapiens
tgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaactttcattcaaaaagattattcagttatgttatttgcatattaccattattaaaaataaaaaaatttttaaaagatggctcaggaatcctttcattctaaaatgttttattagccttctgcaggctctgggttggctttctggacatgtttcccaagttggttcaaacacactattcttggtcttgatacatttgtgatatctgatgtaattgtagatgaaaaagaaaaaatattatgggaatccttggtcttttttgttgctttgaagagtcccatgaagttagttacaggaggtaataaagtcaaagaatcttttggttgaattttaggttttaattttcttcggtgctccttccctaaaaattagccacaattaaatgtctctcctgagagccctaggtatagtctcattacttctacttctatgtagttctattttctttacataactaaaacatactaagagaacagatcagtacttccagacatttagatgtcaggggccaaaaatttgtggggaccactatatggtttgctagcttgttatgtcaagttagcaccaataagagaacgaatactactttaaatatcattatgtaaaataaagaatattttaatactaaaaaaagtgtaaaaggcattatctcaaaatgatggacttgatattgaatgaaattaattttatcagaaacgtgctaccttgcccttattttttcttatgttactacaaacctgtgaaaacttcatcagatcatgactgataaacaggttgttgtttagaaaccagtgttaaagtgaagagtgaactgactattcttttatgtaaattactctaacattcaagaag

SEQ ID NO: 97818 - DNA, 2954 bp, Homo sapiens
aactaagtagcaatagatgtgctaccaccattcacctaaatatttctgaattttatcttagtaaactgaaaaaaattcacatatggtgagaaaaaatagaaagagtagtacacaattttataattcttagcctttcttaataaaatggtaagaggttcatatctgtacataaaggctgaaatagtttgcagatacagttatgtattttgccaaataatgtatgtgaaagaacgtgcttcgtaaactaacatactgcaaaaaaggtaaaataagagaatatatatagattaacataaggacattaaagatgcaatgcacagaattaaatcacacaattacttacaccacagacagggtccccccccacccccctttgttttagaatactacagaggctactgccatatataggaaaacaaacaaacaaacaaacaaaacactgcttcccacagtgaaataataggaagtataggacaagttcttattattgacgttcatcattaagcagttattgtcaacttcaagcccattttccaaccaatagaagagcaaacatagacaggggcagtgattggcctcttattgttcgggtcatcataaggaacagggttgtctgcttacctgaatatcagctatagtctatatttgccaaagtatagcatgttttattcattcaggggttttttgttttgttagtaattttcaatttatttcctttgcatcttttcgtttcacagtatttaattttatgactctaaaaaatatgtttctttgataggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtatatttctaattagtaaagttgaacagataaatattcctggattgtgcctaaaaatagctgctcatttctgcaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggtaagttttatctcattttatagtaatagttacactttgcaatatgttacttttttcccaagaccttgaccttgtgtttaggatgaacagatctttatgccttatgctagccctgacagtatgaaattatgcaggataggaaagactaacagccatttcttgtactagtttggtagctttatgggacagctgtatagcttctatggcacataagtctaattttgcatcttcttgttggatttaaaagagggcttacaataaagaaagtaaatgcagtaactgctatcactatttttagaaaaataggtggatttccttcatcctttgatgaaatccctttgtttgtttgtttttttaataagccagtcaaatttagcagtgggaggtggtataccaactttcgtgacactaatgttgataaagttctgataatccactatattgtaccagccaaaatccctttaattgtgcttaaaagccttgacaaacatcctgtttaactgtatcttaaactttattcatttaaaaattataaactaaagtgggaaaatgtttaaatggtagtaattcatagatggaattttacatggatatcaaagaataattttttcagagttatgtagtaaaatgcacaaaataataaaaatttcagggtctaaaatagtgtactatgattgaaattatattaaataaatatttagatgaaaggttggaagaaaatatacaaaaatgctagtaatgtttgtatgctattagaattattagtaatttttttctttccaaatttttattacatagatatgtcatctgcccattacccatctcaaaatgggatagtttattattgtttaatgctgatatttttctccaggtttaattagcagcttggttcatatccatatatgatagttattttggttttctcaattccttcaggttgcatctggtggtgtcgcaagtaacttctatatccgcagagctctggaaattttaacaaatgcaacacagtgcactttgttgtgtcctcctcccagactatgcactgataatggcattatgattgcatggtaagccacaggatatacgtgcttcactcataactatgtaaatattaattgccattttatcatactaagccttcttccttcagatcttggagctattgattttattttaatgcttcttatttaggaatggtattgaaagactacgtgctggcttgggcattttacatgacatagaaggcatccgctatgaaccaaagtatgtggtatcattcatgatctttatgcaagttacattacttaagacaaagcctggattttgcctttatatatgaggttttcattgacattctggtggtacttgaaggaaagttacataaatttctttcatgaacctagttaaggttgataccatatgagaaatatttttgctacagtatcaaattataaaaatcttggcaagtttaggtgagttagaaacaggtcatgagtaagggtgatgaattccctcctttggaactagaatgtaaactatgtccatgacctggacttttgcaatgtcaagaacatctcagaaccagcaagtatgctgggaaatttaaggaaaacatgcagaaagcattcaggtgtgagagtgggttgtgattatgctcttacacaggcagttgagaattggccgaaagatagctgtttcctgcaagccttatttcctctcccaaatcaaagttccagtgaatagcac

SEQ ID NO: 97819 - DNA, 1016 bp, Homo sapiens
atgaaactggaaatgtgttgggagaagcaatacattcccaaactgaagttcatttaaagtaagtagacattatcttagtcatttccacttttttggaaaaagtaaaatcattcttttgtatttgtcatatataaaagttttcaggagctactgtcttattcctttttgcaaacacttttaataactgctatagaaaacctcaaacacttcatcctggcttttaagggtcttcacaataaggtcccaaccttaactaatcctgttgccaaaagaaactgagctcattcccagcttccgtatttattgattttccttcagtaatgcattccttcttttctccacttctatgtttcatggtctcagctgaagtcctaggaaaactgttagtcattgaaaaaaaaaatcctattcatatttatacatataacttgtattagtacttaaataataatacactgttgtattaaagcatagaatggtgcaaggattataaactgtgatgtttatagaggactaccaggcaggttacctaaataaatggacaagataaaaagtggaaaatgtctggaggaggtcactactcagctctagccagttgtcatgtgggaatgcaggacctgtgttattagattattataattttcaagggaaaatggaaatccagattttttttttctttttttttggtgagacagagtctcactctgtcaccaggctggagtgcagtggcatgatctcggctcactgcaatctccgcctctcgagttcaaacgattcccctgtctcagcctcccaagtagctgggattacaggcacgtgccaccacgcccagctgattttttgcattttagtagagacggggtttcaccatgttggccaggatggtctcaatctcctgacctcttgatccacctacctcggcctcccaaagtgcagggattacaggcgtgagacaccgcgccgggctggaaatccagattgttaatgtatttgcagattttttacattagtagcta

SEQ ID NO: 97820 - DNA, 1049 bp, Homo sapiens
tctccattttataatttttacagggggaacagcgaagccagatgatttattagttattgccggtgaaaatacagagatcctttgaaacatttgtctctcctagaattctcatcaaaccatatgcttctaacacagcacttaacagtcatggggagtatgtgggaataacagagactcgcttccctgccaaaaccacacatagacccacacacttgaaaaataaggaaataagatcatctgagtatggagattcctcaaaaattaaaattatatccagcaattccacttccgggtatatacccaaaagaagtaaaagcaggaacttggacagataatttgtacatctatgttcacagcagcagcattcacaatagccagaaggtggaagcaatccaagtgtccatcaagggatgaatggttaaaagaaatgtgacatatacacacaatggaatattactcagccttaaaaaggaggaaacttctgatatatattacatcttggatgaatcttgaagactttatgataggtgaaataagtcagtcacaaaatgacaaatactgtgttaccccacttttatgaactcctagaataatcaaatttaaagtggaatggtggttgccaagggctggaaggcagaaggaatgggagcttattggttcttgtttttgttttgtttttttttttttgagacgggagtctccttctgttgcctaggctggagtgcagtggtgcaatcccagctcactgcaacgtctgcctcccaggttcaagtgattctcatgcctcagcctcccacgtagctgggattacaggcattcatcaccacaaccagctaatttttgtattcttagtagagatggccatcatgttggccaggctggtctcgaactcctgactccaggtaatccgcccacctcagcctcccaaagtgctgggattacaggcgcgagccactgtgcccggctgggagcttattgtttaatgggtacagaatttcagtttgagaagatgaaaaggttctggagctagatggtagtcatagttgcat

SEQ ID NO: 97821 - DNA, 1021 bp, Homo sapiens
aacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatattatttcaaaagccctccaaatttagtcatcaaaattaaaatgacatttttcaagtttatttttaagcaactgaattcgtaaaattaaagtaacaaaaagcattcatttttctttattttaaagttcctctcaaaaggcttacatttttttaacatacttcagagatagaagtctccctcttagacatgctttcttcactgctttctcccgtcaatgttttaaaaatatttactcagtagatatttgaagggcccactctgtaacaggaattatgttaggtattgaggatagtttgtagacaagaaaaaccaactcccttccctttggtgcctacattccagtttaaaacaaaatctaaaaatgactattacttggaacaaaataaattgccatgccataaatgctcctgacttcaagtcaggagacataatggcaatttctaagg

SEQ ID NO: 97822 - DNA, 1041 bp, Homo sapiens
tttttcagaaacatacatggaaatacagaactacacctgtaattacagagggcatatgaaccctagtttgataagccttgctttaaaggatgcagtgtgttctattaaatgtatttaatacaattgcagaaatggaaaatgtggacctccattaaacaaattttttagttcctaatgagataaacttgggaccaaaccgattcctcttgttttagtgctcaaaaatagtttcatttttaggtatttatgctttagtggcctttttttctacctttaaaattgtttaagttccaagtaattttatttttggatgttatatatattcttaacttttatctctacagatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcgttttatgtaagcggatgtatatcctcttgttttatacaagccagttcccacttatgagggtacttttttggttttgctggcttaatattgtgta

SEQ ID NO: 97823 - DNA, 1258 bp, Homo sapiens
ggccaagccagacagctgaatgttaatggtaaagcaattaatatacaggttgagcatccctaatcagaaacccaaaatagaaaatgttctaaaattagaaacttttttagcaccagtgttgtgccacaagcggaaaattccatacctgacttcctgacaggttgcaattaaaatgcaatcaaaactttatttcatgcacaaaattattaaagatactatataaaattatctttaggctgtgtgtgtatgatgtatatgaaacataaatgaatttcatgtttagacttgggccctgtccccaagatatctcattatgtatatgccgatattccaaaatccaaaacaatccaaaatctgaaacacttctgctccaaagcattgtggataaggaatactcaacctgtaatgtatagtccaaacaggctgtttagagagtaaaatggagctttggtaataactactacaagagattaggtataatcagaaccatcgtatgcaaacaagaatacaaggtcacctaagtcttaggataacttcttttcctttatattccatatccatttgctcagagcactgtcttctactgctttactctcaacttgatccccataccctcattttttcctcaagtaaattactcagataaatcaaatagtcttcttgatgcttctctacccttctccattccagcttggcagagtgatgttttaaaaatgcatgtttgctcaagtcatactctaagtcattcagtgatcatccattgcagtcatggtaaaatccaagtttcttgtgtgacatataagaccagttgataacagtgcagaaacaaggagacttcaccttgtctcaaccatctctaaatagaggctatacactagcaataaagaaaatcatcttgctctcattttattgttttggcttaagcttttctactatattttcttttcacctggaccaagtactcttttgtttttaagagactggcgtgatcatagctcctcccaccttagcttcccaataaatttgaggactgcaggcacatgccaccacacccggctaatttgtttttattttaatagtgataggctctcactatgttgcccaggctggtcttgaactcctggcctcaagcagtccttctgcaccatcctccaaaagtgctgggattacaggcatgagccagcatgcccagccattttgtttttcttacagagacagggtctcactctgttacccaggctggagtgcagtggcatga

SEQ ID NO: 97824 - DNA, 1071 bp, Homo sapiens
gcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttttctgagcaggtctgggctccggggtgttctggcttggtctttgttgcgtcccattccccagacccttctgggtggaggacttaaaatttgttttccaggcagcagatttaacccatggcaactgtaactcatcttgtgtgagtggcggtttatagtattgtatcctgtggcatcatacaaggggtgcaagttaaactctttaaagttaatcacgatttttgctcttggccttctgggtttatccgtacgccgaagacaggcacctgtattacatgctaaggaaatgtgaataccaaaaattgatcctgaggaaagtcttgattaggtttttttggaatcgcctttgaaatgtaatttccctcaccttggcagtgcagaaagtttgtgatttttattgccgaaatagctttcaacattttgaaattgacttaagagaatgttggctgtgtatgtctgtatcttgcatttctgttggctttgtgaacctaattgttttggatttagtctgatctttaaataaatgatttctttgtgttctctctaatggaagtctgtgagttctctgatctttacttcttttttaggcacacctgttgtccttaactgact

SEQ ID NO: 97825 - DNA, 1069 bp, Homo sapiens
acaaaaaataaaaaataaaaaaagacgagctgtgcagtatgatcgccctagagcacatttgggcaacgatgggatgactgggagaggaggcaaaaatccagttgttaagaagtttgtacttaacctggttggcaattggaaacctttataaaaattttaagtggggcagcaacatgatgaaatttaaatacagaaagaaccctataggtggttgagattcgagtcaaaatatcaattaggtggttattgcagtagttcaggagagaaaggccgaatggaggcagtacaaagaggagaggactagtttgggaaacatttagatagtaggagagagatgactgggtggcaggatgtagagagcgagtagaatttctaggatgacttcaaggtttctaattttgctttatgtgcttggatggaaggtgtttgagagcatggcctttggagtcaaacatgccaaggtgtgcatctgccacttaatagttttgtgatcttgagcaagttaccatgcctttaaatcctatttggtgataaaggatgatagaatacgtagagttgttgtgaggattaaataggataatatatataaaattctcatgttggctattacttttattatcaaacaagaaatataggaagaaagttgattagaggccagtcgtggtggctcacgcctgtaatcccagcactttgggaggccgaggcgggcggatcacctgaggtcaggagtttgagaccagcctggccaacatggtgaaaccttggctctactaaaaatacaaaaaattagccaggtgtggtggcgggcacctgtaatcccagctactcgggaggctgaggcaggagaatcgcttgaacccgggaggtggaggctgcagtgagcggagattgtgccattgcatttcagcctgggcaacaagagcgaaacctgaaactctgtctcaaaaaaaagaaagagaaagattctctgatcagtttgggacatgttatgtttaggttgccttcaggtcatctaaatgatgatatttagaaggtagatggaagtaaggccctaaagtccagaaaaaaa

SEQ ID NO: 97826 - DNA, 1669 bp, Homo sapiens
tatgaatttggtagagacacaaatattcagactgtagcaattaggagagaagaaagatgacatgacatggaagaagagtatgaaaagagatgcagacatcttaagaccagaggatgcaatgggatggggtagataaagtgtgacagaattcatgctatgaattgccatgatcttagtaaactagaagaatgaggaatattgggatgcaattatagagatttaaaaaaaaaagatcttggatttggcattgtaggagatgaggtattataggaaacgagacaaagatgatgagattaagactgctcagaaggagtcagtctaagtttataccccaaagttttgttgatcagtgtttttcttagatccttgggatttcctagctgaggtggaagacttcttgaacccaggcctaatgtgtgagcccctttggggtaggggttagaggtggggggattgttcatttaggggtttagaggagctcagtttagtcccagtatcctgggatgtttttagcacttatatgccaaacactgtaatacattatttatatatactactttatttacttctcaccacaatcatatgatatcattattagatccattttatagattaggtgattgcattttagagagtttaatttcctcagtgttacatatctgttagtgtaagagctaggataaaaccaaagtagtgtgatttcagagcctgccattttaaccactgctctatccagcactgttcaatggaactataagccacatctatcattttaaattttctagtagtcacattaaacagattttttaaaaggttagttttaataatatattttatgtaatctagtgtatccaaataggataaaatcatttcatcctataatcaatgtaaaaaattgatatgatttttattaatgctgagttggaaattgagtgtgtattagcacatctcaatttggactacccacgtttctagtgctctagtgttcagtaagctacatatgactgatggctaccatattggacagtgcagatctgtcccttagatcgaggtaattctgaagctttggaaaagtgcagaggtgccttttgcttgtgacagcactaatttgtgtgaatgttatgatgatggagtagcctatagtccactgtttccctgcttgattgggacaggaaagcctcccagctgttgagaacaacaaaaacaactattgaaaggtagttgttcacagctgctctcctgagaactgggtaccccaaaactaaatcaaatatatagattaattagagggtagttagtatttaaaaagaattctcagcattcctttacataatgatctcttattataatactctacattttataaggccttatcatttgtagaacaacactttatatattcttccttatttgattcttcacagtaaaccagtgaggtattagctccatctttacagatgatgaattgatttatggagggatttgagtgatttgctccatttttatagatgacaaattgatttatggagggatttcagtgatttgctgagtttatgtgtaataaaggtgaacccccaatacctattttataggctctggtctgttacatttttttcattgtgccaatcacctttgccttctatatagcaaaatatactgtatttatgaa

SEQ ID NO: 97827 - DNA, 1112 bp, Homo sapiens
gcatgctttacagatggaatttccataggacgtttttggatttttcgtttgtttgaacaaaggatttccagttaccaacagagattttggatctgcaggttggatctataaaggacctcaaatgccaacttagagatttgagctttatattattggctttgaggagccacatgattaaaataatgtcgtaggcagaataatatagaggatagttatctgacatgtctggtatgagaccagttcagattaacagtaatcctaactctaaaggagctcagtgattgaaaaagacattataattcatcagaatgtatggatgactaatgatgtttaaatgagactgttggtaaggcacataactgattgtcattatccacttcccaaagttatattatcacttggtcattctcagccaacattacactcattatagcacaattgttcttatcattattcagttattaccatagcatttgtttttaagaaatctttttagaacatgcatgtcttgattccagtatctgtgagctttcggtgatctactgtaatgagtttggaccaagatgtagttggcacagacatttaaggaaatatatttgaaataaaaatctcaaaagtacctgggcccagttacttactcagctttcagcctcttaaatgtccataataataagtataatgttttattcatagtacctactttctatggtttagcggtttaaatgcaatcctatatgtaaagtgtttagcatactatatatttaatgtagtagttgctgttcttattgtaatcatcattttaataaacggcagtatagactgggtgaccaaaggtgaagagtcattgaggctaattaggaaattatattgggaactaaatgtgagaaatactgagaaaagaattgataggatttaggagttgattagatttgagtcagggtgaatggataattcctgtaggaaagttgtgggtttagggtagggattggtaattatacccggagtttgagctagtgattatttcagcaggcagttggaaatacagagttcgagtttgcaagaaaagtcagaatataattagtcacacaaaatcctggaagaaattagaaaaa

SEQ ID NO: 97828 - DNA, 2365 bp, Homo sapiens
tgcctgactagaacatgtgttactttgtcgctgatggagttctgttctgttctgttttgttttggggccatgcataccaaaggtgtatgtaattcagaagaatttttttagtcaaatttaaacataaattattgtttattgtaaatacccatgataatgaaacagtgaaaagcaaccttaaagatcagcctaacctccttattcaacagttgaatctgtgtccagagaaaacaagggagttgcctgttgcaccataactagaaattagtagagctgaagaatttaaactcttatatccataatgctatgcttccataaaagtaaataaatgtcaaaattctttcacttgtgtttctttctaagtgtgataacagtttaatatttttacatattaaaagtgttttttgacattttataggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtaaggtaattatattggttattttagtgatttcatattcactgaacattacagttaaaactaacccagtatttggtgaagtatggttttaattatttttattatggtaaaatatacataacataagccgggcgaggtggctcacgcctgtaatcccagcactttgggaggctgaggcaggtggatcacctgaggtcaggagttcgagactagcctggccaacatggtgaaaccccgtctctactaaaaatacaaaattagctgggtatggtgcctcacgtctgtagtcccagctacttgagaggctgaggcaggagaattgcttgaacccgggaaacagaggctgcagtgacccgagatcatgccactgcactcccacctaggcaagatagagtgagattctgtctcaaaaaaatatatatatacataacataaaatgtatcattttaattatttttaaatgtacaattcagtggcagtggcattagctacagtcacattgtcgtgtatctataaccattattcatctccgcaaccttttcattatttcaaactctgtacccattaaacaataatgccttttccccccatcccctagtactcactgttctactttctgtctctatgaattagactattctaggtatcacatataagtggactcataaaatatttgttcttttgtatctggcctatttctcttataatgtcttcagggttcatccatgttgtaacatgcatcagaatttccttcctttttaaggctgaataatattccatcatgtgtatataccacattttgtttatctgttcattttcatcggtggacacctgggttactttcacccacctttgggctattgtgaataatgtttctgtgaacattggtgtacaaatacctgtttgagtccctgcttttacttctttggggtatatatccagaagtagacttgctatgtcatatcataattctgtgtctaattttttgaggagcagcaaagtgtgttttgcatttaaaaattgtattaagaaaattaagcagatatttaactatagcacttctcagagcctttactatattcaagcacattgtaaatctctaaggttggtggtttatatacgcactttttcctatacctacttgaccatgaaattcttttattgagaaagcatatcatttttgtttgtttgtttgcttgttctgtggactacactttagaaataccactctaaccggtacagttagtgagattacgctctagagatgtgaattgacttggtctaaaccttaactagttaagggcagattggatttaagaactttactcttctgactgtgagttaggtgctcagtgtctatgaactcctgagttcagtgcttggcacattcacttgcatagtaccaattatactacgctgcctctgccccagatcttataactagtttgtagcaaagcccgtctagaaccttgatctcttcatttctgttatctcagttgtgtttgatcacgtgactctgtactactttttttgtactatactattaccctgtggatgttgggctcttattgtgtgacagtatctatgtgccaggtgacagggtgattgtgagggtctcttgagttattgaaatttgcccagtagccatgtaatccttcatttgtgcttaggctggcagaccctatttaggcaagaatgttccagtacagtaaaatgataggacttcatacttgttgttctggaaaagtggcacagaaatgagat

SEQ ID NO: 97829 - DNA, 1052 bp, Homo sapiens
gccatgaattgcaaagcatttcatatctaaatacgttttcgtagtattctacaaattgtaattttacaaaattttaatgttggaaaatagagggtttttttttactttaacataaatgttacattatgagcactaaggtcttattttgctttttagcacttcagtttcttcgtctagactggagtatatatgtttaaaggatgagcaaattaatatcttgtaagataaagtggttaaaacaaaatcccatgtaaccttataaagtattagcatcatcttcatcttatcatcacccttcccttaaagatgatctgtgtaatcatttattcaggaccatctagaagccactggcagggttagtcctggaactcagagttccagggccgcctttgctcagtgacaccaactttaggtcaggtggctagttctttggagtagagaaatagaattcagttgaccttagcattttggaaaatcagttggttaaatgtagaattgtcttcaaagggataattatggaataatgagccacagaaaagaaaatctctagcactttctgtcctctaaattacaccatttttgaaccatggaatgtattttggaagaggtagatcccttaagagtactcagaaactcccaactttgttttaggttctgcttttttgggggatagtatcacagtaatagcttgacatagcgcccctagtaagagtttcatagacttcattttcagagagaatctaacgtcctctgctggtactgtgagctggagaagccgtttctttttgttgctctgatattccctgcatgctaccaacatgttccacagagctgtaggccctacagtaaatctgcttggttagggcagggtgacagaaccttcaaatatagacccacttggattcagatgagttccaacagtggggttggattcttatggtgtctaaattatatagatttactttagaatattcagctcttcgtataaagatggccaagaaagattactcccaattttgggtcatcattggctcaccagacatgtgaggagg

SEQ ID NO: 97830 - DNA, 1018 bp, Homo sapiens
cctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattgcagtttatcaaagtacattctgtatattttctgtggtttttttccttcagttttaatattaaattattggattctttttttcaaatgacttctgtcttcatttcatgtataaaatataaatttcttatattttaatactggtaccaaattctctcactcattcacttattttgtaaatccttagcttaattactgattacttttgcccattaggaattgatatttttgttccacataaaggagagagttaatagaaactcctaagacaatgcacattttttcctcatttattcagttaatgaaaatgagctcaagtctaacagctattttatttgatgtagaatgatacaaatattatatatgttttaattaaaaataatagattataattcttttactgtatatcaaaggttaggacagacagaaggcatttttaaaatatggctcctctctagaaatactctgaccccagttcttacgagttcaaattaggacaccattaggagatatttgagtggctatccagtagagtactttgaagtaatctagtcgccttataaaactt

SEQ ID NO: 97831 - DNA, 1496 bp, Homo sapiens
tccatctgatctttgcccttttgctgttgattttccttttcctgctgacctcagtcttataccttaagtaagtgagaccaggtatgcatattaaggaatttctgtagtcaacaaatgaactttactttctttagtatatttcttttatctcaagaaacaagaataaatacttagaagatcagtagttgcaaaactactaattgcttttcataactcagttttttcacctaattatagttgattggttaggaaaacagcagaaagttaaagtcttaattttaagttgttcttggtggacatattatatatatctacaaacactttcaaaagccttttatgtttatattgccttagtgctgataggttttgagtgattgaatcacatactcatatttcaccagctgtcatttagcttccatttaaatattttctgcgtaagataaaattacagttcaaccatcctaatttatacctgtacatgtagggttcttggactaatttctgctgtgaggtgaacatccctgcttagcatttactcttcatgtcatctgatataatgatacctgtgggtggcataattgtaggtacgggaacaacttacaacataattttatttaggcattggaaaatttgttacccctttaaaaaacgtaatttattattattattcttattttgagacagagtcttactctgtcgcccaggctggagtgcagtggcgtgatctcagctcagtgcagcctccacctcccaggttcaaacagttcttgtgccttggcctcccaagtagctgggattgcaggtgtgtgtcaccacacctggcgaatttttgtgttttttttagtagagacagggttttgccgtgttggccaggctggtctcgaactcctgacctcaagaaatctgccctcctcagccccgcaaagtgctgggattataggcgtgagccactgtgcccagcctaaaagacatattttacaatgtttaaaaatagtttactagaaattccagctctggtttttctaggtgtatatttgttttatggattaattcagccatttaaaatgatttatgtgtttaacagtatgtcaccctaagttgcccttgccttctgttcacttccattttaaagcatttttttaaactaaaaagaaaaatagaaatacatctctatcttttaaattattgtaccaagaacatggagtaaattaatagctttagtcctatcattttctgtcatcacttctattccctttaccctagataatcagtattaagctttccaaattgatttaccctcctagtcagattcttttaagatcttccagtacttctgccttagaaatttctcatatatcaaaagtagtatttaaagggctgtgatcattttcctaccctgttactagagtttcagaacatcatgttctttgtaaattcctacggtgtgtgattgtgcgtgtattaaaagatcttttcatcttaatttaagaatggac

SEQ ID NO: 97832 - DNA, 1035 bp, Homo sapiens
ctgactgcctagagagaggttagcaagtttttcagaaaagatgacgtttgagtttgaagatggtaggagtttgaagatgatagataagaagacatggagtgtaacctttcggcaagagaaaaatgatggatacagattttcaagagaccattgctatctgcgtagcaatgaggggaaaaaacataattttaaaaacttgtagtctttaaactcattgaagacctgtgtcacagagaagtttaaatgaacaaagctcaagagaaacactacatcctcctagaaaagaagtgcctggtggccatttgcatccctgggagcattaactgagtcataggtagataaaggaacaagtcttctacaaataagggagcttttatggtacaaggagaaaccagctgaacttttatagccacttgtgggcagacatgacagattagaatatgggatcctcaaacagagctagtccaacccccacactgaatctcagcaggacttttgttgagtaaaaagtgattaagaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaaaaacttatgttaaagaatttagaagaaaagatggtcaaaactggtaagaaggtagcaaatttcagcagagaaatggaaactaaaaaactaaatgaaaattctagaacaaaaagtactatgaagaattaattggttggacttattggagtcaggtc

SEQ ID NO: 97833 - DNA, 1075 bp, Homo sapiens
aaaacagtcaatacagagcttatgttaaacctctttccccagccctgcttccctttttatcttttctgtttgttgcttacattgattttcaaaaaaattatgttcaatttagaatcttttctgtttactttctactataaaagaaaaatagttggctgggcatggtgactcatgcctgtaattccagcactttggaagtccggggcaggcagatgacgtgaggtcaggacttcaagaccagcctggccaacatggtgaaaccctgtctctactaaaaatacaaaaattagccaggtgtggtggcacatgcctgtaatcccagctactcgggaggctaaggcaggataatcacttgaatccaggaggcagaggttgcagtgagccgagattgcaccactgcactccagcctgggtgacagagtgagattccatctcaaaaaaaaaaaaaaaaaaaactgttttcccccacctttcccattccaaatatgtacttaaaactttttcttgatctatcagtttagatagtacttttttactccctaatactggatgacgttcttaactcaaacttttcttcttactccttcctctttcagtcatatcagcaatagttttatattttcaagcttaattatatatataatttttttcttctttctttttttttgagacagagtctcactctgtcacccaggctggagtgcagtggtgggatctcagcccactacagcctccatctcctgggttcaagtgattctcatgcctcagcctccctagtagctagaattacaggggtatgccaccacacccagctaatttttgtatttttagtggagacatcatttcactatgttgcccaggctggtctcgatcctctgacctcaggtgatctgcctgcctcagcctcccaaagtgctgggattataggcgtgagccaccacgcccagcctcataatttcttatgtagccattttttaagtcttctatcttttgtctgaagattgattctaaaagttgaaaacttgtatggactataaaacaatcttcgttaaaagcccagtattgtagtgggatt

SEQ ID NO: 97834 - DNA, 1343 bp, Homo sapiens
aagcttgtactcaggtaatgcttgggattttcttggccgggggaaaattcaggccaaccttagtggccagctacagtgttagccatgatgtgacatgggtcctatttttcagagctccctgaagagttgttttctagttttgacacactccagtgctacttcaaactggttacggtcgctgacttgggatggcaagggtactgtctgaattctgctggattcctcgtagcttcgtggtactttgttgcctacagtggtaacccaggcagcttatggcaggagatctagacttgatacctttaccatcatgccctggatattctagctatcataatttagtctgaagactagcagtgttggcatcacctggaagcttattgaaaataaagaatcctgggcttcatcccagatcgactgaatcagaatctgcattttaacaaggtccccaggtgcacattcaagtgtgaaaagcactgatctagactttggtcagctatgatttcatgagtgaacgagactattgcatgaatcagtcctgtacttggaaatcttttcctcccatctgttttgagatgtgttgccagatctgtgcttacccattgaatttttattttcaatgggcaagcacagatagaattgcataaagagtcctagtaatccatcatagatatgagaatttttgctgcacctctatgtggtttttttttcatggtggattgagggaatttggtaagcatgtgttaatgttccagttccatgggctgtcagaatgataaacttttgagtgtctctctggtgagagtgatcatctaaccaaatccctcttctgttattgcactgtgtgtctaaggtgttgtatttatgttgccaccagctacccattatcactccattctttctgggcttatatggttgaaggagaatggtcctgtatcacagtttctttgagccctttctccatccctggccaaaagcaatcttaagttatttgccactgctggttagtggttgtcctcactcacctcacttctgtccccattatatgcctttaagttgtgcaacttggccaccaaggcctcttgactagtctgggatgacagtgctattggccattaaggaaccttggatgtggagaatctttatatatctcttcccataatgtgagggtaacttttttttttttcctcctgcagggaccccacatgggaagaactaattattggtggtgatctcaacagggccactgctctggtggcttttgtgaggcatttcccatcgtgactttgtgggcttgatggagctcctgaagttatcctttttgacatctgtcttctctttgaaat

SEQ ID NO: 97835 - DNA, 1031 bp, Homo sapiens
actgttatatatttgcagttggaatggcagagaaggggatttcacatgaacttgtttcactgtcctgaacaaaagtgcttaaattactactgtaaaaatgtaacttcttggtgttgtggaggtttactgaaagaggagaaggattagtgttaggagaccagccagggttacatcaatataatcagggttaagaagaggagatgggtttaacagactaggtagctggcagagcccttatcatagtaaaggagtataggatgagctagcaggatagaagtaggatgaaatattttaccaagttttgaatgtggtgagattgagaatatttttgtgacagccagttgaagatggtaagcactggggagtgaaataaatagcagctatacagctatatcttagcatcactggtgtatgggtagttgttgaaactataggtgtgaatgaaattaggaagagtaactagagagcaggaaaaagggggctgataatggaacttggggaccatcatcatttatacgggataaggaaaaggagagaaaccagcaaaccagaatgaagaggaggcattagagaggaagcagaaagaccaaaggagaaggatgaaacaaattcattcagtgagacacttcccagatgagagaattgtgagggtgtcgggctgcagggagtcaaataagagaagggctgcgtagtgtccctttagtgtcccttggagttggttattgaagtagaagcctgcttatacgggattagagatgaagggaagagaggggcggaccatagttgagaagcaattagggaggagaggtatttgtattttgccttcaatttttgttatgctttttaggaaattgaggaatacatttgggtacagaattttgtaaagtcttatctaattttcaattttgttgcactgatttggtgtctcaagttatttttccatgaactggcctgattttcactttttacagcattttatgagtctactgttttattttactttgccatgtaacttaaacatagtttgttct

SEQ ID NO: 97836 - DNA, 1037 bp, Homo sapiens
attgtactttttaattacatattattttttcttttatttattacatgtatttctagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggtaactcttttcagataattttttcttatgctatttataaacatatattactgttttcatataaaaagatttgtttatatttatcttttttattatttaaaatcttgtctattattttcataatttcccctaacatttgttaatttgtatttttaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaa

SEQ ID NO: 97837 - DNA, 1156 bp, Homo sapiens
cctctgctcttacccagctccaaaaccacttctacatcttcagttatctttatagcagtgccccactcctcagtactaattttctgtgttagtttgtttgtgttgctataaaagaatacttgagactaggtaatgtataaagaaatgaggtttatttggctcatggttctgcaagctgtacatgaagcatagtgctagcatctgcttctggtaagggtctcaggaagcttacaatcatggcagaaggcaacaaggagccagcatgtcacatggtgaaagagggagcaagagagagatgccaggctcttttaaacaaccagctgttgtgtgaactaccacagagacctcactcattaccatggggatggcaccaagccattcatgatggatctgccccatgacccaatgcacctcccactaggcccacctttaacagtagaggtcacatttcaacattagatttggaggggacacacatctaaaccatagcatctcacttcattgaactctgtatctcatcccttaatgcttgataatataatattatatattattctccagttgttctctgggaaaaatgtttaggataccatctctgtagtctaccagcattgcatctgccaaccaggtcaaggatgtagtctgtaattgggaacaggtaagggattggattattgaagtctcaggatctgaaactcttcaagttatatcacatctctttttttaaattaatccattgatagctactacttatccaagattggactgtctcttttcctttaattccaggtagcattatgtagacttcatgaaagaacactgttacaccgatacagccaaagaagacacatctttgctatgttccaaaaatatgcattctaaagccaaatctgatgctttgaaatatgtgctgttatggattatgtacccagttatacatccaatcctttagctagtttctagttttattttattttattttattttttgagatggagtcttgctctgttgcccaggctggagtgcagtggcacgatctcagctcactgcaacctgtgcctcctgggatcaagtgatcctcccatctcagcttccctagtagctgggactacaggcacgtaccaccacactcgtctaattttttttgtatttttgg

SEQ ID NO: 97838 - DNA, 1055 bp, Homo sapiens
gtaagttaaaatcacagaaataattcaggcgtttagatattgaaatggtagggtagaatttgaagagcagcagttgttaaaacacttaaaccagttttattttcataaatatcatgggactccattttctctccaaagcaagaaatgatctaaacaaatttaaggaacagaacagcaataactgggattaagttaaattatataaagcacatgtggtgtcagtgagcacttatgacttaatgtgagaccctatgggaaattactatttgttctccaactaaggaacaaaactttgtcctgactgtattaaatttgaatgagggttcactaaatgttttaacagcaatttttgtttttaatggacatgttctggaatatgaacttaactatgtgtttttattttttttctttcaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagaggtacgcattattttatatatatgttattgtatacaggggtcccaactcccgggccaagccggttaggaaccaggccacacagcaggaggtgagcggcctcctagcgggcatcaccacctgagctctgccttctgtcagatcagtggcagcattagattctcatggaagcacaaaccctattgtgaactgtgtatgcgagggatcgaggttgtgcacttcttgtggaacaatttcctgaaaccatccccacccgccaactggaaaaactcttccacaaaaccggtccctggtgccaaaaagcttggggactgctgctgattctatatatagaggtattatagattggccagactttaagatacttatttcttaaaatagtaaattatttccaaatagtagaatattatctgtaagttttattatgtatttgcaagaagaacactattaaaaaaaaaaagaacactctattaagtttcacat

SEQ ID NO: 97839 - DNA, 1083 bp, Homo sapiens
gtctaaaaagtattgtaatataattctaagtcctgatctcatcaagaggagtagaagggaaggaaagtgaaagatgggaatctttgaataagcggaaattttcatttttgtgacagtattcaccacaaaagagaaatgtaagagtgggttaaaagaaaaggattaaggaaggttataaactttaaaatataagatagtagcaggaaaacaatagtgtttccatctatatatcttgttctagatatccctcaagattggtattatttaaaaaacaaacctgaactctaatgaagtttttctccctttttaaaaatgagccatttttgtttacagttggtagtgtgcctgctgtattctgaaggtcggacttccttaacaggaaagtctgcttgttaaaccttctgaagaatgtattcagtaatgttctgtgaatcctttaggaactttgtcatgtggaaattcccagcctattgtgcgggtagcttaacattgatagtttctagagacttcaagggaatattttcttgtgaaagagttagtatgaacttaaaggttgagggagctgtgggttggaagaaccatgtggggagaaataagagttcagaaataacaggaataaagtaaattgggactggttttaaatatttttttgctaatactttacctttcagtatgttaaggtaatagtggtataagtgttaagaaaaatgggctaggaaaaaaaaagagagaacttaaaccacggggatgcttccatttaaggtcaataagatgaatcagagagaaaggaaagtgaaaggagaaccaagagaggggtggatgtaaaagtcaaggaaggaagtaaatttaagaataagtagtatcatgttctgtatagggtaataattgctagaagactatcagatatggctactagatgacattggtaaccttgaagagaatcgtaatggcaaagtacaattgtccttgtatatactcagtggattggttccagcaccacctgtggatactaaaatccaggcatgcttaagtcctgcagtcagccctccagaacccacatatatgaaaagttggccctccgta

SEQ ID NO: 97840 - DNA, 1030 bp, Homo sapiens
catacattatagtaccattaggaaaggccacattatacggatgggcactggtggaagggtctggcttcaataaaaacaattatctcagaaaatgtgtttaccaaatatatatccttgtacattaggtaatagaccaagaatctctttagatgctgcttttaaaaataaaaattagtgtgatattcatgtcttagaagagcagaatgaatacttctactatcagatacttatatacagaatctttgaaagataaatgaactttgcagcttaagggtagattaaaataattttctttatattataacacatttatgaagtaatattcagtttaatctccctgatcaaatgcccctttctcttagaatggatatctgaagttgtttttctatcttacctatttcttccacaggtagaatttgcatccacatcttttgggcatcctcaaataaaatcttgtttattattgagttagaaacaagaactaaagctcactgaactcactgagtttcaataatgcttgaaactacctaatcaattttagacttttttcttctcggatcacctcatctggtctctgtcttctcatgaccatatcagacaattaaattttatttacataagtttctttctacttttagttttcctcttaaatattattatatagtattgttatttgttactacattattatatagtattaaatgttaatatatagaaaaattaatacatatcattatgttatataaacaatatttcttatgcttgaaatagtctcattttcttaatgtgaaagtttttgatgtcttttcttaaaatgcctctcataatatcttatttcaaatatcaggaaagatttgtttttgtgatttatatatttaaaatgtaaaggccatacttaaaaaccttaaccaaaaagtaccaattacaatttagaaaatttagaatcaaatataaaatattgagtattaaacattaatattaaatatttaaaacttctcagtactgaattctagacaattgaaagaacaac

SEQ ID NO: 97841 - DNA, 1698 bp, Homo sapiens
tcatgggaaataggattaatgttttatttgggaccaaatattgaggggacttgaatatcaggctaaaggttttcaacattggaaagagcaactaaatgtttttgaataggaaggtaacacaatcagaactatatataaggaatattagtttaaaagcatgcttaagatgaatcagaatgaataagaagagaggtgggagatcagtttagaaaatcatagtgctattacccagtcacggtggtacatgcctatagtcccagctactccaggggctgaggcataagaatcaggaactcaggagacggaggttgcagtgagccaagatcgtgccactgcacaccagcctgggcaacaaagtgagaccctgtctcaaaaaaaaaaaaaaaaacatactgctaaaatttcatttatgtatgttttagtcatctcacattcattgtgttctttcagtatattaatagaagtttctttagaagaacttgaagaagaatttgactttcttgagatatacaaatatattatttctaaacttaaattcaatcatagtaaaattttaaagcatatatattttttcagttttctagttctgatacttgccagtaaaatgtgttagtgactttggaggatgacaaagatggaacttaacaagaatgttgagtttatgctatacatggacaaaaagatgctttaaatttaattttatcttgattttcataacaacaaatattcttatatttgcctaggggaaaatgtacattttgttatctttctttgtgtcatggctttctaggttccttgtacttattcctgtctctgtactttttcccgcgttccatatgggcctaaatgtttccagattatctcttatttgttctttcccaactaccaaatatacctccctttttctgaatttggttgatcttggctaaacgttaaaggaaaaggaatcagatagaagtggtttatatcaatgcaaatgatataaagatgcattctatcataaagggagaaaacataatatgaatgactggaatatttggatcttaagattcagtctctaattaattgaattttaggcaatatagggatatatttttgctgtttggagaatattatctactttcatatgcatgtaagatgggtcctcatattacatttttctttccccaaaggataaagaaagagaaactataagtgaagatggtagttcaaaagaagcacatgatatgtcagtgaaatatatttaatatatattttttaattttaacttttattcaaatataaggcatatatgtcctgaatttcaaaatcagtaatgcaatatgatgtaagactgtggactttgaggcaggatagcttcagaactgaattccagctctattcattactagctgtgttactgtagactgttaacttttcaatgaatgtacttcctctatgttgaatggggataatgtttactttgaagagtttgtaaagactgagagaaaatgtaaagcaactagtgcaaagcttgggatatagcagatactcaacaaatattacttcgtatttcttatttctttttatctatttcttaagggaattttacaattaaaaagcaaatcatttttaaaacacagagtctgtctctgtgcacctaagtataacaaaccttgttatatataatttttggtaagctattcatcatgacagtgt

SEQ ID NO: 97842 - DNA, 1044 bp, Homo sapiens
taggaggaggaggaggtacacgtgctgggtaactgtacatcctatcataatagtcccgttgaaagtcacaatccaagtcaaaagaggagccgtacatctccgctgcagatcgtttcacacctgcttttcctcggttcacttttggctctgcagccaggttaatatctaaaacctggccagcaatcattctgccatcctctcctgctacagcagcccgggcatttctctcattaacatactgaaagaaggcaaagcccttatgaacagagcagcccacaattttgccatacttcgaaaagattgcctccacatcagatttcttgaccacaagagtgttgagattcccaatgaatacacgggagttcatggaacgaggatctgtcttgttggtaacgttgctggccattgtgtttgatggtaaggtttctcacaaagccgaaaacaagaaggggagggagaagagattcgattctgagtctcctactcccgggttctgcgtagagaagccgactgctgctggaggtcggcaacgcggccgcaaccgctcagtcttcgtctcttcacaaaatggcctatttatttatttttttagagatggagtctcactctgtcgcccaggctggagtgcagtggtgcgatcttggctcactgcaacctccgcctcccatgttctagcaattctcctgcctcagcctcctgagtagctgggactataggcgtacactgccatacccggctaattttttgtatttttagtagagacaaggtttcaacgtgttgtccaggctggtcttgaactcctgagctcaggcaatccatccgcctcagcctcccaaagtgctaagactacaggcatgagccaccgcacccagtagaagcttatcttaacaaacatacttgccccataaagtacatcatggccttcttgcactgaggaacactatatagacagtactttaaaaatatggttagggccaggttaaactttaaaattaccaataaaaagtgcagatatgagaaaaacatagcaataagtaataggta

SEQ ID NO: 97843 - DNA, 1061 bp, Homo sapiens
cgggtatggcagtgtacgcctatagtcccagctactcaggaggctgaggcaggagaattgctagaacatgggaggcggaggttgcagtgagccaagatcgcaccactgcactccagcctgggcgacagagtgagactccatctctaaaaaaataaataaataggccattttgtgaagagacgaagactgagcggttgcggccgcgttgccgacctccagcagcagtcggcttctctacgcagaacccgggagtaggagactcagaatcgaatctcttctccctccccttcttgttttcggctttgtgagaaaccttaccatcaaacacaatggccagcaacgttaccaacaagacagatcctcgttccatgaactcccgtgtattcattgggaatctcaacactcttgtggtcaagaaatctgatgtggaggcaatcttttcgaagtatggcaaaattgtgggctgctctgttcataagggctttgccttctttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggattgtgactttcaacgggactattatgataggatgtacagttacccagcacgtgtacctcctcctcctcctattgctcgggctgtagtgccctcgaaacgtcagcgtgtatcaggaaacacttcacaaaggggcataagtggcttcaattctaagagtggacagcggggatcttccaagtctggaaagttgaaaggagatgaccttcaggccattaagagggagctgacccagataaaacaaaaagtggattctttcctggaaaacctggaaaaaattgaaaaggaacagagcaaacaagcagtagagatgaacaatgttaagtcagaagaggagcagagcagcagctccgtgaagaaagatgagactaatgtgaagatggagtctgaggggggtgca

SEQ ID NO: 97844 - DNA, 1068 bp, Homo sapiens
gatctgatacacacaacaacagaatgaatctcaaaaacattatgctgagtgaaagagaccttacacagaaactacatactatgtgattccatttatatgaagctctagaaaatacaaactgggccacgcacaatgcctaatgcctgtaatcccagcactttgggaggctgaggaggaagaatcacttgaggcccagagttcaagaccagcctgggcaacatagcgagacccctgtccctgtcagtgcacagaaaataaaaaaatgtatgtgggcataatggtgcatgcctgtagtcccagttacttgggaggctgaggcaggggtatggtgtgagcccaggagattgaggttacagtgagctatgatcatgcgactgtactccagcctaagtggcagagcaagaccccctgtctcttcaaaagaaaaggaagaaagaaaatacaaactaaaaaacaataacagaaagctgatgatggttatatggagacaggagtgaagggatggactgactacaaaggaacctgaaggaactgtttggatgatggaaatgttctgtatgctggttgtggtagtggttatgcaggtgtatatgtccttcagaacttattgaacttgggaaagccagctgacatgttgtgaggacactcaagcagccctgtggagagattttatgttccaaaatggtgtagaagcaagttggcttcactccccttcacagaaaaccacaaacaagagagcaccgagatcatcaccagcaatatcccagcactcaaatattaagataaaacagtttgtagaatcacagggaaatcaagaacaaaatctttgagcaaaactctataggaaaaaaatctaataatccaattgaaaaattggcagaagatttgaatagaatctgaaaagaagacatacaaatggcaaaccgatatatgaaaaggtgctcaacatccttgaccatcagagaaatgcaaatcaaaacaacgagatatcatctcatgccagttaaaatggcttatatacaaaaggtgggcaataacaaatgctggcaaggatatgaagaaaaggga

SEQ ID NO: 97845 - DNA, 1946 bp, Homo sapiens
ggctgttttcaaacacctaacatggctatcataaatagatggcaaataacattatttaggcattctgctttcaagcagaatggtctggaagaataatttcagtttttaattttgttttgccattaaacaaaaattataatcattacttatttaggtccacacaatgttgtaacaaaaggatgctttaaaattgtagaccaacctccaatccattttattatctcctctgtagcactcctgacaggccagccacattttgattgaacacttcagtgacaggaagctcattacattttgacgggttcctccttttctgttgttagcaaggccttgtttacgctgaactgacaatcacttaggaagcagtacctgtttctcattagtcctacctggccaatagcgctccaactgtgaacttagaaacaagatttttctgcaaaaaggatctgaaactttagtcagtctgaaaagggtccatgacccaaaaatagttaagaaatgaaaggtctaaagtgatacaaaataatatttttgtctcctttgcttgacagcctttcagatccctgagcctcagtttctcatctgtaaaatgggaataatatactttgtctaaccctagggttactgtgaggattaaattaataatattaataaagtacttagtagaggtgcctaggagtcagtaaatgttagttatcttcaataaatactagtttttatgtttccttccttacctaagacccctctctgtgctaaagatccttagcccaaaattgaattcaataagtcagtttaacccaaacagtgcagggtgcaatgagctgccatcttcaaataaaataatctattgcttaattggcatttgtagtaaatactcagaagttgactaaaaacctcacctccataccccgtgtgctttgctgtcaagcaaaggagacaaaaataaaggtaggctttattaatttttaaattatgcagttaagcatttcttgaatctgaatttcttttttctcttggcttgtattacttaaagcctctgtatggtttgcagtttgttagatagacgttttaatcttatgtcattcatcatgttaattctacttttcagttttgtgtcacctacacatttgctgagtttattcaccagacattcaagtcactgataatagataggacaagtccttttactgtgaccgtggtacctctagaaacctgtggcacagtaggaatggtcctggatttttggaggctggttttggagtctggccctgatacctattagctttgtgaccttgagaaacttcagtatcaataaaatgaggtaacatctgcctttcagggtggttgttaaaattcaaagtattgaaagtgccaagtacgataatggctggaaatctagttggccttcagtagattttgcttgaactaatgaattcgctggactcagccctttcttatcaaactattctagtccatagagcagtcttctccataaggacattatgagaaaaatgtcttgctgaaaagtaaagatcttgcatattccctgatctaccacaaaagtaaataacattagtttaaaaatgaatgattcttagcaaattgttagttcctagaaatccgcagtcttttcctccacccctcatttttccttgtttaatgtttaagtttcgaattttgccagagatagatgtcaaactattagtctgtaaagtctaggaattctaattctttcttttaattttgaatattaaaaataaaaacactgggggaaaaaagttctgtttgaatctctagtctcttgagactgcccttcttctccatgtttttatagaggttgtcagaatagttctgtgctgacatctgcaggttcttttggtaccctggaatataattcaccagaatgtgaaggcatggactattttaaaatgacctcttctgcttgc

SEQ ID NO: 97846 - DNA, 1053 bp, Homo sapiens
tattaatttatgcctcctacttgttctaaaatgaagtggttttactacataaagactaatagaaattgaatttgtaggggaggaaaaaagctgtcctctaccctcttaggtttgtgaccaaggcctgtgaatcaaactgataaaagagtaatggcataaatagaacagatttaaacacacgtatgcacaggagtttgcaaaagaaatgtgactggaggaggtggttagaatttggggcttatctaccaacttaacaaaatgataaagcgggaagaggttctagatcagattttctttactagttggtcagagctccttttcatttttctgtgaggatttatattatggtgctggaggaattgctgcagattgaaggtcaacattcatggccataaataggagtggccagatgaagccacctggtagccagagtgaagcccagaagggcttagggaaatacctgcttgtgtatgtgtgtggtttttttcctctacctggaggacctggtaaatgagatgaagtattgatacctggacttaagacatctatcgcctgttcaacagttagtctatcatctaattgttcaaaatcctaaattactgttgtcattcttagattataattctctttcctcaattataatctggagatataatacaacacttaataattagatgttagtagctttaggagacaatctggagagataagaaatggaaataacacagaacatgttccacgttccaagggaagttctagatgctttacatatagattcacaatttttatttttttgagacagagtcttcactctgtcgcccaggctggagtgcagtggtgcgatcttggctctctgcaacttctgcctcccaggttcaaacgattctgctgcctcagcctccctagtagctgggattacaggcatatgccaccacacctggctgatttttttagttttagtagagatggggtttcaccatgttggccaggctggtcatgaactcctgacctcaggtgatccacccactttggcctcccaaagcactgggatta

SEQ ID NO: 97847 - DNA, 1020 bp, Homo sapiens
gccattacttaggaagaagtgctgtgacattcagctgattattgggtgtcacaggacctctgttcagcccttcagatgactaaaatctaagactaaacagaaattgctgttaacatagaagtacttaaaatgcatttcatcctagttgttcttataatagtgacattatcgtagacacatttttaaatccagatagttatttgtactttttcacaccagtttttgcttttgtcacatttattcaaactagcacctccacagtcaaagtgttgtcatcctacagcctcaaggcccctcactctcaatgtatggaatgtcatggtacttgatgttattgcatgcccattgctgcaaggcatcacacaagatatcctgagacaggcggtgtgcatattccaagatcacagtattggtccctggaggttccttcacttcctctttgacattaactggagaagccatcctaggtagacatctctcttctggcataaagggttcttcactctcatgctgcttctcaccttcatatatggtaggaaatgggaaagtttgctttgatttcatgcagcccatgttatgaagagctgtttgtggaggaagcagtggcaaagactacttccaggccatctttagaaaacaatgaaatttgtccatgtgatgttgaccagtgctttccctctccagggcacttcagtaatcaatgttccctttcaccactcttcacgtgtagtgtttacctgtcaagagaaggtaggtttcattttgaagttacagaatgcaaaatagtgtatgattgagtggcatgtaaaaatcctttcatcactttggtcacatggaagaaatctgaggtaaaaacaaacagctttatcttatcagtagaagaaaaagataatcactcaataaaaatggcaacttgcaaaataggaaaactttttttcaagatcttgcatattttataaaactgaaaacaattcaatttttgctagcttagatttatctataccaaaacaattcaatttt

SEQ ID NO: 97848 - DNA, 1060 bp, Homo sapiens
gtgattatctttttcttctactgataagataaagctgtttgtttttacctcagatttcttccatgtgaccaaagtgatgaaaggatttttacatgccactcaatcatacactattttgcattctgtaacttcaaaatgaaacctaccttctcttgacaggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaaatcaaagcaaactttcccatttcctaccatatatgaaggtgagaagcagcatgagagtgaagaaccctttatgccagaagagagatgtctacctaggatggcttctccagttaatgtcaaagaggaagtgaaggaacctccagggaccaatactgtgatcttggaatatgcacaccgcctgtctcaggatatcttgtgtgatgccttgcagcaatgggcatgcaataacatcaagtaccatgacattccatacattgagagtgaggggccttgaggctgtaggatgacaacactttgactgtggaggtgctagtttgaataaatgtgacaaaagcaaaaactggtgtgaaaaagtacaaataactatctggatttaaaaatgtgtctacgataatgtcactattataagaacaactaggatgaaatgcattttaagtacttctatgttaacagcaatttctgtttagtcttagattttagtcatctgaagggctgaacagaggtcctgtgacacccaataatcagctgaatgtcacagcacttcttcctaagtaatggcatcaccaaagaaaatgctaaggaataaaaactgccccaaattccaatggttgaagtttatcctttaaaataacaatttttgtttgtttatacccaaaaaaagtccagatatgaaaagggcttttctaaaatttcttggcgagggaatggcactcaaatcatagt

SEQ ID NO: 97849 - DNA, 1049 bp, Homo sapiens
tttcttggatcattcaggtccaatttaggacctttaagagtataaatgtaaatgtatccgatatcatggcatctttattccagatctgttactgaattatttgaaagaaaaatgcttcacataaaacagattaagaactgagaaaacataaagcaataccttctgggctgccatttcctcatctatgagaagggtgcaggacatgatctttaatgtctttttcagttccgttggctttttattcttacaaacctgaagttcacttagtttctaaagagtatgggatgaaggagaaactataacaagttacaaaaaatttattttgtttataaacaaaaattacaaacaaaaaattataaattttgtttgttaatttataaacttacctttaaaattaaacaaaaattacaaacaaaaaacaaaatcataaattttgtttactttgttaatttataaacttacctttagtttaaaaattattcttgcctagaactttaaggttctgagtctggaataccttttagttctttcataccttaaaaagtacttacttcattaacaatatcaattattgaatatatcttttgaacaaaagtcttcttgctttcaattaatttttttctcctgacttgaaccttgtttgtaaggataattatcacacaaaagtcttacgtaaattataaaaaaacagagtgtctctatctaagagattggagtttcctaatttctcattctaccagattaacaaatatcacaaataacaagaaaataatcctttcagtttcaccatgggatggtattctgattattttagggaagaccaagtctgagttaatactgaagagggacgttaataaaaatcttttctctctgcccaaggtttctaatgtttataaaaggagctcttctgctacagtaactcagttactttaaaacacactcatatatggagaaaattctatgaggcattaacacagtatccaaaacaaaaattctatgaggcattaacacagtatccaaaacaattttcagggtctttattttttata

SEQ ID NO: 97850 - DNA, 1120 bp, Homo sapiens
tttaattatgcatgaagtccccttttctctaccttaagcaattaatttcctcccaaaattcaatgtggaggaggttagaaggcacatctggtccctctgccctcccctgcctttactttaaaccactggttttacctgttttgtaatgtggaggtttcactggcaattttatttcaagaagaaaaaaagaattctaatgtttaaaccactggattaattcagtaggctttattaaagctaagacatgaggcttaggaagttagaaaatatccaccccagtcatcaaaagtatattgctgtccatccctggagatttaatttaaaagaaaaatagaatacatataaaaattttgcaggaaaaaagtatgatagaaaaatgtgcctagtataagaatttctgtcaattcagtaagtaaaatctagcaatattagacaaaaataatggtattaacatttgtatcttctcttgacagttttaattgataaagaccagagtccaaaatggaaaccagctgatctaaaagaagttactgaggaagatttgaataatcactttaagtctttgggaagcagtgatttgaaattttgaggtgacaggcttttaaggtatattttgtagcatgggttggcaatctacagcatgtgggccaaatccagcctgctgcctgtttttatataccctgtaagctaagaatggtttccgcatttttaaatggttgggaaaagaaatcaaagactaataattcatgacgtgaaaattatcagaattcacaaataaagctttattggaactagctatactcatctgtttatatattatctgtggctgctttgaaatgagtagttgcaatagagatggtaaagcctacaaagcctaattatttactgtctggtttttgtcagaaaaaagtttgtcaatccttgttttagaagatggaaaaatgtgaagatctttggagattctcttgagtggtatatctaattgaaatgggatcttcgtttggcttgtatgttgatgaaatcaacttaggtatacaatataaaaaataaagaccctgaaaattgttttggatactgtgttaatgcctcatagaatttttgttttggatactgtgttaat

SEQ ID NO: 97851 - DNA, 1038 bp, Homo sapiens
ggttttggcaagccattttagaggagtgggggcagaagttagagtgtagtaagttggagaggaaaaatgggatgtgaagaagtggagagaatatgtgtagatgaatactcttgaaagtgaaataggatagaagctgggactgtggaatcaaatgaagttccttttttattttgtaagatggaaggtactagaacatgtttaaaaatgattgggaatgatccaatagagaaacaagattatgttgatgatactaatggtagttaatatttactgaacacttagtgtcggacactgtgcttggatgtggattaaaataatcctaggatggatatataaattaccttttcatgtaaagaaactagggttggagaaattactagtccgaggtcacatagttaatatgtagctatcaggatgtgaacctagacatttgaactcagctatattgcctacatcgatgattctaggaaaataaaagtgaatgaccacatcaagcaaagtccatccttgagaaggcaagaggggatgtgaattggaatgcaagggaggactggtctttgaaaaagggatggtcctttcctccacggcattgaaagagaaggcaggtgcagatggccacagttgcctgcaggtgttttagtggtgagaagacaagacttcatatctaagagcttctcgtatttttaaagaagtcagaggttaagtaactggctgagactataataagagtgtgctctacgggtagaggttgagaaggcagaaaacacttaaaatcattatcttggggagttgggaagagatcttggattgtttggcagttttctgtgcctgtttgagatttttgatcatgaattttaaatgaaaccagtcacagttgtatgattttctgcagcaagacttagctgctgaagtgcaggcaggggtacgtgatagggtttagttggtgccaggattttgctaggattgtaaaaaaggaaaaaaggtttgagggagatgatgacattttgacaggaaagtgaccatattaaaggactggtg

SEQ ID NO: 97852 - DNA, 1029 bp, Homo sapiens
catgggcaatttcgagtggctacagaaaagtgtctttttgctatgccagaaactgcaataggtaaacaaccagaattttttttataattacttttagcatcatcttcttttgatatgtttcagagtttactgttgttgaaggaattgatggactcttgtgtgagatgcaacaatgaaaggattttaaaaaagaaattaaataggaagatactttgaagtctatattagctcaatgattatatctgaaaacacaaaactgagaacattaaaggagacattaacacactataaataaaacattaacactatagataaaatatcattaagggaatatatttttgcctttagatctgtgcagttttgagttgtgatcaaaactatcatatgacacttctgagttaatttttgtatatggtgaggggtgtggatcacctatataagtcaaagtttattttgtatatggaaatacaatcattccagtaccaactgttgaaagggtattgttttgctactgaattgcctgtgtagctttgttatagttgtctatagatgtcaatcatggtgccaacaccatgttgtcttggttagtgttgctttatagttaagtcttaaaatcaggtagtgacaatgttccacctttgttctttgtatcttaccaagttgctttggctatataggttctttatctttccatatgtattttagagttacttgtcgatttcaacaaaaaagcctgcagatgaatttagagagaattgacatcttaacactatcgagtcttttcagacctgtgggcaagatataattcttcatttatgtaagtggtctttaatttctctcagcatggatttttagttttcagtttataggtcttatcttttgtcatatttatccataagtatttcatattaatgatatttttgaattgttagttaccagtctaaagaaatacagttgatttttgtatttacctttatcatgcagacttgctaaactcacttattagttttagttgctttagatttgaat

SEQ ID NO: 97853 - DNA, 1022 bp, Homo sapiens
gggaaaggaacatcacacactggggcctgttggggggtggggggcaaggggagggagaactttagaacaaatacctaatgcacgcagggtttaaaacctagataacaggttgatgggtgcagcaaactgccatggcacatgtatacctatgtaacaaacctgcacattcagcacatgtatcccagaacttagaatagtgatgccatgagtcctgatggttgggtatagcagagtcctgggaaatcacagtatagttaaaactgtgttccttacaggtgttttattagttaatactgcaaaatacataagcagtgagacctggtgattaagttatattgtgcaaggctttaagtcagtatacaggaaacttcttcacaattattaagtatgtcatattataatctggctgcaaactacttattctgcctaccctctcaccactcgtttcctcagccagcctttgttccactaatgttttaacatcttaacatttccaaatagtcattgcttatggcttagcatgtgctgtttcctttgcctggaattctcacctcccctttttcttgggatacatcaagccccaactcaagtatcatctttgttttcaagttgaccatagctacaatagtcagaattatttgccctctcttattcatctttgctttctcagtatgtaacatagaacttgatatacagtagtaaattaaaatatttaagggtatttcaaagtccaagaaattctagactgggctctatataataagtcagcttattcagttagctcagaaataaaaatttaggaggtgtgtatgatttgctttggaattgttcgtctacataatctaaataacttcagaaacttataaggtgtacctagttattctttcctttagttaccattaatatgcaagatttgcatttgatatgtatgttttgatgttggcttgtgataaaaacttaagaaattttgtcataaagttattctttgtttatacagagaatgtccaagcacacagatgcag

SEQ ID NO: 97854 - DNA, 1573 bp, Homo sapiens
ttggccctgcccgagcggcccgatggggttggggggcgggaagaaagggtggcaaacaacgattttaaaaatccagtcattagtatttgtaggacgaagaagctgatctgacagttgtccagagcagtggcccagctgcaacaggtagatggcgcagctgtcagtgaccccttggtctcagccttggctttgagagatgcatctgagtgtccctagctgccagctacctccagtgacctacttgatgagtgtgaaataaatatgatgggactatatttagaaaaatctttacttccttgctgttaattctctctgcattttgaaaggtggttttgtgaggtgtgcataattagttggtgtgtccagagtggtagctggaaaaaaatatttaacctgggtttggccctatcatgtagacggttaggcgcaaagagtgtgaaaggaaacgcttactttagtacatctgtgaaaaacacttataagaaaccacggcttgttttttggagatttctcattttaaaggtatttttaaagtgttgaataagcagaagtttgcccactgtatgatggtgttcacttcaaaagaacagtgggttaaaagtatggacagaccacttaagtggatcccatctgttgagtaaaagattttttagcccttttacactgattcctagctttgaagccagaaaagttgataaggatcagccctgctcaacttgataatagtataaggatgaaagtaatccactgaactactcttgattggtgaattagctaagtgatctcattcttaccttttaaaatagagaacataagggaaaaaataaaggcaatggaagaattcattttttcaatacagatatttgtttccattcttatgtagagcctactttatttttaagtttttatggatttttatactacttttgaagtcagcttagtcatgaagagaattatgtcaaatacatagagttacactgtactttttgtgtagaataagctaccacttttcaagcttttggactaaaccaccgcttgcttggaaattgcagctttgactaatgccctttaaaatgatataccttattatagatttaaattatagctttccttgttatagtcctgaaaaaaatgaaaagataatttcttgtttgacatagaaggcctgtgagacaaaagttataaaggttattatatatttattttgctttttaattctgtctctaataacagttagaaaatgtctcattctatttcatgttatacagaaattgcttaaaagataattatgttatataaagtgatcaatgaaaacaaacgtcatcttcattttttaaaggtgaggatggtgtatataagcactttttcccgatgtgagtccttatgaatgttcttgttaaaatactttgaatcttgtaatgaagttaataaaactatgttaatgtgtttggctgagagcttagaaataaaggctctggctggcgtggtggctcacgcctgttatccctgcactttgggaggccaaggcaggtggatcacttgaggttaggagttcgagaccagcctggccaac

SEQ ID NO: 97855 - DNA, 1051 bp, Homo sapiens
ctgcaagtgataaatgatgagaattctctcttgcaattattattttagtttgtaactgcttaatttcctgcaagatgaagttctgtgtttacatgttatgattttcattactaagccatcttttaaattttactttacagatcaacagtacaaattctgaagtttgtaaacttgctgatggtggtggtaagccatggcagatgataaagttgctatcttaacggatgatgaagaggaacagaagagaaagtatgtgcttgcagatccctttaatggtatttccagggaaccagaaccaccttcgaatgaaacaccttcctccacagaaacatctgctattcctgaggaggaaatagactggatagagaaacattgtgttaagataaacaacgatcttctaatttccaaggtcttttattttttcttttactctgcctatggctctctctatccccttttgcctgtgtattacaaacagctgggaatgtctccaagccagagtggactactagtaggtattcgttacttcattgaattctgcagtgcccccttttggggtgtagttgcagaccgctttaaaaaaggcaaaattgtcctcctcttttctcttttgtgttgggttttattcaacctgggcattggatttgtcaaacctgctaccttgagatgtgtaccaaagattcgcccaacaactcaccccaccaatgcaagtcaccagttaactatcctgccaacaaattcttcctttacctctttcctcaccatatcaccaaaaatgcgtgagaaaagaaaccttttggaaacaaggctcaatgtctcagacaccgttactttgccaacagctccaaacatgaacagtgaacccactctgcagccccagacaggtgaaattactaaccgtatgatggacttgactttgaactcaagcacagcaacccctgtctccccaggaagcgtaaccaaggagacaaccactgttattgttaccaccaccaaatctttaccttctgaccaagtcatgcttgtttatgatcaacaagaagttgaagct

SEQ ID NO: 97856 - DNA, 1049 bp, Homo sapiens
gcctggtatgtgtcaagcattggggataaaaatgagccagcataatatgaaagtcctcaccctgcatgcagaatgcagtcaggttgtaggtgcactgttacaaccaagataagtgttgtgaggagaggcacgtgatgctgcaatcacatattaaagggaatggaccaggcatgagatggagctgggtgagagctgaagaatatcaagacacagagacaggtggggatggtggccgagtgagtccatttgtcatccctgcgagtgggaggactgagagctaggcagtgttgtgccagacaaggtgacaaggaaagatgttttataatagaatcttcttcatatcagcaattttgatgcagatgttcctactgtgttacgtagactttctgatgatccatgcagctcttgaagcaaacaagcactcttgttaagtctgacacagaacaccatttctttgtccaggaagaaaatgattatggcaacactatttcctatgtctttcttaactctttggacaactagatggtttacccacacccaatctcccaagagtttcaaaagaaaggaataatttaaatatgaacttagctagaatgttgtatggttttgaagccaaaatagaaacccagacagtgatcccttcaggttgagaaccatgggtcagacatcacacatcatttaatgggtctgtttctactgcatgaaacacagtgacttgatgtctgttcattctttgagaaagtagacatgcacttggaaaaacattcaaaaggtatttagtaaagtctctctcccaccccttgggcagtcccccaattcctctccttagagactatccattatatgaggttctagtgttgtatccttttagagatattctgttcatatgtaagtatgtagctgtatgtgtcacttcctttttctgacataaatattacaatactatacttaatattctgcaatgtcttttaccttgctttaaatgccaaacagttctggaggctgggaagtgcaagatcaaagtgttggcaggttcggtgactggtaaa

SEQ ID NO: 97857 - DNA, 1166 bp, Homo sapiens
tagttggttaaatttagaaaagtagggtctcacaactaactacactgttaggaattacagaatgactcataattcattgtatctatatcttgaacactcttgaaaaaaataccagttttattataagataaccacaaatcagcttaaactgctaatactgtgaattgtgcttatataagaaattagaatctgtaacaatttttttctcctactcttgtagtttgctcaaatacaggataaaaaacgagtggcaggtgatttgggttttccacagggtagtgttttctgctgcatcatttgcttcttatcaattgtgttcctctttatagataacttcagtttaccaaccacctgttctaaaattgcctttgtttcttgtctatttttattactactgacttcctgttctgaaataggacagtcatgctgtttttgagttttatcattataggtgttcagtaggtatctatatctcgtggagagactttttttttcagtgtcttgtatttccagacatcagtgcccataagattactgattatacatcagtaatcttatgtataatcttatgtaaaaaaattctaggaccctgaacatatgctcatattcagcataaaaaagaatttgattgtctagaaaatgatccagtaaaatatgctttaaattcctttatattagcaaatccctaactgtattagagtgaatgtgttcatttgcttgggttaccacaaagtaccacggtctgggtggcttaaaaaacagaagtttatggccgggcgtggtggctcacgcctataatcccagcactttgggaggccgaggcaggtggatcactttaggtttggagttcaagaccagcctggccaacatagtgaaaccccatctctactaaaaatacaaaaattagccgggcctggtagcatgcacctgtaatctcagctacttgggaggctgaggcagaagaatcgcttgaatccgggaggcggtggttacagcaaaccaagatcatgccattgcaaaaaacaaacaaaaaaactcggaagtttatttcttcacagttctggaggcaaaaagtccgagatcaattgtccgtagggttggttacttccaagggcctctctctttggcttaggttttcttccagagtttttatttcttcccttgtg

SEQ ID NO: 97858 - DNA, 1068 bp, Homo sapiens
taaaacattttttaaaaaataactatcacgtggcttttcctgttttgacgtctttttaatcataatcctgtaaatgggcctaaggcaacactcattataacctatgccccactgatgttctaagttaaatgaaaaatatatttcttaaatatatatgctaatgtctattaaggcctataaagagacccaaagataaacatcatgttcattgattcagtacttacaccaagtaatgaagtcattggtaaccagcaatttattaatattatcaagcactctggaatgggtatatgggattcttggtttatttatttatttttacctttgttcaaatatgtagaaaatgctgaaaaaatagtttaaacattcttttctctccagacaagacaatgttggcagaaagaattcctgttccctccagtcccgttcctatagcaaccatcgacttggtacagcaacagacagaagatgtcatgccacgcattgagcccagacttccacccaagaaaactaagcaccaggaagaacaggaagatgtgaacaaaccagcctggggagtcagctcttctccctgggtgacctttgtctatgcactctaccaaattaaagagatgatgcaactcacaagagacaaccgtgcttctgagatacagcctttacaggtacagttcctttgctgggctagcaatattacctgtcactcaagataccttaactgggctcagttttaattactcacttttcattcaacaagatttattgaaagtctggtgggggaaatagacatgcaaacaatttcagtactctgtgagcactgagttaaagagggtgtatacaaggtcccatagagagaatattctgccttatggagttcaggaaaacttcagaggttatgattctttcacttcttgaaagaaataaaataaattaatccattctttcattgtatatttgttttaaatttcagtattgatggttgtctctgtaattccaaaattctagtgggggcattatattataggaccacaataaatatttgttgaattaattaatctgagccactgtatg

SEQ ID NO: 97859 - DNA, 1032 bp, Homo sapiens
tgtacctacatttcacaaagcatcaggaatttgaagcatttctaggaatctaggaatatctagaaatcctaaatggaaatacaaccacacacatacacatatcaggcatgtatggtaatggttcaggctgggctgctttatggcttcctctgccataacagatgcagggaatggcctccctgcctcctggggtggggtaaggtgctaagcggaccagggctttgacattaggaagatttgagtttgaatcctggctttgtgaccttgatctcataacttaaactgttagcttcagaattctcttgtttaaaatggggatagtgataggaacacctccagtttttgttaagggcaaaatgataatctcatcagcacactacaagcacccaatatccacggatgtggttcccttttcctagattccctgctgaactccaaattggcagagaggaatattgcctaagtaatggtctcagtacctcagcagtactggaaggaattgccaattagagggaagctattagccagctatccacttcatgtgacccatggcaggattaataagccagtaaagcagggttgctcttcctgtgaattccttaacacttttcatgaggtttactgcctgctggacaatgtatgtattataatctattcctaaaacttgaggaatagttcaataattagcagttaaccactttggatccacacaagctcagcactcggtaatttactgtttctacaaccataggagaaagagtaggaagtaagtcattaaggcagtgattaccagcctgggctctgtgacacccctgtgtgtgttgagggatctcaagaggggttacaaaatctcaaatcaaaatgtaatttgaattcactttaatattttttaaggtagcatatggcactttggggacaggaagaaaaagtcacaaagtccacaaacccatgaaggtgtcagctcacaaggctggaaatgactgcattatcgattctgctgtcacagtaaatgttccataacaaaggcatgtt

SEQ ID NO: 97860 - DNA, 1355 bp, Homo sapiens
agaaaccaagcttgtcctgtagaatctccaccttctagatttatctgatgacccctttatgatagaatttaacatattcttctcttctgcgtattttctgtaaactggaaattagacttcaaggcttggttagatataaattaaacacttaagatagaatacctaagaggtgatgggcacttcaccttggatcatacccagagacacagaatagcttatagtctcaccatcgtaatgatgagactgaacattggattcagagggtgactccctccactgtaaaattaccttttcctttcatgacaagaaggtaaaaataaaaaatagggtttgtagccaatggtgacatacaactgtgacttcttcctgaccaaagtaaccatgataacattttagtccagccagggtgctggactaaaacacagacatacttatgtatcatcataataatgagtgtacatcccaaattattgcgaaagtcagcctagtatctcatatggaaggaataacaccctatgtgcatttttcaaccttactttatggggtaaaaaacacaaaaattaaggttctctaatagtttttacctttaagtcaaggctctgccaggtttttcacataatgtctcaaattcaaatttatattattttacctcttccacttttccaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggtatgtatcatttttttcccccagcaaatttgacattttgagctctagttttattatttgggagagtgtttgcacacatcatgttaatctcataattacatttgatctggagatttcattctgagcaagattgggggtgtaggggtagagagctccaagcatctgatcccatcttcatggctagtcttcattaatcgttgagagctgtaccaccaattaccaggtaattagagctcactcagaattcactagagtcaatggcagaagtacttggactctgggttacctaaaatatcttcttttattcaacattttctttaattagagtcaaagactgctttagtggtatcagctgtgcttatgagatacgaattaggaaacagaaatgaatcataaatgactgaaaggtattatttgtatttaggactttcttttctcttaggtttttagttaaggcttatgg

SEQ ID NO: 97861 - DNA, 1108 bp, Homo sapiens
gcgtgagccaccgtgcccggctacaccttcaataaaataacacactgaacttagttgaggataaataattcatgttggtagtgttgcagttacactgattaaagtttgcaacagcagcattattttaagataaatttactctttataacagtgcttataactccaacttcagtgtacatgcaagctagatgggaatcttgttgaaatgcaggttctgatttagcagtctgcagtggggcctaggactctgccatcccagcaagctccatgtgatgtcggtgttgctgatttgtggaccacaccttaagaccctagggagtttcttaaattgacttcaaatcagtttgatgtaggagtttctaatacaaaaggtttatttgtttgcttttatttttatgagagtgaatgaaccaaaaaatgtgtcatttattttcttccacacacagtatagcaccttttgggctctaatggttggttgttggtttgcctcagtttatattgtatgccagttgatggaagatctgaagtggctgtggtatgaaaacaggatatatgtattaggtaggtaaatagaaaaacaatatgctctgtgattggtaaaactgagatgtacaactagaggccttcttttgatagatgtttctctccaacatctaaattttcattttgaactaacgaaaggtgctactaaaaataatattttgtttatcttattcccattgttgttgatttcagttcatttagatctcattttagatgatttccctatgacatgtttcttagttttctgtagtaatgatcaaaagaggaaaaaaaagtgtttgtcccttttgaatgcacatgcttctgaattgtggttaagctctaaccacatctaactggtaatgtaaaagcttctctgaaaagtggctgtttctttctttcccgtaagtattcattaggaaaggtgagaaatcctaactataaattactaatgaaaacttgccttttcagaaacacagaggctaagaaaccatttattttccttgttttacattacaaaataaatgtttttattgtttattttaactagaaaataatggacaatgagagaatcaattttctccta

SEQ ID NO: 97862 - DNA, 1061 bp, Homo sapiens
atctttgttatgtgtttgtgtgtcttttttactccagtcatggatttcaaactcttccttgtgtttgtggcaggagtttttcttttcttttatgcaaggaccctgagtcagtaagtattcctttttatatttttaactttgtgaatgaaaagggatttagatcatttttgaccacatgctaagtattttcacactattgtgcatttgtagttcttactttaggttttgcaaacaataggtctgaagatggtattggaaaggcctttgaaaacagtaacatttatttttatcgtgtgatatgtatatgttacaaagtgctttcacatattttatgtattaacattttattagatcttgataactatgcaagctctgtattattgttctcattttatagatgagaaaagcaacatccttcatcacactactagttcttatcagggctggagatttgttccctggttttctggtccacacaccttgctctattacattagagccacctactagatttatgaccgtgatacagaaggctgaatatagcaaatttctgactcttagagaaacattatcattttcttttttattactgacaagttctcatctgagaaacatattattctgatgttttgcttcttggaattctctcatgagaaagaaatctttttttcaatattttacttcttagcttgtagattctaggttagtacccaacactcgtcagctattcttaacattgttcattttgaagcttttccttatagtattaccaagtgtgtttaatgtcatccatgaactttagaaaccagatgatgcatacatagcatgaagaataaagcctggactctgacgagctgggctgtaatcccaaatcctccactgagcagatactgacttagggaagattttttaactttttggtgccttaattttctcctttctaaaacctagaaaagtgcctgctacatgataggtgttcagtaattattgtctgatcagatcctgaatatgaaaaatacttcagacattctgttttgagttagtggcaagcaacttaccat

SEQ ID NO: 97863 - DNA, 1256 bp, Homo sapiens
caatataagaatccaatatctctaaactgaattaattccataatttatctcattttcatgattctgtacatacttgctggttctgcccacccccactcccacctcctagtttctgtcttattgcctctaccttgcccttcagccctttactcatatttttgtcttttctgagaaggtgcccataattctgccttctgcttcagaattgaagaagtacttgttctctgtgctcttatagtgccctccaatgtcataaatattgacacttgggctatcgtattttctatctgtctcctccttggttggaaacactgaaggactataattatcatataggagaatttattggccatagaacgttaaaactgctactgttacctccctgcaaactttttttaaaaaagattctgggcaattaaacagttagaaaatgcattcccttttccatctctcagttcgtaggtgtaaagctttgaaggaaaaagatttaattagaacgtctgagtcagactgttactgctacaatcaaaattcccaagtggagtggaaatacatatggtcaactatgcaggtaagggcctacttttaactcatgtcttagggacagagaattaccatgtcctggggacaggaaatgtaccacttcaggaatagaaagtatttttggtatgacacagatctgtgtatcactatgaaagctgacttgaggatcacacacagtggttcaatgggtgagcagtgtgagaagaggacactaactccttcatattctccctcagcccctcccaagccactcccaatgaatatactatctaaatgtatacagcatgcctgctgttcaggcagtcttaagacaacatgttcctcctactttccacaattgctatccaaagcccctccaaatagaaattctggaataaccacttatcccaaatatggccaagatagcagttgctcttaattgcctagtactttccttcattcagcatttaacaaatacttattgagtacctaccttataagtaccaggaactatttctaggctcctaggatacatcagtgaacaaaatagatccctgccattgtggatatttacattatctagggtggggaatagtaaacaataaataaaatagggatgaaaatggtaaaactagtaagtactatgaaaaaagaaaatgtagagtaatatcagtgggatgagagaagtgggagcaaattggccagggtagttctcgttgagaaggtaacatttg

SEQ ID NO: 97864 - DNA, 1018 bp, Homo sapiens
gataagaaaaaagggcagccagaggacaccatgaagcactgacactttgtggaatctcatggattgtgtaaattccacatcagcttcacctcaaaagccagaggccactctggagaattcgagggaaaacactgcaacatgcttttactagcgtgtctataggcatgaacagtcaggacaacctccttccttctatgctgtccttaatctggttgaagactgaggggaaatgcagaacaagttcttttcctctaactggcagatcccttacccagaatacactgatgtatcatatatgagtcaaacaaaagaagcttaatgccacctattctttctgacctcctctatccagtgaggggcaagaagatgatccccagtccagaggatgttaagggttacagtactcaaccctctagctatggatgtattggccatggggtagggcaagggggaagtgcagcctgtggcttccagactggccctcatgctttgtcagttctgtaaatgggatggcagtggcacaggctggcaagggcatcctactacatcaggtggtttcaagggagggccagagtgcaccttcttttacggtgctgactattcctggccaggctcttacaaagattggctggacttccattggtaggccacacatgcctaaataacccactagtcctcttgaaccacaagctacacacaaaagataaatatttaagttctgggggttacagtgataaacatgcaatgtccctgacttcatggagagacagagtataagctaataaatatatatgtaatatgaagaaagaataaagcaggtggaagtggttggggtgtgtttgtttagacagtggggtcaaagaaggcctttctgagaagggagtgtttgatagagtatatcagtgattggaagggatgagctctgccaagatctgggagaagaaggttgcagcagactgaggaaactttatgtgggggctcgctggcatcttgaggacaggaaggccagctgtggctg

SEQ ID NO: 97865 - DNA, 1036 bp, Homo sapiens
ataaccttggtccaggcacagagtctttatggaccgtagttttctcttgagtaaaatgaagatgtttttactgaagagtttccagtattttcctcacctcagtgaacctggtgtttttaaagtttttatgttaccgcatttagtataatagtaacagcctgcttctctgctttgttaatcaaagacacacataaatacttattggagcttctgttctgcctgagacatgcaggatgcccactgacttgataaaactagtccacagctaagaagaatggcaacttttgtagccttagagggatgcctgccattccggtaggctttccaatacggactgtgaagcgcccagcatctggtagtgtgccagtgacactgttggcagccctggattagactaggcttaagaaccatagctgctctttaaaagtctatggtttcttgaggaccctgagaggaaacagctggtacttcctttaagcgaggggcttggattagtgatacctaaggtgccttcctgttctaaaattttgtcttgaataacacacacttcaatggaatggagaacattcagaccaaccccagctttctgtcactctatttggaggaaagtcagagacagttgacacaggaggagcaggtagttgtctgactgagaggagaaacttcaagagtttcccataattttcacccagttagtgaggtccctagaaaccatgtgttgtcctgagatgaagttcaggccctgtcagtggctttccaggcttaaactataacagtccatttgacaccacagctttaagattcatctgtgaagatttgaacttgaagttaaagacctgagtgtgcatgagtatatactaattccagtttcattctcatattcttggagaaagaaaaagatgaatattcaggttaaaaaaaactgaggttaagagaatagttacctttatcactttggtgcctcacgttaacacctttgaaaatgtgtatttacaaaaaacaaatagtaagaaaaatcctgagtccatttgacttc

SEQ ID NO: 97866 - DNA, 1053 bp, Homo sapiens
cttcttacctcctgctaaatttgactatctttcactccacctgcgtccaaaccttggcagtagcaaagtatatagccaaaaatacgggacatggaacctttggtttgatccttggtttgaacctccagattcctgcttaccatttattctcttttgggaaagtacgtcagtttagttactgacctataaggtttttaggagttcagaatgagataaagtatgtagagagaatgctgccttcacaggcagtcacgatgcagatgcttctcgtttttgttcttaaaacctgtagtgtaacctatttggtgtaaggagtttgaagcaagtatgatgagtttttacttttttttttttttttggcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaac

SEQ ID NO: 97867 - DNA, 1121 bp, Homo sapiens
gggcaattgtaaaaatcgctactttgtattgcttttattttgtgtcagtccctactagacatttggaattcattatcacaaacattcttgtctaacctatgtggaggctttatgatttccattttacagccaaggagagacccagacaggctcagtatcttcacctgtgttgccaaactgctatccagtagcagagccggggcttcctatctatgtctgattcctgaatgtcaaagcagtaccaccttcctaggtgctaatgattattcacaaagcatcttacctgtgaaaaaaacactattggggttatacctttcctcctagtaccgtgtgaagggcgaaatgtgtgcaggactggtagtctttgaaaagggtggatggtggcagttattattttctaatccaagaaatgttatgtagtaaacagttacaagttttgagtagaaaatttaacaatgtaaattacaaaatatttaaatataagaaattttcatttgatatgctgattgtttatgagtaaaaaccttgtgttgggaagatacacagagtaaatcagaaaaattagtttgatttccttatgtcctacctatgaaagaacatatttaaggtggcttgacagctcattcaaggggatgaaaaatcaagagccaaagtccctggctctcttgtcttctcctaaatttttttaaatgttagttaaaagtgaattcaattggtaacctttctttttcattaagaacacattcagttccatgaacaaatttgttattaactccaatgttataagtaacatcttagaagggaggaaggatatataaagctacagtctcagacctggtgatggcagctgactaactggactgagtgctatttctcatttgagttttcttcattcgctgaaattgctggagactgggcagagatgggaaatgacagcattcttgaccctgtgggagtcagaggtgcaaagcattcagagataagtggatgaaagaaatgaggtttgttaatagagcccaggaagtcagagaactggggcttgaagaagaaagacctaaaggaaacatctgctagcagttccagcaaggtgggggtgggagagcaaggaagggggaggaaag

SEQ ID NO: 97868 - DNA, 1007 bp, Homo sapiens
tggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatc

SEQ ID NO: 97869 - DNA, 1094 bp, Homo sapiens
tgaagacatgtctgcttcctgtttgccttccccataactgtaagtttcctgaggcctcaccagcattgcttcctgtacagcctgaggaactgtgagccaatgaaacctcttttctttataaattacccagtctcaggtatttctttatagcagtgcaagaatggactgatacactccccatggacctagactggttgaacccaatctacacatctcctttcctaggggatgttagggttttgggaatagaaaaataattcctcctcacataaaagtcaatatattattctatattgagtcaggaaatctgaaaccatggtaggtatttcaaacacaaaggatttaatacagggaattgtttacaaaggtgttggaagagctgaaggagcaaaaggaagaaagggtgatacacatagaaagctcctgatgttcctaggctggcattcatgagcctactcttggtactggggagttatggatgttgcacttcagggactggaactgtcaaaattgtccttccgtggctcaggctgtaatcaagaaagagactgtgctgctgcctgggctgccagtgtctgcagttacactagcccctctgctgctacagtagctctggttgaatttagaaatagaaagtttttccctttttccaactttctgatctttcccaatgcctgcctgccattgacagatttgatagatatgaacaggaagccactgtcaaggagtctaagaaagggaatctgcagacttccagtcctaagcaatatagagaaaattataaatggttaagtataaagctgagaaacaatagatacataatcaacacagtcagacatttgctctaaagcaaagcttcctcaacttgtttttaggtcatagcatgtattttaattgggataagctgggaggaatgtggggcttggtaaaaccatatgtcttagtctatttgtgctgctataacaaaataccggagactgggtaatttataaagaacagaaatttatttctcacaattttggagatcaatgtgtcagcaggttcagtgtctggtgagggccttgtctgtgcttccaagagggcatcttcctgct

SEQ ID NO: 97870 - DNA, 1088 bp, Homo sapiens
acagccaaacacaacacacatgacccaggagtcagaagctgaaggaaaatccaggggaacatggagcagttgctgcttcacagcactgaggtgagtcagcagatcagtgacaaggtgtgagagctacaaaatggctgaagccctctacctctcctacaagaatctccctgtggccttctctcagtggaaacatacaggaaagagaactctggaaaaggtggctcagcctggctaaatggacatgttatctagtcaccacacaccatcatgtttgtagttcagccagtggaaaggaagaaggaaatgaagatctcaccctcttctaattaaggacacttcatcaaagggataccttctactttaaccccattgactgaaacctagtcagttagtgactacacttagctataaaggaagtagaaaatatagtcttcattcctgggccaggaattgtgttcctagggaaggaagaaggatggctattgggagatgacttgcagtatctgccacagtatactttgctccgctcggaatgtcttttcctccttctctgcttggcaaactctagttcacccctatagatccagctcatttattatccctcctgcaaagccttcactctttgttttcccattgggttttataaatccctgtaccccagtactttcttatttattcatttaccaagttttaagtctccccatatgtgcagcattgctctgggaactggggatttagcagtgacaaaacaaagtcctttcctgtacaaagcttattgcttcataattatttatgatactttgtattctaaggctgtcccaaattcagacaaaagaaggacaagattcatgggtaatttcaagcaattttattcctgactaaaaatgtaaatctgttatctagaattacgattaaataactgagtaagtcttcaaaagtacatcatattccttcctattaatcacaacggtaatatttgtgatttataaatcatgtctattttagggaattacggaccttgaaaagatcttggagattatctgataaaaccaccttagtttacattagaagtctgagtcttgaatcac

SEQ ID NO: 97871 - DNA, 2200 bp, Homo sapiens
tgagtctccccaacagctcgaattcccagagtggaggagcccactgcttcataaatgcgagaacccagagcccctagtacccaactaggctagcctcggagttggcacggcgtgcagaaagtggctactgagcagccgggcctggctcacccgcttcacacgtcagtttgactcctctccccgccccccaccaatcccccgccctactctccgcgcacccagagccgagagaaatttgactgccctaatcgccaatcaaaagagaggtcgaggatttgagccaatcgcagcgggcgaaaggggcgggccgtcggcgagcgctgaaggtctctagccctcccctgcgctttagcctcagtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaagtgagtgtctccgcgaggcgcaggaggcctcgttcctttcggggcccgggctcaggctgtgtggggccctgcggtggggcgggataggagccgagggtctagaaaagagaaagaaagaggtgccgggcggcctgcgccgtctgcgccatgtgattaggcccggccccgcccgcgccttccccgcccgcaaccctccgccaggcacccacttcccttctccgcccccggcgggggtcgccctggtggggccgcggtggggcctgatgggctcgcctggcgtccccagcgccagagaggccgctcccctgcccgcgctgcgtgctcagctccctggcttgcggctgcagcgcctggccgcccgccccagccattcgtgggcgatgctgcacgaacatctccaccgagtgacatttaggagttgggcgttcagcagagcctttaccttcctgacttgtcgcttttcctggctcgtttccgctctgcctgccctcccttggtttctgccatcatccggttggaagccagatgtgacagagagctctttatatttcgggagtggctacctcaggcacgtgtagagccatctggggcaccggaaacaatgtttcagaagtgagattaggaggaatccggtcatgtggccgagaagatggggcacgcagtatagaccacctgtttgcataagggaccagctttggcttgtcaggtcttccgtgagatggggagatttttagaaataaaagttaaatagccaagatgaaatgtgacgtaatacactaactcagtgaaaaatctgagttgagtaggttttgtgacttcattgtgataggatgttgactcatcctgtatgtgtacggcacagtagtttagtcttaaagcaaaactggtttttcttaaacaatatgcaaagcagtctcctatatatttttgtcttgtgtaatacaaatggaccactttgttttcccaaaatgggtaaaaatttacggatctgctttcattataccttactctttttctggctttgtacgctgacactctaacctgttttgcttcccttttatttctgctgctatttccagctctagagttccttaagtcaaactgaaagtgagaacattgttataatttcaatctcacgcctgcttgatgttttcctgtaattgaagttgggaccttccagaaacttttctaaag

SEQ ID NO: 97872 - DNA, 1049 bp, Homo sapiens
ttagtttccacaaaaatgtttatcttgagaaattgctatacatctgtcttatatgaaactatgtgagttgcactgtttaccttttgctctgctgataaataagttcagagtaaatttaatgcttaaccacaccaatttcatcagttcacatggctgggatatctgcgtttcctcctttccttggtcctgagtttatattttatttactttatattctggaaggaggcgtgatataagcaagttactttacctttttttcacaaactctttgaactaatgtcactttagactatgctgtttccatcacgcaactttagtgtggtttaggatacgaacgtcttaatatcacatagaaaaatttaatgatctttgctcagttttgtctttagtgatcttatttaattttgttatggttcattctgttatcttgaaaaccaactttgcttgcctctcttcgttttcaaaattgttctctcttctttcctagttctttttgaatttcctcactgggtaaaaaccctgaggctgaggcctttgtccctttcccacttgtctgccttctcaacagcgtatcccttctttcagctttgactctcatctttgtgtaggtaatacttcacctcttaatccaaagctctgttcttaaatttgtcgccacatattcaatgacttcaaattttaagtctgtaccctgatattcattcttttctccaattcaacctattttgcgtactgttatgagagtaattttagagttttaatttgaaaatagcactctcttccagaaaaccagcaggatctggaatgagcattatattaaagtcacaaactatgttatggtttatgccagcacttgcccatatggacatttttatcatacttttctctgttaagctggttatacttatttccataaagtccagaagtatgtatcctatcttagtgaatggtccctaggaagagtcagagggatagaggtaaggggcattattaagtttttttatttggacatttattttttaatgagaaaggaaaagagatacataaca

SEQ ID NO: 97873 - DNA, 1035 bp, Homo sapiens
agcaatttttaagctctatgaggaacttacaaagtattcatacctttttaggaatctaagttcacaaaataaactgaagtgttagaaagatttatttcctattatttttggtacagtgttatgcatactagagaaaaatggagaaaaacgcatgttcaacattagtgggatagttaagtaaattgtggtacattcatatgagggtctcttatttagtcatttaaaatgtttgcaggtactttttaggatataaggtaatgttataacggccaaaagttagaatacagaattttctatgcagtatgatctcaagctatttaaaaagctcagaaaaagtaatagaaggaaataagccaaaatgacattagcagttgtggtttatgagaacgagcattgtttttcctgcctccttttgttacttttaagatttcccccccattataagtgggaaacgtctaaaacagtaaaaaacattccatagttttgaaaatcaaaggaaccacatctgttaagttttgaacttgtaaatctctactgtctactcttctaatatcctgattctggttgtataagaacagtaagcaccattacattgaaagaaaagtatgaaaataggttatgtatgaatttgcacagctcctgtttatcagcattgtctaatcatattcactggtacccttaaacatcaaactttaaaaatttaaaactatgcttgatatatctccctagtaaatgttacatatttctctgccatattaaaacattgtaatcaatagagtttaacatttcttgttcaacttatgtgtattttaaggatgcattattatactgcactgtaatacagtgatgctgtaagacaagtgctggcacactttccctgaaaggccaaatagtaaatattttcagcttttggggttctctagtcactactacaacttctcagttcagtggtggtagcaaaatagctgcaaacaataggtaaatagatgtggcagtcttccaataaaactttatttacaaaaagaggaggtccct

SEQ ID NO: 97874 - DNA, 3419 bp, Homo sapiens
ggttatttaacaatggatttagttaaaaatccagtagaatgttcatacaaggattaattttgtgttctttctacctctttagtaaaataaaacagggtctgttacctagcttggaagatttgctgttctatacaattgctgaaggacaagagaaaatacctgttcataaatttattacagtaagtttttatatttttctatcttaacttaaaaaaatcaataataataaatatatacagtattattgaaatatagtcttaaaggtcgtctgacatgtagattctgactgacaatatttctcttattatgttttcaaatttttgtcatgctcatttcaaggtaatcagtgaaagaaaaagaaagaaacaatgagaaacttgtccagaaagtgggtaatagtgacactaagatgccatattcatgttcaagtgttgggtagaagtttttatatacaggaataaaatcttatagttggtataagcatatacattatttgcactatatatttacaaactcttatttttttaaaaacaggcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttgaagaacttggtacatattaggttctataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctgcattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaactgtctgcacaatattctgattaaagtgctttctgtgggcattattttgttgtatctgtgaatgaagttgttagagtaatggttggtagatctgttgataatcagtaggggaactgctttggaattttaagtggaagcagtattttacactttttttttttaagagacagagtctcattctgtcgcccaggctggagtgtagtgacatgatcttggctcactacaacctctgcctcccgggttcaagtgattctcccacctaaattcccaagtatctgggattaagggcgcctgccaccatgcctggcttttttgtatttttagtgagacggggtttcaccacgttgtccaggctggtctcgaactcctgacctcaggtaatccatccgcctcggcctcctaaagttacacggttttaatacttgaaaaaatatttatgttttgtaaacatgttgttatgtttaaatatgaaattaaaaacaatttaaatcctctgattattaagccagggaactgcaaacattaaattttctgcctgcaattaagagatagtaattattgttttaaacactaatccaatttttaaaaatctatgcttgtaatacaggcagtttccaacttgacaaatgttttatggtctatatgagcaaccagtagaaaagtacaagtctctagggcataattatttctctttattcttagaatgaggtggttcaaaacctccaactgttaaccttttaatagctttcagtcacctggaaaggtgattgcttcagagatgttcttttctctgttttcaaatataagaagttacctagttagtgttgccagaaataaacttctccctttcatgcagctagggaggagatgttaaaacatgggattcatttttccccagagaaataatttataaaggtgggtaggtttggttgaagcagtgtgttaatattttacctaaaatacattgtagattaatatttttagactttttcggtaatctgagaaaactattatgtgtgactttttttaacttgggaaaatacgttctaagcatactttttggagtaaaacctgttcgaaagttggagactgcctgtacccaggttgatagtcaattgtttttaatgctagtaaatcttaacactaatacaagtaaaaatatttgtgtggaaaactaatcctttctttattcgtgcatttttaactttataggtattaaaactttctttgtatgatcataattttttgatctttttgttttgcaagaaagtgaatggtagcctttcatttgtatgtttgattttcttaaaaatttcatatttattatgttattttacaaatgaaaaattatttgtgagaaatgttttgtcaatcattgtgcattagtttttagttataaacacttaaggaaagaaaatgattattcccggcttacagataagaaaactgaacaaaggacagagatatatataacttgctgaaaagcataagcacctcctcagagttcattttatatgacttctcatttcctagttagactcatggtatctatattaaaataactcccaagaaaaaccttactgtttggaatggtgatcggtatgc

SEQ ID NO: 97875 - DNA, 1272 bp, Homo sapiens
tctattactgcattacagagacttaagaagctcagaatatacaattggctgtaatccatttgcaaaacgttttaaaggctacgttaatatactgattttctggcttaaattctttttagcaaaaagcagaatacagttcaaattattagatttcagaatatcatgctctcccatccacttggtttactatatttttaaaatacttttttaacagtgaaacatttttattctgcattatatttacatatcttacattaaatagcatattgtaatataacatttttggtgactcaaataatataaaattaattattacactacttcatatgaaattttatttcaaattagagattatttttacaagcatatcaacagacatttcatttaagacataaattaatctgactaaacaaagttgatataattaaggaaaatatgttataatgcaaaatgtttaatttttgaatgaaatgctagtaatagttatataagaactaagagatgtatttctgagattacttggtaaataaacaagatctcaaccttggcagtctgaattttgttaaccagatgtcgtcatgctgaatgttaccaactctgattgagtaagaagcttgtttcagatggtcttaatacttaaacctggtggaacgccttgtcttaatttgtgacacaattttaggcacatccagattaatctcttacacgttcaacagcttacaagcaactacttgaaagactgctagaaggaaagataatgtagaaagcataatttatagaatttagttgtataaaatgataaatttatctattatttaaatagtgtcctaattattactgttattaccaagttctgatatttgaaatgtacccagtttattaattatctttttacattctacagatgtgttcagagcaacattgttttgttgacacaagcatttagaagaaagtttgtgattcctgactttatgtcttttacctcacacattgatgagttatatgaaagtgctaaaaagcagtctggaggaaaggtaatgcttttgatgtacatattttcataaccgaatcacttaataaattcagcttaatttgaggtctagagagtaaattgtgtagttgtgttttgctaaagaaaacactttagcttcgcttaagaaatttaagtgaagccactggatttagtgtttttacggtattttaaatatttaactttgttattctggttaaagagaaatctaagggtaagaattttttattttcagatgatgg

SEQ ID NO: 97876 - DNA, 1050 bp, Homo sapiens
ctgcatataattgcactgtttgaagtttaaatccatgttcaagattcaagtgtataacaacttcagtgtaaatacttactacttacttttaaatacttgattcctaatgttttagtgaaaccctactagcacccatgaccctgattaaataaatttacttttttcctgcttaaaaaaaaaaaaagttcaagttcctctgctagactctcctgctaaacatgagaaagaaagaatgcattggaaaataagaaataatagagactgagaaaagtcactttagatctcataattctcaagtctgttttgcctttagttttcatgagcattgttacagaagatagactatgaagccactgagtgttgtagaataactagtcattggtagaaggtaaaatgagataagaaatttgttggtggaagaaaatacattatttgtcaatattatatctattcatttctttccaatcttttggataggttgcagattatattcctcaactggccaaattcagtcccgatttgtggggtgtgtctgtttgtacagtagatggacagaggtaagtttatttcaaattcatgaaaaccaactctaagccttaacttttgtataatggtgagaatgacatggagaagatcatcttttataatggaaattagtcctaacaggatataatttcaaaaggtaaataaatttaaattttaatgtaatttttaaaaactcaaacagtaacattatattaagttttatgagacatctattttattcacagttgtagtcttgttttttgagtattattcaaatacctgcagttaccaatttgtttcagaaaagcaggcttgtcaaaacatgacactattctctaatgaactgactactaataaaattagtccctatttctcaacttaacattggtaacccatctgtcgttgtctttgttccttgtgttcctgataaaattagcatgagaattaagacagtgcaacataacgtatcccaaagttaaaagtcagttgcaaaacatgtaggatttcatgaagtccatgaaagca

SEQ ID NO: 97877 - DNA, 2061 bp, Homo sapiens
caaagagaaaaatcaatattcttttttcactcatttttaaagacttagctcagagatatattcctttgttttttgtttttttattaaagtatttctgttttatcaaaatagaacttacataagatgtacaacttgtaagtgaacacagcttgaaaagtttatatcagagttgtaattttacctaaatttcgttaaaactactaaaagccgtttaacctagtaattttagattttacttttcaagataatgttgcaattaaaaaccttttttccttttatgaaaatttgatcttttatgttgcccaggttagttttgaactcttggcctcaagtgatcttcctgccttggcatcccaaagtgctgggattataggcatgagcccctgccccccagccaaaaatctgtgactcgtaaggaccttcattttaggtgattttaatttttttttactaattatcctcaagtacttacagtaaaaaatatatgggttagcccattcattttgaaagtaaggaatctgaggaccatagttgacatgatattggcaaaggtgaaatgaacacctaggtctcttaacttctagtctattttttctttcattattatatgcctttatcctcatttgggtcagtaaaatgtactgagcagtcaccatgtgttgaattaaatgttgtgtgctatgaagggacacaatgaaatgaaaaggcatggtgactttatcccttgaagcaaattccggtagggaatggtattcctgtttttgcattttaggaaataatttatcaagtaatggaagtctttgaatttgaagaaaattattatcatgtaatattgaatatgatttttctcttcttaaacattctctatgtctcttagtttttttatctagagaattcagaaagttgacttcagaactagaacatatgtatttttaaatccaaaggtagtaagacaagctcttaatcattttttagaatgattgtcaagtttgaagtaacaatcttatatagtataactatatagtttaagattatagttacacatgaataaatttgataggaaaaaaatatagtgcccagtttcattatgaatgactttcactatgaatgaatgctttgtgatgtgttgggacattgttcagggaacctgggaggtatcagtaagtaaatcaaagatctctgcctttgtgaagcttacattataattgggttggccagaactttttcattcccaaatcttttctctacttcatgtacttctcagtttggtggtaatataaagctttctttttgctctgttatttatctgcatggtaatgatgactgcctactgaacttagtgccagctctgtcatgtttataaaactggatgcttttttttttaatggggcccaggattgtgagtggatgtggcttgcaatatgaggcatttgtagacagggtcccagagaatagtattgaatctaaactgagttctgtttaactttttaaccatggtttagtcacagcttacagctctgagttgaaaaaaaggtgaataatttctaaaagggctagtttattttatgtgattgaatacacgtgggagtaaggaggagcatgctcttactctcttgccctcagaggaaaatttccacattacatatttattatctactttaaaaccattattctgttacgtgaatactttcatgcttttgctttttttcacagtatttctcttaaaataaacataggtcaattctgtatccatggggtctgcacccatggattccaccaaccacagatcgaaaatatttgagccaaaaaagatggatagttgtggctgtagtaaacatgtacagacattttttccttgtcattattccctaaataatacagtacacctatttatatggcatttacattgtatttggtattataagtaatctagagatgatttaaaacacatgggaagatgtgtgtaggttatatgcaaatgctatatcattgtatataagggacttgagtgtccatggagtttggtatcacagggattcctggaatccacctcccacagat

SEQ ID NO: 97878 - DNA, 1858 bp, Homo sapiens
gatcctgtctctacagaaaataaaacattagccaggtgtggtatgtgcctgtggtcccagcttctttggagtctgaggctggaggatcacttaagcctgggaggtcaaggcttcagtgagccatgattgtgccactgcacttcagcctgggcgacagtctgaaactttggctcttaaaaaaaaaatcccttataattttattattctatgtaaatcacttgtttgtgttttgaaatccttctgtgtatgtgcttgtatataaagataaaaataaagcactaagaaaaaagcaaaattgagtacgttagctgtgctttttccaaggtcatttttagtatagtaatattactcaagtgtttaagtatttgaaataatggtattgcttttatattttacagataaaccacataatcctatggtaaatgctggagcaattgttgtgacttcactaataaaggtaaaatgttgatgtttcattttaacctagtaaaactttttttttttaacagctaaggcataaagatgaatctgggattatttatgtagaattatgaaaaattttctcttggtgttaagaaatttgtcttatggtatagtgttaggatctttatttcaaaataaatgatgtagtcatttcaaggcaaaattaaaacagatgactcattgtaaattccaacagtcatttactcttgacttgaagatctggaaaatatttaaagtctgctgaagaaaggcatagaggctttttttttttttttaaagttttgatatttttcctttcgtttccttttggttcttccagaatgaacagttataaatagaattaaaggcattttactgtatatttgttattagtatatgtgggaacaaatgttctggtacttaagacaaagtacatttaccctcaaatattctcaagtctttgatactctcatgagctgaaatcacagtttttattggaacttgtttcatttggttttacttaaatcatgccataattaaaataaataaggcttattccaattatggagttatattttcttatgctttgaaatttgcattgtaagggttttttttttttttagtgtttggtttgcgttaataattggaagatctagtattttaaaataagtatttgaaaatggttcctgtgtgatagatttttaaatctaccacacgattttagatgtttcagatttttaatttctaattataaattttatttatatttaaataaattttatttatgtttggaacatttgtatacttctttggtaaatctgtgcctatctattccaagttagaggaaagcataactacatggccttgtaaatgcattactgtggataaggtaccctggttacatgaaggatatttgagtataaatgatacccttggcccagttcacaaaatttcatctaacttgtatactagaaagcctttcttaacttttaagagttttatatctgtgagaaaaagcttttaaaatagaaggctggtatcttaagaatctatatgtttacttgttacttcaaggcaaattctttgaaagtattggcccatttaattcttataactctaatgaagtagatgttatagccaagtgtttttaaaatgtaactaattgtaataggatatggagaaagctgtcagtttgagctgaaagaaacttgaaaatgcgattatttgcaaggcacagtcctagctttaggtagcttactttgtagtgtgggatatgcaaaagtaaatgggtccttataagaaaattcaataaatgctgtgatgagagaaaagcctcattaataattgcttagatttgaacaagtaacttaaagtagaaataaggaaacacatacta

SEQ ID NO: 97879 - DNA, 5268 bp, Homo sapiens
aagaacttttaaactgaagagagattaacatacactacgcatagtctcaaaagggcttatgtaaataattaatagaagacttccttcactgcacacagttaaaaatctttcatttaatgattcatgggtttaacagactacaccgaaatgctgcatgtgggaattgcatgtctggttatcatatcacactatcatttcattagtttcacttgccatgtttagtcatgagtcataaactatacattgagctgcattttagtatgagtgattataaacaaagttaaaagatacatacaacataagtgtggttcagtgttcaacagtgcaaaaatttaattgagtcatcttgtacctacaaatttgatcagtgattttcataaaaatttaaatttacaggcaaagttggaaatgaggcttcaggatatggtttatatttaaggtcactttctcctgagtttttgttttgtttttagcatgtgtttcacaagtgctttttttttttttttttttatgaagttcatacaaatcttggagagcaaagcctgatataaccctatgtaaaattgaatgccccagaatatgtaatatttttcttaggatcttttagggaaaggattaaattcatataaatatctataatgtgatctctgcaaattgtatgatcacataatatttataaattggtattggtttgaaatttaggtaataaaaccatagccaaaaggccttaaaaattgtcaaacccagttctcttactttatataacggaggaaactgagaacctggcaaggttgtaacagcagtagaattggacttgaactaaatctcctgatactcaatgtgctgttcattacaattcactctgccatatttaacgtaggtgtttgccatttctcttgatgacatctttaattttagttagcatagttatattgccccaaatgcagaagtactatttccttaatttgaactggttcaaacgataacaatttattggtttaaaagttgtatctcatttgatagcaagtgttacgtagtcattcttcggacattagtcagtaaagaaacaggcccttttccaagatgcttgcatctgagtacccaaagccacggatatttcaccatggctactagaggtgaattctgtttttagctcttttaattgatgaccttaaggctatttgtgatttttttttttctttcaaaattcaggaatttatcatggtgccattaaaatcattttcttcatgttaatccccccaccccaaaattaagtagagtctttagtaagactcttgatttcataattttgtagtattgatattttttccttgtaggattggtggtgatcctcaggaaatgggggaagaggcagagcaaatgttcaaaaggattagcagattgtggaaaaaaggagaatttggacagaaggagcctgttgcataaattcttaactactaagcttataggaaaactccaatatttaaaattttaaacaaagctatataggtaaatacctttttaaaaacaaatgtaattttatacttaaaatgcacataatttttaaaaatcataagggtattatacttcctctctttttctctgtggtagctactaactttaaaggaatactttttgttgtaatctgttttatttgggattgtgataatgtgtgattgcttgattaaaaggaaagaacaaaaataaatttgaaaggaacagttatttttatatgatgtagcagtatccttacgtatttgttttcttttcactggtaaaaatttcacgtagttttagtttaaaagttaagatctggtgataacttaagggttaggataggaaaatgaggacaacatactgcaaaataattgccacacttaatgctttttcatgttagaaatagtaaaagttacactgtcttctatgtttttacctctcagagttttttgttttttgttttttagagacaaggtctctctctgttgcccagtctaagtgcagtggtacagtcataacccactgcagcctcaaactcctgtgctcaagtgatcctgccacctcagactccagagtagctgagaccacaggcacaggctaccatgcagggctaattctttataaagctagggtcttgccatattgcccaggctggtcccaaactcctggcctaaagtgatcctccaagtttggcctcccaaaatgctgggatgacaggcattagccactctacttggcatgcctcattctagtggtagtttccagtttttgtcatttaaagaagttcaattttctttttaatcaaaagtatttttgaattttaaaaattagggttttttttctttctctttaaacaatttgtaatcatactcattgaaaatcaagacaagcttagttaatgtatatgtgatgttcagtttggttatgttagcaataacctgttaggcatgcttataagacaggtttttaaagtagtttgtgactctcagagtaatgcatgatgccttggacttgcaacattcagaagacaggattatattggtttatttacttcttgtttatatcagtttatgctttagttttttttttttaatgaaaggtagagcatttattgtcaactgaaaattgttctgttactttatttttagggttgatctatgaaaatactagatctagaaaaacattcttttttacctggagtgtcttattttttattttcctaatactctttagctttaaaccattttctatcataagactaaattaagagtatttcacaaaatcgtttttagttacctctttttgcctttttcctctatgatctctaatttttaattggcttgcacctccatactttatgaatggaatcaagtgcgatacttacaaaataactctgatgcattgattttaaatgagccattttattattaaatttattggcagatgtccttgttaacagtgtttttcacctgttataaagtataatacatgaatcaattcataaatatgttgtaaaaactataaaacattgcaatatagttacattaattttttaatagataatgttaaaactcagtgcctctatcaaattttcattcatacagtattcttcaaaggaatgtaaattctgtaacttgacaggcatatttacagaaaaattttataatttactttttttttttgagacgaagtcttgcttgtcgcccaggctggagtgcagttctgcctcccaggttcacgccattctcctgcctcagcctcccgagtagctgggactacaggcgcccgccactgtgcctggctaattttttttttttttttgtatttttagtagagacagggtttcaccatgttagccaggatggtctccatctcctgacctcatgatctgcctccctcagcctcccaaagtgctgggattacagacgtgagccaccgcgcccggcctaaatttgtataattttctggtaccagaatctgattacccttttcaaacaacccatatgggtttgttttttaaaaatcatttggtgagtggattagaaattttgataagtatatttcttccaatttggtttattttaaaaatgtttctactgtatttactacaaatgattatagctttttcaaaaataatacagtatctaataatgcttgtacagtgatcttcaaactgggataaatatatctttggattccatacttggaattctttccaaggaataaaggggcattgacagttttaagataagtcagtttcaaaatctgtttctagatgcgccttttaaaaaattaatctgcctttagtccaggtgtcctcctattttccaaaagaaagacatagtctcatgtctttcaaattttagtacagtgcactgcttcacattgtaaaaacctcagcccaccagcaaaagaggacattttgaaatattagagtcagtgttattaagggtgtgaaccattgtaataactggtaataagtcctgttatatactaggttgtttccagttctttggtttcagcaaaatcgaaagggaatcttaagttgtcagtcaataggagcattagcataatttttgaggctagagtactgtatgacttttggcatgtaatgagctggaggcatataaagaactgagtaacattgctataataaaacttttaaaatttcaatctacttgtctattataagcaattcacacctctgtaaaaattaaaaatcggaagagaattagtcctgagttcattctagcaatagaagatatccactgatatatgaactaaaaatcaattactgtttcaaatgggaaagaaaaatactcaaaaggaaaatcttacaaattagtatgggaaattattagcaaataaatatttttcctttaattttttattgtgaaaaaattcaaacatacaaaatacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatgacatgttaatgattattagatctcatctatccttggggtacatggagtcgttccaagagatacacaagcagatatagtttattgacttaagttaaatgccatttccagggtaaataatatgaacaaacaataatcaaatgcctttacatttaaatgaggaagtatgggggagaaacattctttagtcaatgcaattattcaatacaggcatacctcagagatattgcagatcacctaactaaagtgaagattgcaaaaaagcaagtcataccaattttttcgttaaccaatgcatacggaagttgtgtttatactatagtaagtgtgcagtagtattgcatctaaaaaaaaacagtgtgaataccttaattaaaaaatattttataggtaagaaatgctaaggatcatcggagccttcagtgagttctaatctttttgctggtggaaggtcttgtcttgatgttgatgactactgactgataatggtggtggttgctgaagattgcggtggctgtggcaatttcttaaaataagacgacaatgaagttgccacatcaattgactcttacttttatgaaagatttctctgtagcatgcaatgctgtttgacagcatttt

SEQ ID NO: 97880 - DNA, 2758 bp, Homo sapiens
ctgtgaaacacaatgaagtgaagctcaataaaatgaggtgtgcctgtattttcttttgctctatttacataatctgtctagagaatgttgagtacccaaaatgttatactgtataatgctagacattggtaaataccagttgtttcttaaaaacaacgttaagagcaaaacttaattgtgctttaatttagtaagtcacaaaatagaccaattatgtgaccatagtctagagttgaatggtttttatttttgtgtattaaacatgacagcccaatgaagaaaacttgtaagagttttatagggtacagtttaggtcacagaatgaagttcaacataacttgtttattttacattgattgtttaaccagtaattatccatatgacatcccaatgcaaatgctgacatccatttccaaaagagttgtttttttgtgctttttctaaggttacaaaggtttttgtggtttaaatgttgttacatattttacagcattaggatctatggaatattttgacaactgcaacagttcaatgaagttggtaatttcttcttttaattatttttcattgaacagctttggagttacatttctacattttgatttctggtatattataaggaaagaaaaaattatgtcaaaggatactttagagaaaatacatagatagtgattacaatatggctgtaattaaattatccttaatcttgttgaagttttgttagtgcctaattttgatgaaatagtatggtgttccttccagctactgattgtatatatgtgattgcacatctttcttaaaaaagtggatttgtaggttttcacatattgtcagccacactctaatcctcttgtaaagaatgaacctggctttattcaattaaataattctctggtacaggttttcctcccataatattttaaagtacaatgttttgggttttttgagggtaaagtaaaagaaaatatgttttaaaaactttagttgtcaaattattttattttaagcctattttagaaattagagatgtattgtttcttttgggtgcatatcaccaattaatacgtttgatttcagatctacaacttactgctttgtaaacttcgccgaggtaaaatgaaaccatttggctacttgaactgatctacattacatagatttttcctattgacatttgcagtagataacatgtcagaaatgaaagtgatgaaacaatacatcttccatattctgaattggcataatgctaaatacaacagaagctaattttttagagactgtgaaatataattttttttagttcaagtatattatagcaagtgagagctattaagaatagagctttctctgcagtagtaaaatgcaaccagaatgtttgcatatactggaattaaaagattagttttgcaacataattcatttttctaactctgatattagtttaaggatttaataaaatataagtagattgttcttaattgaaatattttatatatacttaattcttttcgaagggtgaaactttattttaagtttttttaaatataagattaaataaataacacattttagcaaattatgtgctgtcatgaaagataagggaattcatggtaacttgtatttaaaattctgtaactttgggttgggtaaagatatacttaaaataaagcattccctttgtaattctaatgcattctcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtaagtgcaacatgtcattcagttttcatgccacattctctatatatttgttttttgattactaatattccctacttttggtttctaggtcatgcagtttttgaataagatggctggtaatgaatatgttggattcagtaatgcaacgtgagtgttttaaatactgttttgttacgtaaaaacacacaactgtatttagaattgatccactctcttttcattggagggaaatgaatgatttctaaattacctgacagaaacacttaaaaatactttaaatagttttgacaaatttcttacaggtaatcatacaatcagaagagaccccaagtttatctcaaattactggtgcttattcagttttatctttgcttgtaatacctgtcttacctctcttctatttctgttccaggctatctggatttttaccccaattttttattttaaaatttgtgagtctatagaaaagttgaaaaaataaatatctggaatcttttacttatattttctaatattttgtcttacttgctttttctcaatctctgtctctttagatagataaaaaatatgtatgtatacctctaaacacaaatatgtaaatatatatgtacatagattttttttccctaaaccatttcaaattaagttgcaggcatcatacttcacccttagataagaaagcacatacagtctaagaataaggacattctcctacataaccacaataccattaacacatgtaagaacgttaacgttaattttaaaatatcatgacattaatcaatatgtaaatgtccccatctcttccccaaatgtcttttacaacttttattattatt

SEQ ID NO: 97881 - DNA, 1041 bp, Homo sapiens
tttgttttgtgggtagtcaggagctattaattatttggcatctattggttttgataatttggtcccagtctcctttgtttgtttgatgttttcccactcctctccatgtgccattccccagttacatcagaatatttgccattcttcagtggagccctgtctatatacttttctaacccgttcatgatgcatggaatttgccagtgcctaggcctcaccctgaaatctattagtccattgagtcctgcaagatccattttgtgtttcccactctcagtgaaagttccatgattatgtcaagttccctgattatgtcaattaaaatggactcttattgtacttttgggtagccagaggattctgcagtttttcagtgtattttaatggtagaagatttgagaattttaaaattagcatttttgtttacaaaatatgaagactagaaaggacctgaattcgtttcagtcattttatagccaagaaaatgaagattgaaagaattaccacttaaatgacttgtccaaagtcacacaaatagcctattgacagaattgattggaactctgtagtcctgaatcttagttcagtgttctttatgctgtacattgctatgcaaatgaaattatgaacaatcacacttttaaagaaagtacatagagcaaatgtttttttttcttcttccaggtttcagtctgaaagagaaagtggagatcgaaattttgcaataggatattacttaaaagaaaagaaggtttttaaatttttgtttctatttcaaattattctttcatttaataaaatacatgaagatgtatgctaagaattcaacaatagcctttaagcaactacctattactatttaaggtgcagaagtttttgcagagtgctcgtgagtcagtgttatcaaattgttaatgttattgttaatttgatttgtatctggcagcatttaaatatttgactcatattatttattaatacaaattttgtttgaggtttagtctattttttcaaaagcatgatgcctgattactgttaact

SEQ ID NO: 97882 - DNA, 1152 bp, Homo sapiens
taccatatagatggggatgccgaactttgttatgggtgaaatgtcaggcactgtagcatttttttctaaaatggtgatttctcatgtagacactatcataatcttcatgtatggtgctttatcttaaaaatatttcatggctctttttttttctgttgagttaaaagtaattatgcttgtgtattccacagaaagtattaatatttaagcaaatttgaatatcacatgggataataacaaatcttagtgtttagaggctggcacttcctagtctagttctgccattaaaagactgagtatctttggccaaatcagggtaaatcttaaaagtgggtaggacttcggtcaactaaaatcttcagaatgtcctcaagtttatattaaagtaatctctttggaagaaatatttcagatctgtatgaaataccaaataaaatagattatcttaaaagtgaacagtaatattaaaagtagtatgagaattctgctttttctttgtgttagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgtaagtaattgtttaatcttattttctctggcaagaaactagtctgaactggttcttttaaaaatgcagtttgaactttgcttctaaagctgtatattaatttttgagagagaggcttgttttcaaggttaatttgttacaagattagtaaggaatagagataaggtctaccagatgttcttaagaacttggaagtttgatttatagaacctcatcccttctgcttttaaggcaatccagtgtacaaggttagtacagtctttctttactttttgtttttaatgtttagcattatgattatgtatcttaagaattctctaagttcagaaagattgcaaagatgtgacgtttcacatctttggttacggccatagctgttttaaggactaaaagtgtattaaagttaaaacttaacaaaaatgtactgctttaagctctgttgtgcatttgccacttgtaaagtatatagac

SEQ ID NO: 97883 - DNA, 1290 bp, Homo sapiens
tcccctatccttgtcatatttcagtatgtaattctaaataaggatccttaacaaaacataacaataatacagtttttacatataaaaattaaatattacatatcaaaactttaatatcattattaatatcaatattaaattgaatatcaaaatatttagttagtgtttagatttcctggattatcttgtaaattattatttctttttttttttttttgagacggagtttcactttgttgcccagactggagtgcagtggcacgatcttggctcactgcaacctctgcctcctgagttccagcgattctcctgcctcagcctcccgagtagctgggattacaggcgcctgccactgcacctggctaatttttgtatttttagtagagatggggttttgccatgttggccaggctgttctcgaactcctgacctcaaataatgcacctgcctcagcctcccaaattgctgggattacaggtgtgagccattgcacctggcctattatattattttatagtttgtttgacttaggatacagatgaggtgcatacattatgattgggttttgtctcctttttttttttttttaaatctattggtcttcttttgacctgtctctctttttttcttgttatttttggttggaaaaactgggtaatttagtctatacagttttccactgtctctacattgctgattacctctgttccattgtcccttgtatttcctataaatttgtagatccaattcaggtgtgttttttttttttttttttttttttggtctgcttgttttgtttagttttgtgtaaaagtactttattggtatacttcttttatttttgtttgtttatttatttatttattttgagacagagtctcactgtgtcgcccaggctggagtgcagtggcgtgatctcggctcactgcaacctccatcgcctgggttctagcaattctcctatccagaggtactgactgactgaatgttagtaagcaattaatgaacactgctctaatgacattaatttttttttttatcatttgtcaagttttgctaatgtaacttaaattttttgaggaggagtaatttaaattaccattttagaaaatcttttaagaatatataactttttattgttttctagttgtaaaatatttttaaaaaataatttgttatatttaaaaacaatacgtttatcttagaacaattagaaaatatagtcaggaagaataaaagcatccatagcctcacaatttagatgtaactgctataattccttagaatgta
